United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 58

SEQ ID NO: 858 - DNA, 410691 bp, Homo sapiens
ggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggtaagggagaacctgctcgcctcacctttgcctctggtcactcctctctcacgtaccgggggagcgactgttcgcagttctttcctcttggcagctctgggagacccttctcagtttgccgggagccacctgcgaagctccccctcgcttcacctaagcgtcccatccaagaggaggaatcatgtggggttgggtggggagcgggacagccaaggctgagctcctgggaaactcagatcgaagtagaagaaccccttctagacatttttgtgcgtctgggggacttttccccttctcgccagtctctggtgcgcccgccgctccccactgctcttttcctgcttctgttttgcctccttccccagtttcttctagcttaactcccagcctggttcgagttaccgatattcgtctgcaccctctggccccgtcttttgcccagcgtggttgactatgccgggactgagacacggcatgcgttccctcggcatcttccgtacagcggagcgtgcaaggagtaggaaaagctgataccctctctcactgaggtctcaaagttaaatgattatcttgtagtttgtagtgatcagcgagattctccgtgtccaaggtgggctagtcaaagtgtgttcgtttttgaatgatggtatcttctggtacttcaaagtttctgctgttacttacaactccactcgtgcaagcttgacggaagttctgatttatgatcactcacattcttcgctcacttcttgaagtgaagtctggttattgtttttgcatagcagtgttatgcctctgcctgaagttttctgccgaaaactttactcaggaggacatttttccatttctgacagttgtgtttggaaaagagtttcccagctattgccactttacttgagattgtgcttttagtattttggggatcactttgtttgcagttgccttgagtcaccttttcatacagtggtcttttagtgcttttagagttatgagttaagtagatcatcagagttaattaagatttatttgctgatacattgacagtctttccagaccagtaatgatctggttttgctattgttacaaatggtattacaggataagaaaatgcatgtcctcacagatcatcataggaagtatctataataaagtaaatatctaattttttttaatagtgaccactgaaatgagatctggcgtgagctggggagagtggactcaaccccccttcccccctcctttttttttgaaatggagtttccctcttgttgcccaggctggactgcaatggctgccatctccgctcaccacaacctccgcctctagggttcaaatgattctccttcctcagtctccccagtagctgggattacaggcatgcaccaccacgcctggctaattttttttttttttaagtagagacggggtttctccatgtttgtcaagctggtctcgaactccccacctcaggtgatccacccacctcggcttcccaaagtactgggattacaggcatgagccaccgtgcccggcaacccccttcttttttttttttttttttcgatacagagccttactgtgttgcccagacgtgagtgcaatggcgcaatctcggctcactgcagcctccgcctccctggttcaagcaattctcccgtactcagccttccgaatagctgggattacaggtgctcgccattacgcccagctaatttttgtgtttttagtagagacggagtttcgccatgttggccaggctggtctcaaactcctgacctcaggtgattcacttgcctcgcctcccgaagtgctgggattacaggtatcagccaccatgcctgccacgcccaccgcccccacccttccttttttttttttttttttttttaaataagatagagtcttgcttgttgcccaggcaggtaactcctgggctcaagcaatcctcccacctcagcctcctgagtagttggaattacaggggtatgccatgatacctggctttcagtgattctcagtatagtaaaaactacagcacttatgttcattctaaattgcggtctaaatgaaaacagtgacaagtttcagctgtggctgttacatgaagtccccacacgttctgacatcgaaacttttggtatatatctgcctgcttatagtctttttatcttctctacttggtgaatgattgttcattcttcacacttccatttcaaactactcttctgtgaagccacccctaatgcctctgggctaagttagaccctcagccaactctaccaatgagccctttatattattttatgatcatgtgatcagggtctctttttcttactagaatgggcattcaccctgggaaaaggtgatgttttattaatttacatcctctgcacctagcacagggcctggttaattgatttttagtagatgttgttcagtgtctgtggaaagcctgagagtaaggacagtctttaagtggcgcatagcacctagtccttagtgtattttatcagtaagctattgctaagtaagaaccgcaacatcacagtggcatacaacagttagtatttattttgttggtgcatctgggggccacctgggagctgaccgacataggctgtagtcatctgggtatctctatgatgcacatgtggtccatatgtctctaatctttggactagtgggctgaagtcctcatggtgatagcagaggtataagagcaagcccaaccacagagacacattttaaacccctgctcacatcatgtgtttatttcctattggccaaagtaagatatttggcaaaggccaaattcaaggggcagggaaatacaactccttccttggaggtgacaaagaggaagtgaatatttttctattacaatttaatcgatcacatatattaaacatttacaagctcttagtaaatgtatttcaaatgaatgaaccattcctatcctatatgcatctagtactggaaaactataaggaatctaagcagtgctagagatatgtgactccttttctcgctcgtgggacatctgaagaacatctgctctgtctacttgttttttcctttaaaattctgtctttccattaccctatagagctccaaggctgtctcatggccttttactttatgttaactattcagtattttctgtgttttgtaattaacaaaacataggttttgagagaaaacctggttgacctagtgcatcatttggttccaggttacatggtaagttgccaagatttgagtcaagcgagtacttaaattagatgaggtctggaagatgatgaatcaatatcagtagaggttatggatgttgttctgttttcctctttgttgagtctcattacatgttgacgaagatggccactggcaactccgggctttcatatccatccagctagtaatccagaagaaataactcttttccccaacatccaaatcatttcctccaaaggactctgataggccaaggttagaccaattgctgtgtccagaatggggcactttggctaacctgggttatcagcctaccctgtggcaggtaaggtaacaacctcactagaattacatagagtgagagaggggcagttcctaaaaggaggcaatgtagggcagatgaaaaagtagcaatgactgttacacacgtatttacaaaccacctaccgaatgaaaaatgttgcctagaggtatgaatacttggctgaagaatctgattatggaatatttcacagttcagtttatatcaaagcaggatgctttttcctggattggctaattgaaaaagttggttaagaggtgaattgtaataacgatacatattccaagtgaagttattttctgagtgtcaaatctttctaggtatttgtaattcttcaaatgtttatagttggcttccaacacctaaactgatagtaaacttttaagcaacttacctttatctttctcaaacattcaacttggcttttagggtaacgttaactccctttcagctctatgttattagttttgtaatatttaattaatgacaagttaaatatttaattgatgacaaatttaatttgttattttgaagaataagtagaataaaaaggtttgtgaagaagcacagttaacttggcaagcatacaacttgacactggcgtcagatgcatctaagtcttgatccagtcctaggtctactaccacgtactggatgctcttcactgatctatatcaagtatttagattgttttggaatgtatttttgtttcacctttattcttgactttgttttatatgcttacttttgctttctctttttcttcataaatgttatcttgttgtattgttcatctttttaagccatcttgaatccttttggtaatagttgtcatataagtcttccataagttgttggaatttggacaactttttactttctaacctcagttttctcttcacttaatgggagtgataacacatactttggaaggttgttttgagtatttgagataatatttgtaaaatgtttagcttggaatctgccacatcatagactcaaaataaatagcagctattgttattattattattattatttgagacaaagtctcactccatcatccaggctgaagtgcagcagtgtgatctcggctcactgcaacctccatgtcctgggttcaaacgattcttgtgccttagtcttctgagtagctgggactacaggtgcacaccaccacgcctggctaatttttgtattttttttggcagggatggggttttgccatgttgcccaggcaggtctcgaactcctgagctcaagcaatctgcccacctcagcctcccaaagtgctgggattacacgtgtgagccaccatgcccggcctgttgctgtgtcttaaaaacgggaaacactatagcttccgcatgtaaaggataaggttttctggtttttacttgcatccctgagcatagattcatatataaatatagggattcagaattctgttaactgtccttttaactgtagggtaactggaattggccatttttgttgagtggatcccaaatgtcagtatctacaggtctttttttcttgttccaatatccgagaaaggaaacctggttaagtatccctaatacaaaaattaaagatcttaaatgcttcaatatccgaaactttttgagagccgacatgttgccacgaatggaaaattccatgcttgacctcatgtgacaagtcgcaattaaaatacagtcaaaactttgttttatgcataaaattattttaaaaattatataaattgccttcaggctatgtgtataaggtatatatgaaaaacaaatgaatttcatgtttagacttgggtcccatcccaagccttctctttatgttttgcaaatattcccaaatccaaacaaatccaaaatctgaacaaattcaaaatccaaaacacttctggttccattttggataaggggtactcattctatattgcactctcctctctggcaggcagatataagactagctgcctattatctggaagctaagtgaaggaaagggatattgatcagaatgaagagcctgttatactactttaagctgtactcgatgtttaagatcagaactgttactcatcttctctagaaatgtatctatcaaagtaccattgtggggaagtgtagttgcctggtgttgatgatgtaatcagggcatctagctactcttctaaaagattttcaaccaatacttttgtgtttagccttactcctctacccatctggtcttcataagtgtttctgtatagttatgatcagtttagttagttctggagtaaacaaacatttcaggttaataaatgggtctttgacttccattgtgttcagttgcatacgttgtttacctaatgggtttagggaccttaggacttgatgtcttttttttcttcttctgatacttaatcttttgacatgaacttatttggtatatagcattgatatttgactaaatagctcattgacttacttaggagaatgagaaaatgccttgactattccttcaccccagataatttcatttgaatattatttaattatataacatgggtatttgaaggaggtcttctaaaagtggtagatgataaggttataacttgatgggagatttgagcatcccttcagttcattaaactaccaatattattgatggccttaaaataactgaatcttctttttaaagcaatgtcaaaagtaatttgacttgatctcctattgcaattacttttacctaacatggattatataaatgtcttatttgttctaaatatgttgcctgttactttcattgagtattagcttgttgtcgtattgtcgatcatgtagatcacgttgtcatactgtagatcatgcagatcatactaaactatgtaagccccttccagtattatacatgtggtgacttaaattattttttacattagcggtttatggtaccattaccttgacatcagagtaccttggtgccattaccttgacatcagagtaatttagactattaaaaggtatttactgtttggagtttaattgggcaagattgaagataatttataatgtctacattttatatttttaaaaatttaatactttgttttttcctaagagtaagctctgttgagtagtttgtttttcttcctgttgcccatagttgacagactataataagaccctgtattattattattatttttaaacagaatcttgctctgttgcctgcgctggagtgcagtagtgcagtctggctcaaacaattctcatgccttctgtgccttctgcctcccaggctcaagcagttctcgtgcctcagcctctcaagaacctgggattacaggtgcatgccatgcaccacctaatttttgtatttttagtagagatggggtttcatcatgttggccaggctggtatcgaactcctggcctccagtgatctacccacctttgcctctgaaagtgctgggattacaggcatgagccaccatgcctgaacaagaccctgcttttgattaagtcttttaaacaattaaaaataaagaaaaccttcaaagagagactaccttttccgatcctccatttaaaaaactaaccttctaaaacttctacatagtatataaaatttaaacatttttcctatgaaatatattcatactgatatattttcttgattattttgatctcagtttgcccttctacacataagaattatgcatctttggaataagtgttccttttttgaaaatagaaaccactctagctactttaagcagaaatgggtttagcatagtgaattaagtgcttacaaaatcactggagaaacagtctaagagtgaatcccagaacaacagagtgccagaacagtataaagctgcaactggccagccaagtgaaatactacctctaccacaataaagaacctgaagctgtctccaggattatatcactttagctgtgatctttggtgaacaggaagctgctgtgccataactatagattctagaagcaaagtatgccataactatagattctagaagcaaccaggagaagtgatgccacttgtgctccctctcactctccattaaattagagagtcaacactggaacctctgttaaagctgcttcagaaaaaccaagtatctttacaactattctaagcagcacaagttggttgtgaattatagttaacaccatctttccttgtttcaaatctcatgttagtgcatctgattagttaaaccaaaatcacatctgaaactttggctgctacggattccaggaaatacagcttctagctttccaactctataaaatagaaaggtatcttggaagctggaatggataggtgatgccggtttatcatattctctacaagcagaggtgttaagagtttagggtctgtagtcaggcagcctggattttaaccttgggtttgactcttgtgagctctctgacgttgggcaaattgcttaactgccctgtgttctagttttttctctcacgtagtaggtatctatcccatagtgttgtttgagtatttaatgaagaatgtggtaagacttgcattaattcttactcagacatgtaatgtaattttcttgtaagcaatctgggcctggagttttctttgtggtaagttttatatttatgaattcagtttttgaaatagtttagactattcggattttccgtttcttcttgtgtcagttttagtagttgtgtttttctaggaatttgtccatttcatctaaatttttaaagttagttttcataaatatccctttattattattttttaatgtctgcaggatttatagtaacctccctgtatcacattgatagttcttccttttttcttattagtcttattaaggatttatcagttttatcaatcttttcaaagaaacaacgtttagtattatcgatcctctctcctgtgtttgttttctacttcattaacctgtactcttttagggatctattttgcttatttttcaaatttttgcaatgaatgcttattaacttttggcctttctgtatttttttctgtaagcctggatttagctgcatgtcatatgttttgaaatgtatttctattgtcattcaattcaaaatactttataattttctttgttttttcagagatagagcctcactctgttccccaatttggagtgcaatggcttcatcattgctcactacaacctcaaactcctatgctcaagcaatcctcttgcctcagcttcctgagtagctaggactacaggcagacaccaccacatcctactaattatttttattttaaaatttttttgaggcagagtctcgctgttgtcaaccaggctggagtgcaatggcacaatctcggcttactgcaacctctgcctcctgggttcaagcgattctcctgcctcagcctccccatcagctgggattacaggcccccgccaccacacctggctaatttttgtatttttagtaaggatggggtttcaccatgttggccaggctggtctcaaactcctgacctctggtgatctacccacctcagcctccccaaagtgctgggattacaggcgtgagccactgtgcccagcctatttttattttttgtagatatggggtcttgccatgttgctcaggctggtctggaattcctggcctcaagcagtcctcctgcctcagccttccaaagtgttaggattacagacatgagccactgcacctggcctatagtttttattatgtgttctttttctgtttcacaggttatttataagtacattgcctagtttccaaatatatttggcttttcaaatatctttttctttatttttgtttgcttatgagtctgaagttattttatatctaagatttttctatcatgggaaatataaaacatatataaagctagagagaacaatacaataatcattcaggtactgataagcttcaacactgttaactcatgaacagctgtgtttattctcacttctcccattgccccaccaccattattttgaagcaaatctcagatgtcattttttctttaaatatttcattatgaacttataaaaatgacattaaaaaatcacaataccacatcaacccagaataattaattgatgtcatgaaatatctgatcagttttcaaattttccccattttgtcataatttttctttataatttgattattttggaggaggatccaaataaaatccaagcattattattggttgatatgccccacacttaaaaacctggcttttagcaacaccagcaaaattattcattatgctaaaacatacataccttgcatactcaatatacctccccattcctaggtaagctttgaaattcaacttttctctcctagctccataggttgttaaagaagcagcttatcttcttggttctttcttttagaattgacacatatccccaggagaaaagtggttgcaaaagtcagagtaacctttgtaggttttctccttttaaagatataagactgcaagccaagtgctgtggctcacttctgtaatcccagcactttgggaggccagggttgaagatcacttgagcccaggagtttgaatccagcctgggtaatatagggagaccccatctctacaaaaaatttaaaaaattaaccagacgtggtggtgcatacttttagttccagctgctagggagcctgaggtaggaggatcgcctgaacccagctgggtgacaggctgggtgacagtgaggctgcgtgacaaagtaagatcctgtctcaaaaaaaaaaaaaaaagatatcagacttgtaaatcttcactgtctttgctctctgatgtcttcaagtaatgctttaaaatattttgttcatcttttatagttatcttcagtaggagatatatctgaattatctaatctgtcattattagaagggaaagtccccttaccacttaaattttgaacattttgaacactaaacttactatatgtttagataacatgactgcaatatttggctttatttcaaaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggtaaccattattctagttaagattttgtaaacactagatttctcttggataagaaaaacaatctaataagaatcatcattatttattctattgagtttacgggcaatctttttcagaacttaggttttacaacttgttttaggaaatcctgctattttaactgggtcttgctgtattatcagactaaaggaaacaagttctcacaaatatagtggcatttgaagataaggtggttgcaaatcaaagggttcatttaaacattctgtcataacatttgtttatgacaaaaagccatgtttgttctgaggcaaagaaggggctgaaagtgaaaacagaatttttccaaactacccttcaagtaataatctgaaaaatcaagctttggtattttttccatttatttatttttttattactttcagaatagaatcaatcttaagactaaaggagaaaattcaactgaaaacactgatattgtaagaagcatatggactgttctgactttaaaaatcattagaaaagagacaagagagttacagactgcaataacaagataccattttactgaattaattttctctcacagttatgttctagcatgttgcaatattactgtaggtgtttgattttataaaatctgccttttctgacagtatttcacattttgaaagggagggaggagcacatttacagtaactgtaagaagagcaaaaaacattttaagtgtaaatgtgactgaataaggtttaggtgaggctaggaataattttaagaaaaaaattttcacaaagggtatctttttatagtatatgtttctcgagctattttagtttagaatatctaagctttaaaacataatagctaaaaattgggatttggataaaaattgactaggttgggcaggaaagaacaattagaatctggttttataatactattttactgaaaatgccggctgggcgcagtggctcatgcctgtaatcctagcacttcaggaggccaaggtgggtggatcacttgaccctaggagttcaagaccagcctgggcaacatggcaaaaccccacctttacaaaaaatacaaaaattaattgggcatggtggcatgtgcctatggtcttagctactccagaggctgaggtggaaagattgattgagcccgggaggttgaggctgctgtgagctgtgccattgcattctagcctggatgacagagtaagactctgcctcaaaaaaaaaaaaaaaaaaaaaaaaaatcaaagtaaagaaaatgccaaataaaatatataaacttacagattttggggtgtacctgtacattaattatgagattctcattaggataccccaactgctttgccttttgatggagataatcagttttgtccttggttagaaaggaaagaaaggtatatgcttactctgtgtcaggtacagagctaggtgttttgatgtattccatttcaagtgatccttacaataactttgtgaagcaggaatggaaatgattaaacatttagaaggaaatgaaagacaagaaaggacagagtgatccagtaggggtctttaggtataaagttctaaaacttatcttctgcatccactggtgaaaagagacaataagtataaattatagcaagaataatttcctgacatcttcaaggccctggtaagggttagccagtgagaatgtgaaatagtctcttcttgagatctttcaaagcaagtcatggttatccacttgtagagatgatcctcatgtagtactatccagagcccaagctatagagtaaactgggactcctttccaacagcattgttctttgtgatatatcttcttgtgatatatgaaagaataaatgtatatctatacaaatatgacattgagttggaaaaaagacacgtgactgagctaaagtgttggcttcattggctgccaagattttttttttcaaactagttagtatctgtccacattagtgcaaaaataacagtactttgggaggccgaagcaagacgatcacttgaggccaggagttcaagactagccttggcaacatagggaaaccctgtctctacaaaaaattttaaaaattagccaggggtggtggtatgtgcttgtagtcccaggcactcaggaggctgaggcaggagaatccttacagcccaggatttcaaggctgcagtgagccataatcatgccactgcactccagtttgggcgatagagtgagacccctttagggattacaggcttgagccaccatgcctggccagggtttctgttttttttttgttttgttttttaatattacttggaatagcccaaagcagtggtttagaagtagttttgcaatgaagtggagtactctcatcttcctctatattttttaagtttgtttaatcagcagtaatgatgattgaaaaaaaagggatgaatagtgttaaattcaaaccaataaatatttaatagcaccttctatatatatataaaaaaacagaaataaatataaatatacaatactatgcttaaggagctgaaatagataaaagttaaataataaaaataattaaataaggaaagttaactattcagtgtaagaactctcaccaggctgtgcataagtactttcaaaatgagtggaatactcacacttaatagaagtttagaggtaggagtgagttttggaaatgatttttaaaaaaactggatctggaagtacttgaaagttctgggagaaggggatgcccagatgatggcaaagatactagaaaatacacagggtaagaaagagcaagacagaatcatcagaggctactgagaagaggccattgcagtctttagctggaggaatgattatcaatatatattatatggtggatctgctccaggttcttggttttttttttctttttagagaaggagtctcaatctgtcacccaggctggagtgcagtagcccattctcagcttactgcaacctttacctccagggttcaagtgactctcctgcctcagcctcctgagtagctgggattacaggtgtgtgccatcacacctggctaatttttttgtatatttaatagagacagggtttcaccatgttgggcaggctggttttgaactcctgaaatcaagtgatccacctgccttggcctcccaaagtgctgggattacaggtgtgagccaccacgcccagcctgctccaggttctattaaggggctaagcattggagattttgggctgggcacagtggctcatgcctgtagtttcagcactttgggaggctgagaagggtggatcacttgagcctaggagtttgagaccagcctggccaacatgctgaaaccctgtctctactaaaaatacaaaaaaaattagctggacatggtggttcatgcctgtaatcccagtatcccagttactcggtggctaacacatgagaatagcttgaacgtgggaggtggaggttgcagtcagatgagattgtgccactgaactccagcctggtgacgaagtgagactctgtatcaaaaaaaaaaaaaaaaaatagacactggggatgttacaagttcctcacaaatcataattgtaaaccccattttcactttctcagttcttatcgcctaagatcacctgccacagcttaacagagataacacacacagggtgatcagcacttgttatcaatacctattagttttgtctatcttaaacttttgctacccattcatttctgtctccttaaagttttattagagttgaagtgaatacccccaagagggttaatgcctaggtatttgtgaattcaaaatacctagttgtatcttgtttatataagcagtgaccttaaaaactttgaccattattttctgtcagccttacatgataataattaaaatgaaggaataattttcccttagtgacttttcatctgaagctaaagtttaaacaatgtaaaagttaggttacaaaactcccaaggtttgttgtcgtctttgtctacctgtggatggtgactctttgtttcaaattacgtgttgagagttatgaaatgaaaatccagggtatgactcctggattttgttccttgacaaactattcttgcctttctggtactttctttcttcctcttttttgagacggtctcactctgttgcccaggctggtatgcagtggcatgatcatagctcactgaagccttgacctcccaggcttaagcaatccgcccgccttagtctcccaagtggctaggactacagttacatgccaccatgcccagctaatttttgtatattttgtagagatggggttttgctgtgttgcccaggctggtctcaaactgctggggtcaagggatctgcctgccttgacctcccaaagtgctgggattacaggcgtaagccactatgcctggactttggtactttgtttcttagaactttgtagaagaggctcttgttattagatagatgcaagtatataagctaagagacaccaggagatgtttataccaaaattctttgattaaaatttccttttccctatctcataaactataatatattgttgtataaagcttgctgtgtagatacaagaaattgttcctatctcccatatttcaacttaattccagcacagcaggaatttgcatattctggaagctttaaattgcttccattatatatggaaccatagaagtgcctgagttattcatttataagtgtatacgtgtcttaggtatagagaaagctgagaggcctgaactgtccttctttgtttgaagaagactactgttactatggtaattgctgaattagaaggctagaactcttgacttttgccttgtcctgggaacttagaatgggcaaaaagtcaagaatgactttgtctttgactgtgttgcatctttctattataacaaatgcactacaccgagatcataccttccatttctagggaaagaaaaagacaaaccaaaccctcacctcattattttagttatatagcttgtgaatgttcagtaaataaaaactagtgattagatggtttgcttatgaaattagatgtatggcagattatttttgtatgtgtagtataacctaggtacgtatatagagcttggcgaggctggcatctaagacaaatacgaatactgcatctatatttaaaagcatagttttattgttagtagtgatattaacaacagaggtgattatagcaataaaacaacgttttttaggacctttaaaatatgatccgtagtttccagaaaactgtgaattccattgtgtcacatttttatggatcttaaatcatagatatgggctagtataacttagttttctaatttgttttaaatttcattgcaattttttatgtaacgtgcttacatataaatatactgtttcagtaaattgaaatgttcccttaaacattttccaaatcccaatatagtacatgtagaaaccatctactaatttcctaaaacccatgagactggaaaacatctctttagctatttttaaaatttgtaatttttaagcacttatttttgaaagaactccaaagcatctagaattaagtttgtttgtttgtttgtttgtttgtttgtttgtttgttttgagacagagtcttgctctgtcaccaggctggagtgcagtggtgcaatcttggctcactgcaacctccgcctcccgggttcaagcgattctcctgcctcagcctcctgattagctgggactacaggcatgtgccaccacgcccagctaatttttgtatttttagtagagacggggtttcaccatgttggccaggatggtctcgatctcttgacctcatgatccacccaccttggcctcccaaagtgctggtattacaggcgtgagccaccgcgcctggcctagaattaagtttttaaaaccttctgaaaacctctcctctttgttcttctgcagccttttaggacccactccactctctggcttactttgtatttttggatcaattttcttttactcacaatacaatttacataacaaaatttgctattttaatcactttaaagtatgcaattcagtggttttaagtatatttacaatgttgtacagccttcaccactattccagaactttttcattaccctgaaaagaaaccccatatacattggctgtaactccccattctccttcttcctctagtccctggcaaccagtacttgactttctgtctctatgtgttgtctgttctggacactttatgtaaatggaatcctacaatatgtggccctgtatgtctgtcttctttcactgagcgtaatctttttaaatttaagattcagccatattgtaccacataacagtacctcatactttttttatggcatcccactgtatggctaatgtattttgtttttttcatcagttgatgaacatttggattgtttctaattttgggctattatgaataatgccactatgaatatgcatgtacaagtttttgtgtgaacatatgcttttaattctcttgggtatgtacccaggagtggaattgctgggtcatgtggtatctctatgtttaactttttgaggaatagccaactatttttcatagggctgtaccattttatattctaggaatgtatgagtgttttagtttctccccatacttatcagtgaagcacttgttaatttttcttcttttttaaaaaatattacaacccttatagtggatatgaagtgatatctcactgtggctttgatatgcatttctctattgtctaatgatgttgagtatcttttcatgtgcttattggccatttgtattttttttcttttttttgagaaatgcctattcaagttctctgcctgctttttttttaatgttttattttctttccaatgggacttttgcactcctgtctttgtgtttttaattgagctgtctctttttattgtcagagttatttttatatattctggatattagaccctatcatacatgtgatatttgcaaatattttctcctagcctgtgcattttcttttaactttcttgatatgtagtatcttttgatgcacaaaatttttaattttgatgaggtgtaacatgtctattttttcatttgttatctataattttaatgtcatatttatccatggcttgcttttcacctctagtttcaacctcttggcatgtttaggcttcagatttttcctctagcagcttttctttttccctcttcaaataattatctgccccaatgactcgttcctcagtccttactcagcaggccatttttaggaagaaactcaaagttcctcagttctaggatagctttaggtgcttgtgaaaaaaatggtttggccctggggagaagaatctggccattgttaatggtttgggataaagctttgaagtttaggacaaagatagagtgaactttttatactctgagtatgttggcaaaaaatcgtagttgtcacataacattaattacaagtataatgctaagactgaagtttttaagaatttaagtttgagcagtttcttttgttataggcattactagcgaaccacagagatcagacaggacctaggtaaatagttgaaaaactaagactagacaagagcttgtagacttgacgcttgaataaagtagatgactcagtgaaaaagaacagtccttaagtttggaacaaatgaaatggaacttgaagtaaccaaactgaatctttgtcatactatattgatagcagttttcctataattagaactaacttcttatagttttgaaaatagtgattattaacattattctttcataagatgccatcttttagggtttttaaaccctgataacttcatggataattgatttcatttttataagtatcttagaggtataggatgaggtttactgtttctccactgcctacccccttaaaaaggtcatatggtaagcattctgtttctttaagaaataatgctttcggccgggcatggtggctcacacctgtaatcccagcactttgggaggctgaggtgggtgggtcacgaggtcaggagtttgagaccagcctggccaacatagtgaaaccccatctctactaaaaatacaaaaattagccgggagtggtggcagacacctgtaatcccagctactcgggaggctgaggcaggagaatcgcttgaacccgggagacagaggttgcagtgagctaagattgcgccattgcactccaccctgggtgacagtgcaagactccatctcaaaaaagaaataatgctttccagaatgacaagttttgcttcagtgataagttgaaatcaaattttttattttgaatagtgtttttaacttttaaaacatgtacttaacttctattatctcagtttgttttttagaaattaaaaaaaattaccattattacaaaatatgtgcatgttatttctacttgtttcagatttaattacaagtatttatttcatcctgatatatgagagacagagagggagagagacagatgcaagaagaagagaatattcttattaaaattaggccataaaacaattccacttttagcaatgtatcttaagtaaacaatcagaaatagatttgatgttttccacaagaatgttcactgcagcagtgtgcacaatagtacaaaattgggcacaatcttaaaatccaacataaagttctggttcaataaattatggtgcagacatccattgaacttggcagccattaaaatcatattatgggatattacttaatgatgtgggaaactgtttataatacatactttgttataattggtgaataacaaattgcaaaacaatatggacaagtgctttcagttctttaataaaaggaatatgtgaacatagaataagatttgaaggctgcgtaccaaaattctcatgttatctctccatgttaggattatgagcagttttttcttgaaggaaccgtatattgcttttatattaaaactttttttggatttcaatactgtattgttgataattttaatagttttatcttacacttttttttttttttttttgagatggagtttcgctcttgtcacccaggctggaatgcaatggcacgatctcggctcacagcagcctctgtctcctgggttcaagcgattctcctgcctcagcctcctgagtagttgggattacagacgcctgccactacacctggctaatttttgtatttttagtagagacagggtttcaccatgttggccaggctgatcttgaactcctgaccttaggtgattctacctgcgtcaacctcctaaagtgctgggattataggcgtgagtcatcttgcattttggaggttaaatattttgctcattttcatcttttcttagtatttactgtagttttccatattagtgtaaataacctcatctctacctagaatcttataggcccagagaagacaaagaatcattatgttattatgattgttttatttgtgattggtgactttgttttttcagattatgatactttggggcctagtgcttatttggtcagtcatattgcaaataacttttttctttttctttttctttttttttttttgagacagagtctcgctctgtcacccaggctggagtacagtggcgcgatctccactcactgcaagctccgcctcccgggttcatgccgatcttctgcctcagcttcctgagtagctgggactacaggtgcctgccaccacgcccagctaatctttttgtatttttagtagatacagggtttcactgtgttagcctggatggtctcgatctcctgacctggtgatccacccgccttggcctcccaaagtgctgggattacaggcgtgagccaccacgcccggccaacttttttcatctcatttaattaccctgtcaaaggactgggcctctgtggcagaaataaagaaaagctctatttttatggaaagggtaatacagtttacacgtattctcttactatgttttagtttgcttggctgccaaaacaaaacaccacatactggggggcttaaacaagagaaatttagtttcttgcagctctgggagctagaaatctgagatcaaggtgttggcaggtttggtttcttctgaggcctcttccctttggcttgcagatggccgccctcacactgccttttcggaggccattcctctgtgcatgcatgaccctgatgtctctctgtgtcctacctcctcttttttttttcagttgataatttattttattttattttagttttattttttgaggcagaatctcgctctgtcacccaggctggagtgcagtggcgtgatctcagctcactgcatccttcacctcccaggttcaagcaattctcctgcctcagcctcccgagaggctgggactacaggcgcatgccaccacacccggctaatttttgtatttttattagagatgaggtttcaccatactggccaagctggtctcaaactcctgatcttgtgatccgcctgcctcggcctcccaaagtgctgggattacaggcatgagccactgcacctgacccctttttttaatttgtaatttcaattttcatttttttccataagttattggggtataggtggtatttggttgcataagtaagttcttttgtggtgttctgtgagattttggttcacccatcagctgagcagtatacagtgtaccatatttgtttatcccttgtacccctcccactcttccccgcaagtccccaaagtccattgtatcattcttatgcctttgcatcctcatagcttagctcccacatatcagtgagaatatatgatgtttgattttccattcccgagttacttcatttagaataatagtctccaatcccatccaggtcactgcaaatgcccttaattcattcctttgtgtagtattccattgtatatatatatataccacagtttctttatccactcgttgattgatgggcatttgggttggttccacgattttgcaattgtgaattgtgctgctataaacatgagtgtgcaagggtctttttcgaataatgacttattttcctctgggtagataccaagtagtgggattgctggaccaaatggtagttctacttttagttctttaaggaatctccacactgtttccatagtggttgtactagttttcattcccaccagcagtgtagaggtgttccctgatcacagcatccacgccagtatctattgttttttgactttttgattatagccattcttgcaggagtaaggtggtattgcattgtgcttttgatttgcttttccctgatcactagtgatgttgagcatttttttcatatatttgttggccatttgtatatcttcttttgagaattgtctattcatgtccttagtccactttttgatgggattgtttgtttttttcttactgattcgtttgagttcgttgtggattctgaatattaggcctttgtcagatgtttagattgtgaagattttctcccactctctgggttgtctgtttactctgctgactgttccttttgctgtacaaaagctccttagtttaattagatctcagctatttatcttttttttttttttttttttgcatttgcttttgggttcttggtcatgaaatccttgcctaagacaatgtctagaagagtttttccaatgttatcttctagaattttgatagtttcaggtcttagatttaagtcctcaatccatcctaagttgattttttataaggtgatatgagtatccagtttcattctctgcatatagctagccaattattccagcaccatttgttgaaaagggtgtcctttcccccactttttgttttgtttactttgtcaaagatcagttggctgtaagtatttggatttatttctggtttctctattctgttccagtggtctctgtgcttatttttatatcagtaccacgctgttttagtgactgtggctttatagtatagttgaaatcaggtagtgtgatgcctccagatttgttctttttgcttagtcttgctttggctatgcaggttcttttttggttccatataaattttagaattgttttttctaattcggtgaagaatgatggtggtattttgatggggattgaattgaatttgtagattgcttttggcagtatggtcattttcaccatattgattctacctatccatgagcatgggatgtgtttccaattgtttgtgtcgtctgtgatttctttcagctgtgttttgtagttttccttgtagaggtcttttgacgtcttggttaggtatattcctaagtattccttttttttttgcagctgttgcaaaaagggttgagttcttgatttgattctctacttggttgccgttggtgtatagaaaaactattgatttgtgtacattaaccttgtatttggaaattttgctgaattcttttatcagttctaggagctttctggaggagtctttagggttgtcgaggtaaacaatcatatcatcagcaaacagtgacagtttgacttcctctttactgatgccctttctttctttctcttgtgattgctctggctaggacttccagtactatgttgaagagcagtggtgagagtgggcatccttgtcttgttcctgttctcagagggactgctttcagcttttccccattcagtattatgttggctgtgggtttatcatagatggcttttattacattaaggaatgtcccttgtatgccagttttgctgagagttttaatcataaagcaatgctggattttgtcgaatgctttttctgcatctattgagatgatcatgtgatttttgtttttaattctgtttatgtggtgtatcacatttattgatttgcatatgttaaggcatccctgcatccctgatatgaaacccacttgatcatggtggattatctttttgatatgttgttggattcagttaactggtattttgttaaagatttcaacatctgtgttcatcaaggatatcagtctgtagttttcttttttggttatgtctgtccctggttttggtattagagtgatgctggcttcatagaatgaattagggagggtttcttatttctttagcttgtggaatagtgttaaaaggattggtaccaattcttctttcaatgtctggtagaattctgctgtgaatccatctggtcctggacttttttttgttggtaattttaaaattaccatttcagtctcgctgcttgttattgttctgttcagggtatctaattctcatgctttactgactgggctagctgggtgcctcagggtatctaatttttcctgatttaagctaggagggttatatttttccaggaatttatccatctcttctaggttttctagtttatgtgtgtaaatatagtagccttgaatgatcttttgtgtttcagtggtgtcatttgcagtatctcctgtttcctagtgaggttatttggattttctctcttcttttcttggttaatcttgctaatggtctatcaattttatttatcttttcaaagaaccagctttttctttcatttgtcttttgtattttgttgttgttgtttcaatttcatttagttctgctctgatcttggttattttctttcttctgctgtgtttaggtttggtttgttcttgtttctctagttccttgaggtgtgaccttagactgtcagtttgtgctctttcagtcattttgatgtaggcatttagggctatgaactttcctcttagcatcacctttgctgtatcccatagattttgataggttgtgtcattattgtcattcagttcgaagaattttttaatttccaccttgatttcgtttttggcccagtgcttatttagtagcaggttatttaattttcatatatttgcatggttttgaaggttccttttggagttgatttccacttttattccaccatggtctgagagggtgcttgatataattccagttttcttaaatgtatttaggctcgttttatggcctatcatatggtctgtcttggagaaagttccatgtgctgttgaataaaaagtttattctgcagttgttggacaaaatgttctgtatgtatctgttaagtccatttgttccaaggtatagtttaaatctattgtttccttgttgactttctgtcttgatgacctgtctagtgctgtcagtggagtattgaagtcctctactattattgtgttgctgtctatctcatttcttaggcattagtaattgttttataaatttgggagctccagtgttaggtacatatatgtttaggatcgtgatattttcctgttggacaaggccttttaccattatgtaatgtccctctttgtctcttttaactgctgttgctttaaggtttgttttgtctgatataagaatagctacgcctgctagtttttggtatccatttgcatgaaatgcctttttccacccctttaagttaagtgtgagtccttatgtgttagatgagtctcttgaaggcagcagatagttggttggtgagttttgatctattttacggttctgtgtcttttaagtggagcgtttaggctatttacattcattgttagtatcgaaatgtgaggtacccttgcattaattgtactctttgttgcctgagtactttgtttttttttgtttttgctttttaacttgtatttttgttttataggtcctgtgtgatttatgctttaaagaggttctactttgatgtgtttccaggatttgcttcaatatttagagctctttttagcagttcttgtggtggtggcttggtaatggtgaattctctcagtatttgtctgaaaaagactgtaatttccttcatatatgatgcctacttatatgatgccttgtttcactggatacaaaattcttggctgacaattgttttgtttgtttgagaggccccagtcccttccgcattgtagggtttctgctgagaaatctgctgttgatctgataggattttctttataggttacctggtgcttttgcctcacagctcttaagagtctttccttcatcttaacttttgataatcgatggcagtgtgcctgggtgatgatccttttgtgatgaatttcccagagcttcttgtagttggatgtctaggtctctagcaaggccgggaaaattttccttgattattcccccaaatatgttttccaagcttcttcctcaggaacaccgattattcttcagtttggtcatttaacataatcccagacttcttggaggctttgttcatattttcttattctttttctctttgttggattgggttaatttgaagatcttgttcttgagctcggaatttctttcttctacttattcaattctattgttgagactttccagagcatttcacatttctaaaagtgtgtctgaagttttctgacattttgactgttttttcttaatgctatctatttccttgaatgtttctgccttcacttcttatattgttcttttggatttgcttgcattgggctttgcctttctctggtgcctccctgattagcttaataactaacctcctgaattctttttcaggtaaatcagggatttcttcttggtccggatccgttgctggttaactagtgtgatttttttgggggtgctaaagagccttgtttagtcacattaacagggttgtttttctggttccttctcatttgggtaggctccgtcagagggaaggtctagggctgaaggctgttgttcagattcttttgtcccactgggtgttcccttgatgtagtactctccccgttttcctatggatgtggcttcctatgagcagaactgctgtgatgtctctcctgggttctagctacccagtgagtctacctggccctgggctggtactggaggttgtctgcacagagtcctgtgatgtgaactgtctatgggtctcttagctgtggatactagtgcctgttctggtggaggtggcggggtggggggtacaatggagtccgtgagggttcttagctttggtggtttaatgctctctttttgtgctggttgacctcctgctgggaggtggtgctttccagagagcatcaactgtagtaatacggagaggaactggtggtgggcggggccctagacctcccaagagtatatgccctttgtcttcagctaccaggctgggtagggaaggaccatcatgtaggggcagggctaggcctgtctgagctcagaatctccttgggtgggtcttgctgtagctgctgtgggggatgggggtgagattcccaatacctcctcttcttataaagaaaccagtcacattgcattagggcccaccctaatgaccctattttaactaaattacctttaaaagccctattgctaaatatagtcacctttcgaggtaccagggttagggcttcagcataagaatttggggaaagtgggaggcacacttcagtccgtaattctatatatcacttatgacaagttttaaatgacaaagtgaatgttgaagtaaatttttatgaattatcaatggttattacaaacttttataacattctaaagaacttcagctgtaaattatatgggagagaatgtagaggattgtagatggattagcactaattttttttttcccctgagaaactcaaactctatgacctattgcacaattgagtctatttgtatataacaaatagtatttttcataggtattaataaaatatcagtgtcaagtcaaatatttaaaagagttgttaactgaagcgggattagaattaaaggcattagaattaagattagtgggcaaaagatacaaaaactttgctccctgacattcataactgtctgtagatggaatagcagacctgaagattggctatttctttgtgactgaagttctgaattttttgtgctgttatagagtaaatttatgtattgttgagtgtggttctggaaggtgatgatttttcagcttgattctctaagtatactgtgtgggtttttggctttaaaaaggttaagaacttccctttacataatgaaaacccaacaagtaaatattatttgttagtactttaagatgtagattaatcatttaaaaagtcattatgttaaatattctgaggaccatactgttatttctttccttctccctctagtgggcagaaaatattcttaaaatatagcatggaataatttattgctattgggtataccataatatacagtctcagtctcagcttttttgaatactaaaaatgttaacatttcagaatcattaaagcaaacgctttactcctttctaggcataatagtggatccttgaatgttgaagatgtccttaccagctttgacaatacaggaaatgtttgtaagttatacattcactctatagaaatatatttagtgttttacaaagtgaatttatagttgatgttttcttctcactaatatttattatactcactaaatgtatgcatatatgtatatataatagaaagtttgactgtctttagctgcaaaataagccttgtataaggtacaccgacaaaatgggatactgcagtttctaaacttcgcaggtgtgtgtgtgtgggggggaggtgggggagggagagagagagggagatggagagagtaggtcagaaagaacactggacactgaagtactgtcccttttatttttgtttccattttgacctcagttaattcagtagtggggctgtttcttccttctttgctttgtttcgggtgctttctttgccattccctgcttctttactttcactgtagaataaacccagaacatatttttcttgatgctactatacattaataccagagtgtttttgtttgatgcagtattacaatattacagaatatattgccttttcatcaaagcttctgattaattggtgatagatttgtccactgagaaaatcacttaaatatttcttataattcttgtaattaatttcatgtgatgaaagacatcagccaagaatacctttatgtcactgagttaaacagcataccatcataggagctatggactttttatgttttttgtataggacatttctcttaagatagtgaattgtcaatgaaatatgagcattttaaatgtaaaaatagtactcatactctttttctcaaagaaaatttcagaactgttaacttttggctgaatttaggtagtgtctttggcttaacaatgcagttttatcaaataaatagatttgcatagaattgtgttcagtaatactcagacaacacttttgttcttatgtccacattatgataagcttttgattttatagaaaaatatttgtggttcactaaggaatctataaatgtccttaaattatcctaaatacctaaaataatgtaggtttcttttttatggatagtgactgatgtgccttttagtttctttctttttttttaaattttccaaacaccaacttgaacccgaatgccttttagtttttccatgttggcatttagtgaattctctcccacttaggtgtatctcatatttttattaggtctaggcaaggactgggcaaagcataccaatgatggttgaggatacatactcttttagttctggggtaatgttaaatatcattgagtcaggcttaaacatatgtaatttcagaaaatgattctagaatgttaaatgtggaatttttgattcagtaatgtaaaagtcaagtattgttcccagttggctccgtatgaaatagggccactagctgacagcattatgtaaaataaaaataatttcctaaaggcatcaattattattttaggcatgaatgactgtcttagccttctctaacattttttcccatcaacttgttccataccccgtgttgttgttgcatgaacaaacggaaatattgcatattcagggtgttttttcactgttgtctcttgtttggtagaaaggtttaagactttggaatgatactcacctgcatttgacttctggctctgaaattcatcttgagcaatttgtatcatctctatgaacctcaactgttttcatctcttagggctggctgtgttataaagaaagtacgtacatactgcatggctgagagttgatatgcaataaaagttattaattattactggcgatgagtacctatataacctcttttggttttttcctaataaagaagataatattattaggattattctgtcttatactattttaattgaactaacagggcagaaaaattagataaaattagcaaaatagctgtttattaaaatgcctcattataaatgttgccttaaaaacctggatatattgctgagtgatagaagtggtgacaaaaataagacctcttaaaatatgttgttttgtgtaccttttatgtttactttttattttaacagaaaaatctatatagatgtttcatttaatgataaattggtaaagtcctgttccaataaagtaaatattgattatgacttttatataatcttggacgtaaagtaaccatggactgaaaaagtgatttttcacttgatgcctcaaaaatttgattttattatgccaatagtgatattgagtttgtgactagaaaacccagcagagggcgccacaatcataattctttgtcatagcccaatataattaggataaatagctcaaataataaccctaagcttttaccatgtagacatataaagatgtgtctaaacatttctatttgattcatttataatatatttaatatattcagtaattcaaaaatacaaaaaaatagatttttcctggccgattttttaatttttaaaaatatcagtttaatttttctacttctagctttaaataaagaagtacttttgatagagagtgaaagttccatacaagagtatcagttcataaatcaccaccatggtagtatgttaaaggacaattagaatgaggaaaaaagtttctaatagatgagagaaccaagagatggaattatctatttattttaagaatttgtttctaggttaataatgcttcctagtaatagaaaaaacagcttaactaaaacattttctagtcacaaaaacctgatatgtgtagatacagtaaaaaaaggtatggtcatggtttagtagaaccattaatttcaattgtaagttcattttgaatatcaggggatgattatattcattgcaaattttcagagatgaaaggatcagtcttaccttctgaattggtttatgctctaagtgaaaagacgtggaaaaatctctttaattttggaaaataaacctctagataacttatttactattagaaaagataatttttttgtatttacttttttgtatagaagttttgtggttttaaatgtatgaactgcaaagtgttttatatttttgaggtaacttttcattgcttgaatttcttcgaatgttgtgggaagaaattaagaggaatctcgtacagaatgaatcacgtctgcgtattgatttattgctgtgtgatatacgacccaaccttctttttatatatttatatttactatggtggaaaacaaaccattttgaaagtgcttacctttaactaggaataggtatgtatatttcattatttggtttctactacttgagaacctactttcttttgagatatcaaagcttcttggtcaggaggttgtgtctactattgattcattgtgcccagaaagacatgctgacaagctacctagggaagagtataggatgacatctttcacctcagatgaggtactggctgcttctgtgtctcctttgatatgtcgctcagataccttgggtaacaagggagtgctctataagcattgtagcagatttcttgcttctgctttttctgtgggcagggactcctttctagcttgtcctctgacctctggtcaaagaagctgcaccatgctgtctcttccaaaatcattttccttttctccaaagttatttcgttccactactgaaaggaatttttaaaaatgtaattctcagtgcttacttgatccaaatttggataccatagtatctaatttaactatttgttgtttataacatctcatcttatgcttgggtctgtagtagattcattggaacattttaagcacatcatcctttgttgagtagtatgaacagaagtgttagtacttcgtataatttattataaactatgtacaatataatgtatataatcctttaaaggataggaggtcagcagttaaatcatttcagtaatatcattgtgaagcaggattcctggcaaatgttgcagcttaagtctgggggatgtattggtaaaacttctctactattctttgaaaaaaattttttttcttggttgagctccatgacaggaccctgtggtagttggtgtcacattatctcctggaggaatttgtagaccctctgccatatatacttgtacatgtgacagtggtgatttttgttttccctagtgaattctaagactgaccaggattttttttttttttaatggagtttcactcttgtcccccaggctagagtgcaatggtgcaatcttggctcactgcaacctctgcctcccaggttcaagtgattctcctgcctcagcctcccgagtagctgggattacaggcgcctgctactatgtccagctaatttttgtctttttagtagagacggagtttcaccatgttggccaggctggtctcgaactgctgacctcaggtgatttacccgccacagcctcccaaagtgctgggattataggcaagagccactgtgcctgacctgaccaggatttttaatgcacacagctatagactttgcttcctagtggtctgatagcagaatctgtttgtctgtttgtgatgtatctaaaactgatctcttttggggtggtaatcagttattattgaaagcaagactcattaaaataaaagtcaggtgtggaggtatgttcctgtagtcccagctactcagaaggctaaggctggatgattgcttgagcccaagaatttgaggcaagcctgggcaatatagcaagacttttcctgtaaaaaaaagacaatcaaatatttatcttcctggtttttctagaggaaaaaaaattatatgttttcactttttacttgtatttaggaaaccaaaggtaatagtttctttggaaatatggtctaaatttttagtttttctgtttcattgttgttatgttataaagttagggtttggaatgttggtgaaattatcaaagcttcaagaatgtcagcttggattttaaaatgctattcttattcaaataaagatgtctatatatgtaatgcatatgtatgtgtatatgtatatgtagttatataatgcatatatgtagcatgtgtgtatacatatgcatatatacatatatgtagtatatgtgtatacatgtacatatgcagatatataatgcatctatgtagtgtatgtgtatacatatgcattatatatacatgtatgcattgtatatctatatttatatacagatatatacatatacacagtacagtggtttgattaaaaaatgaaaaagttgggcttttatgggtcattgctctgtttttaatttagagtggttatggaaggtacatgggatatgaagttcaggttttagctctgcgggttattagctgtgtaattgtagacgagtctttgtacaagtcttaactccttatgtaaaattgaataggaaacaataagtactttatagtgaggtgaacataatattagataatgtgaaagtaccaagtaaactgtaaatagtatttgtattttttatggttagtaatatcatctgcctcattcttgaattttttcagtacctttgttattcaaaataatacaagatagaagatatttttggtatgtgccattctgttttaatatcatacattattttgttatgtgaaaacaatgtaaagctacacaattaaaatagtgtggcattattgcagaaatacacatataaatcaatatttttagaataaagtgttcacaaagacctaaatatatgtgacttaacatatgatgaagatacaattttagtaagagaggaaaggatggattctttaataaatagtattgggaccattgcctaggaatttaggaaactaataaagctgactccctcctatatactatatgccaaaataaatttaatatgggttaagtatttaattaaaaacataacactcttagatatttcagatgaataattttaatatattgaaatcaagaaggtccttctaagtgcgagtcaaacaccatgaatttaaaggttaatagattgactaatttaagatttaaagaccctttattcaaaaagcgcatcaaaaaaattgaaatacaaattacacactggcaattattatttatgacatatattcagatgaagatgtattttctttataaagagctcttacaaatccataataaaaagacaatctgaaaacctgtaagatagagaaaaacgtagccaaaaatttaagaagaggtatttcacaagagaaatagcaatgttctgtatgtacatcaaatggttattttattaggaattgaaggaatgatttttaaaagtgagataatttttgcttatcaggttggcaaagatgaaagaagttaagcagtaatcagtaaattgtagggaactgggtattctcatacactgttggtggaggggggtaggtaaattaattctacttttccagaggcagtctgattatatctttcataattttaaatatccatatctttcaactaatgattacctttctaaaaaaaaaaaaaagaaagaaagaaagaaaggaaccaggatgggaactgtggctcacacctgtaatcccagcactttgggaagccaaggtgggcggatcacaaggtcaggagatcgagaccatcctggccaacatggtgaaaccctgtctctactaaaaatacaaaaattagctgggcgtagtggcgtgaggctgtagtctcagctactcaggaggctgaggcagtagaatcgcttgaacccaggaggcgaaggttgcagtgagccgagattgcaccactgcccttcagcccaggcgacagagtgagactccatctcaaaaaaaaaaaaaaaaagaaaaagtacacaatattttgttttaaaataatacttttcttgaaggagctcacagcatgttagatgttaatgtattagtcccccattacacttatgagataaggaatcagagatcaaatcattttaaccctttcttaggttgggaaagtacaaagaggttaaagtcagtcagtggcagaatattgagctttgggaatagaaaatttataagttgtgttacaaaataaatatttaaggtcatcaatgcattatgtggttagaacgcatgggtaatgatcagcagccctgagagtataggggacctgaaagccagtggagcactgatggtatgcagcatggcagtggattcttagtccctctttagcatcgtaatgtacatgtagtctttgattcttagtctgtgttagaatttttgaaggttggcttcggttgctagatggcaatttccctagccatgtgtctccaacttcttagctccacagttgtcaggacggttttttcttttggctcaaaatcaggtaagcgtgcccctaattcataaacagagccctacacgtttgttatcaattaccagagaaggaaaaagacacatttgttatcaattaccagagaaggaaaaagacacatttgttatcaattaccaaagaaggaaaaagaagtctctttttaatgtattttaaaaatttctatttgaaataagaaaccacagaattggaatgattctttgacagtagaacttggtgctatcatgggaactgactgaaataaaccctataatcctttgtagattcatatgccttaatcagtgcaataatatagagaggtagctcatgtctttgtcataaacctgctagtttctccctcttttaaatatctaaagggatgtttctaatttaggtacttccaagttttagcacaagatatgccaagaaagtctttttatttttcccccgagcaaatactgagtagttttcctttgtctgtcttttaaatagctaccattacttttgcatcctttacagtatttgtcaggagctttgtaagtactgtcccgtttaataatcttaacgtctttacaaggggtgaggaaactgatgtccagaacaaggtaatttgcttaaagatttagtaggtggtggcacaggaatttaactattctactttatttcttaaaggctacatttctccaaaacggcgagaaatgaattttaaaagtttgtgatgggaattgaaacagaaagtggtaacttgaagggctagaaaataactttggcaaatggaattctgtgcagcagattgtgtctcagaggagactgattaaaggtcaagaaaaatgggctctccagggtttctgcaaggtagttgacaatctaatggaatggggatttggggagtgtggataagggacaaagaatgcgttttcttttaatagtcttaaaccaaatgcgggctttgttttacttcagtttctttcttttttcttttcttttctttttttttttttttgagaagtgctgatttttgtaacgataatacaatagtaataacaagttatgttttaacatagccccttctctaaggtacttctcaagcttatggctatatattttaaaagtgcttacataaacgtaaatcacccaaagagctcaactaaaaggatgttcttgatttttaacaaagttgtttggattgtggatagcctttccacagagaattgttatatttgacatttatatgaactgtgtatattgcactgctcttgttaatgcttgataagaacaaaatatttgatgattgaatgaatttagtgtttgtgtgtatatactccatgttaaaaaaaattttctcttctctgaacttttactctccactcagccctgagtctgaatattttcattattttctgggaggtgggaacagtttgcaggaaggaataaggaaaagtttccaatcattctgtgtgtatgagattgaaaaggcgcatgttttgtgtaattatagatacgtcacatgctcacaatctgcttgtcctggtatactggatcaggtgtagtctttgctgcacatggtaaattcatagttcgtcttaagcctttgcccttccagggttttgaagatcagacttctgtatcacttaatttctgattgattttctacaaaaaagtattgtttttaattgtgtgatagtcaaacacagacaaataatattttggttaatcctggactttgtttttattttaatacttggtgacttaatcagaatttagtggggattgactgcactgccattagatacaagtaagaaatgatatgtgtgggatgaaaaccacaagttctcctctgcttgtgcctatcctctgaatttctttaaaagagaaattaatgtaacaataaatttgttgggggagggggcattgattcttattgccctctttgatctttctcttatttcccacagatttgttaccatttcccttttttccctctctcatctcctgccatctcacattgctactggttctacacctcttaaatacaaaataatcaagaaaaaaaaaaagctaagaaaaaattctaactcttgtatccatcataagaaaactcttgtcttccattttatcccctttccttctgatttcgtcatgatagaattgaggaagacggctgtcaatgtaggatttttcttgcaggaggtgagcctggggtaggtagactggaagaagaagagacagaaacagaccaggttcttttagttagggtgactgtacagcctcgtttgcctccagtggtcgcagttgttcttatcataattattaacaatgcttactttcactcccaaaagtgctctgatttggatgataaattatatgtgtatgtttagaagacaaggaaagagaaagattggaagcttaattatttatagtcatttataactctttatcccagcatagtacctttcacaaagcctgacccaagtggtattcagtaagtatgcattgattcatttgaatcccaagtcatacccaaacaaatctgttcattctacacaagtgtatttatatttgatatgttaatatgttctatataatggagaggtaaatctaagtttcaattttagaggacatataccacaagccctataaactaatagaaactgagttcagaacacatacattttttatttaggtaatacaataatttttaaaaaattacaaccaggatttaaaaatcagaaatattcacataaaaatgtcgatttttcagtttcttttagagaaaaaaaaaatgatctaatggcccgagtctgagctcacatggtaattattatatggaatgagcagggtctttattttgccttggcactcaccactctacccatggacattcagatttgcaatccctgatgcatattgtatatttggaagcatttaagatgttaaactttgtatatttagttatctacttaagatgagccaattctcattagtcatgttgtttatcaaagctatttaaatgaaatacttaaaaattcttttggtgataagcctttttaaaaaaattcaacaagttaatcattaatctttgggaaatattttttcccataccatccatgaatggcaacagctattaacaaatatttatattattttattgaataaaaaataagctaacactattttaaatatttttcaacagccagtatcttcgagaaagcgtatttttgaaacatacttatttgagttaaaattgtgaaatgcatttaaaaattgaaattgaaagtagaactactggagaagttttaaatatttgtgagtacatgtatgtgtgtatgtgcatgtatacttatgtgtgtgtatatatatatatatatatatatatatatatgtatgtacataaaatacatagttaacttgttcttcatttggttcttgtttatttatagattggaacagaaagagcaatctccacaagtgtttattaagttcctattatgtgctgtcctgcattttcaattctcaaatgatttatcaactttgaagtacaaagtagtaaaacattctttctacacatgttgaagaaactactgcaagttaaatttggataaatatctcagtatctgatgcatccaggtacttggatgatttctgtgaactatatctgacttctcaccagcaaacatgttttaaaaataatacaaagacggggcacagtggctcacgcctgtaatctcagcactttgggaggtgaggcgggtggatcacctgaggtcaggagtttgagaccagcctggccaacatggtgaaactccatctctactaaaaacagaaaaattagccaggcatggtggcggacgcctgtagtcttagctattcaagaggctgaggcaggtgaatctattgaacccgggaggcggaggttgcagtgagctgagattgtgtcactgcactccagactgggtgacagagactctgtctcaaaaaaaaaaataaaataaaatttaaaatagctacattgcttcaccaatgaagaatttaccctgctaacaatttttagaattttggcaaaaaaatggcttgaataactacattaaatatgaatttaatggcttgaacatattgtctcaggacatgattttatttgtacatttttaaggtttaatatattttcagttaaaattatctatatgtagatcaatttcttgctttcggagtcttttctgaagccttctgatgtcttccagtttgacctctacaccagcaacaagcatcttgacatcttccctcactatcatcttgaggattcatttcatttcttttgttttgtatctcgttctaaattccatggcttcctttttgtttggtctgttgttttggaggattataaactccagtagcttcctgagaaagtaaggggaagtaattttttgagaacttgtgatactttggttggatataaaatgatagaattggccgggcgcggtggctcacgcctatagtcccaggactttgggaggccaaggcgggtggatcacctgaggttgggcgttcgagaccagcctggccaacatggtgaaaccccgtctctactaaagatacaaaaaaattagccaggcctggtggcaggtgcctgtaatcatagctactcgggaggctgaggcagaagaattgcttgaacccgggaggcagagcttgcagtgagccaatatcgcaccattgcaccccagcttgggtgacacagcaagactctgtctaaaaaaaaaaaaaaaaaaaaagatagaatttaaaacaatttccccttcaaagttttacagtaatgtgtcatagcttctagagttgcatttgagtagtccaatgctattctaacttatcatttttatgaaacttgttaattctctgttgattgaatcttctgttattcccattattccaatattttatgataaaatatctttgtgtggctgtattttcaaacattgtgttggacatttcttgggcacttttcagtttagaaagtcatatttttcagtctggaaaatttttttgaattactcttttaatgactttcttccatctgttttctctgtttctttcagaaacttccattttttgaatgttgtgcatcctggacagttctctaattatcttttcatcttttgttttgctgtttttttttttttttttttactttttctttacttttaacctttctgttgagttttttatttctatttttacgctttttaatgtccaaaagttctttttctcttttcttagctttttcccccatagcattcttttcatatttcttaattgcctttcttgctttttttgaagatattactgaaagttttttttttttttctgtctttatagtctttgtttcctttaaatcgctttttctgtttcttttctttggtctctgtctgttacagtagaggctttcattacatttctgatgatccttaagagttgtgtactacaaaactgattggaagggacactgatattacagtttcctctgtgggatgatctggttgggttgattcttagggaaccctggctgtccatatggtgtttcccttgagctggccagtttatcagagaaaacacttttgagtttgctgctttgggcagtatgtataccttagcagctagcattttggaagatggataagaagagtcctcagttactcaaccccctgattcagttactccacccccaattaaaaagtattttaccttccttaccaccaccctccttgagctgcacgaatgccttccagtctggagagactagacccgaagacatctgacaggatggagcaagggtagttgcacaaatctttggaataagagatgagatttcaagatctaattgttttgtaagtagattttcaacaaattcttctgtgtttagtccatccttgtactctactcgtagacatgtaactccggttgcttcttagcttctcactactgctgatttaagattcagctttttgtgcctttatgaaccttcattttgtttctaaatgtacttacttttattttaggtggggtgtcaggaagagagggaagctaataggtagattcactctaacatctttagctgccatctttaacgcatacacacatatatgcactcatatacattaatttcacataaatgctataatcacttaaaaataaggtaataaaatttttaatacttcatttaattagactacatatggttcttgtcaaatctacactagaacagcatttccagtttacatgtattgagataaatcaccaaggctttgcataaattttagaaattctttcttccctaatttctgaattcttcagccttcaagattcaactcagatgtcacctataaagcttttcctgactctcctaagctatagtttattggtcctttctatgtttacctatagactttttaatttaatataccattaaaacatatcacattgtgttataactatgtctaaatcacttactagactgtaagcttccagaaggcaggagtgatgttttgtttgtacagtgcctggcatataatgaatacccaatatatgctttgtggattagtgaacttattatttaaaaaagcaaaccacactttaagtaaataaattaggatatgattattttagaaaatattcactatacaaaataatttacaatgcatttaaaatttcattacatggcttgttttcccctccaggaacatgttcatattagtatcatttttgcatatgtgtgtacatatgtatgcattttccattgttcttctttagtaggggtgttactcgtcttttaaaatacatacgtgttattttgttacatattggcgatattttcccctccagatatcttttgctaggagagcactaagttgctattcatctagttttttgatcagtgcaatatattttaagcaactagttcaaaaatacattcaaatagcatgccctattcctcatgaattgctatttctttgcttaaatttcccactcagaccaccagcaatcccttaagtacttttcctaccagctaatgctagcttttaaaaatctacttaatgtttctcttttctttctctttgttgcctctgtcacttaatatacctgtgtgcctgtctcgatattgttccttctcaaggtctttttatgcttttaggatgatctttcctagtttctttttctactgtcttagatgctttgattctgctgtttctccattgcagagagcttagtggaaggaggaagtgaatattaagagtgtctttttaaaaaaagatgttatgtataatattaaagagaatataaatgctggtggttactatataactagtgctccaaaaaggattttgataaacttttagagtctttcatggaggcaaaaatacgaaaatgcgttgtgtttaaatttcttagacaaggggaaaagggagcattgaaattgggcaattgtaaaaaatgaatgatagatacatgggagttcattattttctatctctatgtttttgtgtatattaaaatctatctaaatacaaggtttaaaagaggttaagtatcatttttcatttcttttgacccaataatcccacttttgggtgtcagtcctctagctcataaagacagatgagcaaggatgttaaatatagcactatttggactggaaaggaacataacttgaaaacagtctgacagctgtacttccattactaatggaattgttggataaattatagtgtgtccatacaatattatatagcaatcaaaaagaatggattgagttatatgctatattctggagggatgtccaagatgtatttttaggtgttgagtaatgcataaaatgtaatttcattttaataaaaagaagctatgaatattgcaaaaagctgtgaaggcatatataccaatttatcaaagttgcttattttaggaaatcggaacttgaaggaatggggtagaagaaaaattaactttattaatctttgtacttaatttgtttcaagtatgtgttacttttggggaaaatgtaatgaagatttgaaaaaaatttaaaaataaaatatttaaaaaatgaatgtcaattcatccaagataataataactcatttttaaagctgtaaagagacacagaaagtgatatgcataagaaactaaatgatgaattagatcataatttgcctttggaaagaaacataaatggattgatagctcatgcctatgaaatgtatattcaactctgattctattcccaaacttctaacagaaattgctgggtaataattagaaaggagactttggccttttatatattaattcagtattctcctaaaatctgtgcctaaactttaagcctttttgttatggtaactgaaccaatcaatttcatagttaaagatgtcccattttcaacagaccatatttaacttggaaccaagggtatctagttatatcagttagggttctttggttgtgagcaacagaaactgagtctagccaacttagacaaaaagaaatgtattggaaagatactaagcaggtaatagaattcatgtttcacctgacagttgggcatttctttttgtgttttagtatgcctctaattatattctctgctttcaattatagcattgctccaaaagttcctaaccaagcgcctttgtcattttgccttaagtcttttttttttaattaccattttttaaaaggggaatttatataacatctgttgttcaaattgtgccctagtaaatgttgagtttggagttataataagtttgatttattataagagatattcctattcagatacttacagatagtttcaacctacatattttattttagaattgtcacccttgagtttctctttaataccaccccagtgtctttgtgtgtgtgtgtgtttagcacatttgttttgtttatcttttttgttgttgttgttttattggtaagttttctggggagattaattgtaaaatgtttattaacattaaattattattatttttgagacaacgtctcactctgttgcccaggctggaatgcagtggcaccatcatggcctactgcatccgcaacttcctggacccaggtgatcctcccacctcagcctcccaagtagctgggactatggaagcgcactaccaggccctgcttgttttttgtatggttttgtaggaacgaggtttctccatgttgcccagccaggctggtctagaactcctgggctcaagcaatccgcccaccacaccacatcttcccaaagtgctgggattacaggcgtgagccattgcgcccagccaaattatttttttatatctatgctattctttataatttctgtctacttaactggaacagtctcttgtgctttttaattggattccagacatcgtgtgtaaaaggacagcagggactaaggtaataagattcatgcccaaaagtggtcatgcctcttctgttaggtcattagtgtaggagattaagtcaatttaggcagtagtgaaactgagtttggttttgttgttgctgtagttatctgcagttgttctggtgggctatcattatcttgtgcttagtttagagcctggggtcttagagagtttttttcaataattttgctcccttcacagctttcagcagactttgcacccctgtatgacagatctctgtgctcctgagcctctctagaagtagactgttaagttggttcaaggcttgtggtagggcctggagggctcattcttggccataccctgtgcacatgagtctcaggggttagacgttttcaatgtttgtgcttctccccagacggcaatacacttttgctttgtattagtgcaggatccttggcatgagtgggttttctcccctttcacagcagcaggtgtcttttgcctagtgtcagggcaaggtaagaatgaggtggagattgtcttggccaagttaaccttatgaacctctgcagtaaaatggaaatgatactactatctgatgtagcagtgaaacatttagtttactttatttggtactatacagatgtttgttaattaggtaatatttaatgcagaagatatgggttgagccatggctaaaaggattaggacttagatgggcagactgaaggcaagagggcatcttgggtaggttaagataaaataatgataggcagctgcaatttgatgtgaaagtattttttcttaaatcagttattctatacctcaagatgtcattcattcattcagttagtcagtcattgtctcttgctgcactttactaaaagttggggcttcagaagcatatggctcaactgtaatagtaagttgtactaatagatttcccagtatactgggaatgatcagggaaacttaattgaggcctgggttggtttagaggcagaagacaacagtagagcatgtctttttttttttttttttttgagatggagtctcactctgtccccaggctggagtgcagtgacgtgatctcggctcactgcaacctccacctcccaggttcaagcgattttcctgcctcagcctcccgagtagctgggactacaggtgcacaccaccacgtccagctaatttttgtatttttaataaagatggggtttcaccatattggctaggctggtctcgatctactaaccttgtgatccacccacctcggcctcccaaagttctgggattacaggcgtgagccaccgcgcctggccgtcttttactctttatagattgctataaagagttacttgtaagtaaagtaaagataatgacaataacagtaaaatgataatagtagctctagtttatagaaaggtttcttgttttttattgtttgtttttgtctaggcattgacctcttttattaaagccctgcaatacataaattattatttcctatttatttctttacatcttcagatgaagaaactgtatctcagaagagttaagtgagttgctcaaggccactcagctagtttaaattagagcatgactttgaataaggttagtataacttcaaagtctgaactcattttgttttattactctgcctcccaagactcagatatctagtaaggaaagctagtattcagaaacatccaatcaagaagctcctatgttaaatttaattaattaattaatttttttgagacagggtcttgctctgtcacccaggccagagtatagtggcatgatcatggctcactgcagcctcaactttctgggcccaagcaattctcccaccccagcctcctgggtagctgggactacaggtgcacaccaccacacctggctaatatttgtattttttatagagacagtgttttgccacgttgcccaggctggtcttgaactcctgagctcaagcgatttgcctgcctcggcctcccaaagagtcaggattacaggcatgagccaccgcacccagcctgcttctatatttttaatttttagttgttatttcagccgatatatatatatatatatatatatatatatatatatatatatatatatatatatatatatatatatatatatatatatatatatatatatatatatatatatgtatattgctacataaagacaactagccaaaattcaacgtagtatccagccagtgctttgttatgaatccggcattcttgcaggtatgtattatcttaatagttagttgacatttggactcctagagataatcatgacttactggtgatttctaccgtgacatttgttatgttcttcagactcagaaacatttacactttcatatcatgtggggttgtatgatttacaaattaggtattggctggttttttatctcctcttgaaatttcacatgaatcttggtttgattctaaaagtagatgttattgcgttatcacaaataagtaaatttggaattttgtcaagtttttatatacttctttggcctcaaagcatatcttaaagccattttatagtaagactagcaactcttacagtggcagatttggatggctaaatattaaaaaacatagaagacttgacattgttgtaaaaatgtgagatcatacattatgtcttaagatggtaatagaaaacattttatctttaattgtggaatactctgtaatttatagatattttaataaaataattcatatggaaaatcactgtttttttaattgtcaaaatgcagagaagcaatatgatggagatgtatgtaaggactgtgtcgtttgttcattcagtaattcagttaaccaatatttaccatgctagacaatctgttaggtcctggggtataaagagaaataatatctggtccttgttctcaaatggtttagagtttaatgaaatagacaaataatttgatgaactataatatgttttaataaaagtaggaaataactgctgtggaagtatagagaagagctgagagctgtgtatagtttttagtatgttttctttatgtagcatggtttttatatatctgtagaaaagtatgaaactggtagggggtatttttcagcagtttcttaccatgtactaccaaagaagcagaatgtgagagaccagtaatccagtagtaatacgtgtatcctgacaaacttaagtaattagtcaggtatcagtatatatatatatatatttttttttttttttttttttttttttgagacggagtcttgctctgtcgcccacgctggagtgcagtggcgcgatcttggctcactgcaggctctgcccccaggggttcacccccttctcctgcctcagcctcccgagtagctgggactacaggtgcccgccacctcgcccagctaattttttttgtatttttagtaaagatggggtttcaccttgttagccaggaagtatattttacaagactctttttgtgatttatcagcatactttcatgccaatgtaaaatgtgggagatcttaaaattgagaggtacaatcaaccctgaaattccaaatctattgaaagcccaacatagactctgatgactgtcatttcacctaaagggaacatattctaattaattcaaagcaatatgtcagttgcctgttctttaatatgctaaaagacggatatagtaatttggagaaataacttcattaacaagtgaaggattgctgaagcaaagagtaattgtctgatactaatgggatagcaatatacccagagattaaagagttttaagaggttaaaaacaaacaaattctgtttaaggattggtgaattttagctccccaccccccatctaaaaatgaagcaattactttttaaaatgaaatgtatcattatgtataaaattaatttttaaaagtaattgatagttctaaagtaataaataacttttggttaagatgttcctattgggattatataccttaataaaggaaatgtaatcttttgaatacccatcttgagtgttatcagaaatggcctttactgtcatacccattagttcctacttgtagaatttctaaaagttgaaaatttgatttagttttttaaaatacttctcttgtttgaacaaatgtaatttgcggtctttatagacaaaaccttgtacattatattcctgggcatccagatttgttagggtaggtatttttgtgagtaatattctggctagctgagcattcattcgtttactcattacatatttgagtgactattgcgtggcaagtactaggctaagcactggggatacaaaggtgaaaaaaagacattgtcttatagaaaagtgacatttggtttataaagtttctgaagatttagactccaaggaaatgtatactttatactcaattgcatgtattagaaaatttgaccttggtcatatgttatctctagattttagctccctcatttatgaagtgaatgcatctggattaggtaacctacagattctcagagagattttaatagtctgtcggtgcctcatgattctgaataagggttaaaatttagaaaaaaatcctgagtaccagactttttttcatattttattcattagtatattgaatatgcaaataaatactgccttggacaatgtaacattattgtctttctcttatgtattgtatcctttccccaagttttgtctcaagtatttttgtaaaattccattcatcaaactattttttaaatggtttccaccagttgccttagtttttttaaagtcatcattcaaggtagtctttttaattttttttaaattggcatcctgggggcttcaatttcagctaaatctttaacctctctttcattgttgattcattgcccaaagtatcattaacattattaagaaactttggctttggatacataaccaattaatatgtaacatgaacattctcttcaatttttttttttttttttttttttttttttttagcagacagtgtagatttgcactgaatcctccgtaattcttcagccaggactcttctaggataaagacattatcagagaaaacacagcatataaaagtaaccacaaggagatggaactgcttgtcacgcgcattacgtttcaatgtattgactccaatagctagtgataacccacaaagagtctgtccatttattctgtacaccccctgcgatgcctgttctactcccgtacatacaatgggggttcaaaccaaaataatggctagcatatctttgacacaaattgtttttgggccattataatgtttgtttaagttttttttgtttgtttgtttttgtttttgagacagagtctggctctgtcgcctaggctgaagtacaatggcacaatcttggctcactgcaacctctgcctcccaggttcaagcaattctcctgcctcggcttcccgagtggctgggattacaggtgcctgccaccacgcccagctaattttttgtatttttagtagagacagcttttgccatattggccaggctggtcttaaattcctgacctcaggtgatccacccatcttggcctcccaaagtgctgtgtttacaggcgtgagccactgggcccagccaggtgagtcttttgactcaatacatttcattgaattacttacaagccttctaaaactattttgacactgaataagtaaataagcagtaacttaagcaataggaaacatcctcaaaatatcctaaaaattcaatttggaatgtagtttaaaaataaagaggctgggcacggtggctcacgcctgtaatcccagcactttgggaggcggaggtgggcagattacctgaggtcaggagtttgagaccagcttgaccaacatggtgaaaccccgtctccactaaaaatacaaaaattagccaggtgtggtggcgtgcgcctgtaaacccagctattaggggggcggaggcaggagaatggcttgaacccgggaagcagaggttgcagggagctgagattgtgccaccacactccagcctgagcaacagagcaggactccatctcaaaaaaaataaaataaaataaattaaataaataaataaataaataataaactaatggtgttatctattctgtacagttctctgggggctgattacaagtgctgaatggcagtattaatctctgttgtttttcacttgagtgatcctatacattaaagtcacagtgtacattgtttctctgcttgatttctcctcatctcaaaatgtagggtcaaatgaaagaggcaggtagatatttagagaagagcattttaatctaaatataaccatcacgtactattagtaaagaaattaagaggccaggcatggtggctcatgcctgtaatcccagcactttgggaggccaaggcgggtggatcatgaggtcaggagttcaagaccagcctggacaacgtagtgaaaccccgtgtctactaaaaatacaaaaattagccgggcagggtggcatgcgcctataatcctagcttcttgggaggctgaggcaggagaatcggttgaactggggcggtagaggtcacagtgagccaagattgcgccactgcacttaagtcagggtgacagagtgagactccgtctcaaaaaaaaaaaaaagaaaagaaaaagaaatttaagaaatggatccatgggaaatatatacatttgttgaattgaaaattatttttcaacacttggcttatatctactgtgttgttcacttaaaaagcaggcaaaatgaagatgatgctttaaaaggagttatagttagaaatttggaactaccatactgttccagaagacttgatttaatatctggtcatgagttgcacaattaataaattttagacctcattcaatatattttcatgcctgatttatccttgtttgagaactcaatacaagattcatagtaatattttagctttctagacaggatatttagtagccaggctcagggtggcattgtattggtatgccagttggtaggccttttgactatacattggcaggataacttgaatgataccctctcccaaacctgtcccacatcctcatatctctggcaactctattgtagagtagttagccagaggtgattgcttgtaggggaatataatggttattttctggttgttccaaaggaaagaaaatattatctccatgtattatttattgctatatagcacattgccccaaatttagcagcttaaaacaaatatttattatctaacaaagttcctgaagatcaggaatttgggtatgaatggttcctatggttctggcccagggtgtctttatcaggttgcagttaagctgtcagctgaggttgccgttatctcagtgcttgactgggactggaaaatctttccggggtcactcacatggttgttggcaggcctcagtttcttgctaactgttgattagatgcttcagtttttcaccctgtgggccttccatgaggttcacaatatggcagcttccactagagtgtaagatcagagagacagagagtggacacccaagatgagagtcatagtcttttataacctaatttcagaagtgacataccattactgcagccatgtggtgatcatacagaccaaccctaatcccctgagagaggggactacacagggtggaaatatgaagatgcaaagatcattgaggaccatcttggaggctggccaccaaactcctcgtgatggatatcatcattggtagttctctagctggctatctgtaagtctccaaagctacacttgaactgtctagcatttagattagtacagctagaggagctaagtttgaatttttaaaaaatcggccaggcgtggtggcttatgcctgtaatcccagcatgctgggaggccgaggcgggcggatcacgaggtcaagagatggagaccatcctggccaacatggtaaaaccccatctctactaaaaatacaaacattatctgggcatggcggtgtgcctgtagtcctagctactcaggaggctgaggcaggaaatcacttgaacccgggaggcagagaatgcagtgagctgagatggcgccactgcactccagcctggtgatagagtgagactccgtctcggaaaaaagaaaaaaaattctgggtattattcttactagatatgtgtcagattatcagatcacttggtgttaggcctggtatgtacaactgagttactaaaagatttcatcaagtaggtagcagatatttaggaagagtacttaaagaaaatgacttgtttttaaattttccttctttataggtccaggtttagttcactacagaggataattttgtttgctttgcaagacagccagactagaggttaaatgttttttttgacagtatgtggttacaaatcagtcttgccagtcctatgttaattcgttatttccactgtctccagactctggtgatagtgatacaaattaagataatcacatgaataaattagtggcaataatttctttgagtctttttcttggcctttaagttggtcactttgcattacttgtataaatttctaatgtaaacagagagcaaattgtgtgtgtgtgtatgcacatgagtgaaatctataatgaaatcacagtttagagaaggaattatacgtttaaagtcttcaattttatgaaaacaatgattccacatttcttcaagtggctgccatagaatggaaattgaaatccctgggtgggaagtgtgctagaaatcatagtattccttttcaaagtattttgcatccccttatacatatattcagtacttcatttctaacccctacacactaaatcatgctgtgattcataatactctgttatgttttaaattcaaatattgtttttaaagggaaattgctactaatgttggctaagctgcacgtaatagtttagtaaatggttgtaggtttgattcttctcatgtcaatctaaatgtgaactaacattattcaaaatccttttaagatactgaataattgtttcagttaactaaatgcttcatcaagtaatatcaatttatgaagtatggttgggtttagggcatttattatttaaagaaaaaagcaataggtacatacctacgtaacaatgttaatggatatgttttgggtgccatgtgtttgaagaaagagggattttcatatcttaacagaacaagtatagatcattgaaaaaatttaaaagtaatgtatgatttagtttactcttatttaatttgttaaaatatcagctttaatgagatataatttacagaaatgcaccaattttgatgtacattttaatgagttttgaaagttttatacattcatgtaacctatggaacatttctatcaccccagaatgttttcttctgtttttcttccagtcaaatactacttctcgggtaaaaactgatctactctctgtcactattgattagattaaactcttctcgtgtttcatataaatgcattcttatatgttctcttttttttccctaatatatttcacttagcatgatttttttttttttttttttttttgagatggagtcttgctctgtcgcctaggctggagtgcaatggtgtgatcttggctcactgcaacctgtgcctcctgggttcaagtgattctccctgcctcagcctcctaagtagctgtgattacaggtgcccacaaccacacccggctaatttttgtatttttagtagggacagggtttcactatgttggccaggctggtctctaactcctaacctcaggtgatccacccgcctcagcctcccaaattgttggtattacaggtgtgagccaccgcacctggccagcatgatgtttttgagattcatccatattgtggtgtgtatctgttgttcgtttctttatttttttcactttttttagagacagggtctccctctgttgcccaggctggagtgtagtggcctgatcatggctcactgaaacctgaaaatcctgggcttaagtgatcctcctaccttagcctcctgggttgctgggattacagacatgtatcatcatgcctggctttgtttcctttttattcccgagtagtattgcgttgtataaatatggccacactttgggaggctgaggcgcggatcacgaggtcaggagttcaagaccagcctgaccaacatggtgaaaccctgtcactactaaaaatacaaaaaaaattagctgggcgtggtagtgcacacctgtaatcccagctactcaggaggctgaggcaggagaattgcttgaatccgggaggcagaggttgcagtgaggtgagattgcaccactgcactccagcctgggtgaaagaggaagactctgtctcaaaaaataaaaaataaaaatgaaaaataaatatgcccacaattcatttatgtattcatctattgatagacattcaggttgtttccggttttgggctgttttgcataaaactagtgtgaacattcatatacaagtttttgtgtgtgtggacatgtgtttttctttctcttgggtaaatacctaggagtagaattgttagattgtataagtgtacatttaactttgtaagatattaccaaactgttttcccaagtggttgtactattttacattgccactaataatgtatgagagttccagttgcttcacatttttgctaatgcttggtactgtcaattatctttaaccattctgctaggtgtgtagtgtatctcattgcggttctatgcagattcctgatgacgatgacgttgaacatcttttcatgtgcttattggtcattcatatatcttcatctgtgaagtgtatgtcaaatgttttgcccattttaaaaatcagattgtcttaatgagttgtaggccgggcattgtggctcatgcctgtaatcccagcactttgggaagccgaggcgggtagatacctgaggtcaggaatttgagaccagcctgaccaacatggcgaaaccccatctctaccaaaaatataaaaagtagtcgggcatggtggcacgtgcctataatcccaaatactctggaggctgaggcgggagaatcgattgaacctgggaggcagaggttgcagtgagccaagatcgcgccattgcactctagcctgggcgacaagagcggaactctgtctcaaaaaaaaaaaaaaaaagaattgtaagagcttattatatactctgaagacaagtcttttgtcaggcatgtactaagagtatttcctcctttgtgtatcctgtttaaaaaaatctatgaatttttttttttatgtgttcttctagaagttttatagttctggcttttatatttttagtctatggtccattttgagttaatatatacatataacatgaggtagaagttaaggttcttttgttgttgtttttgttgttgttgtttttcacgtgggtatttggttgttttggtatcattgattgaaaacactgtcatttctccattaacttactgttgcacatcctttttgaaaatcatttacccaaatacgtgttagtcttttctagagtctgtattctgtttcattgatccatcttttatgccaatggcactacattgtcatgattattatagcttcatagtgagtctggaaatgggataatgtaagtcctctgaatttgttttcgttttttcaaaattgttttgtccattctaggttcttgcatttccatacaaattttaggctaaacttatcaatgtctgctaagaagtctactacaattttgattggatggcactaaatttgtagctgaatttggggagaattgacattttaacaatatttggtcatccaatctataaacctgatatggttgtctctttatgtaggtattccttaatttctcttagtaaagttttgtatttttcattttacaggtcttgcctatattttgttaaatttattcctaaatattgcattttaaaaataatattttaaataatcttttaaacattttaatttcctggtttttgttgctagaaatcagttattgaaacaaggaaatatatttcaagctaaattattagaaaaagcccttttgatttaaagtatgtgctatttatgagatctgaagaagcaggcaaactaaaactacttttccagattccgtcgcagctaaggtgctaaatatgaattaggttgtaccacttagatgcacttagatgagatttgaaatgtggacctaagatgatgccttggccagctctttctgctggaaagcacagtgatggacatgttgaatgtttctacaaaagcattccagtgtttggtcattagcttcatgggtgaaagtggaaggtacgatggcagcttcctgatccctaaatctcaggtatgtattcttgaactcagcagttctagtggtggcctcctattcccccatctggaagaggaaagaaggcagcagtgagccaaaggatgttcgcagcttctagaagcttgtaatggcaaggaaatagattctcctctaggcctctagaacagatagtaatttgcatacatcttgattttaacccaatgttgttgttaaaagacagtctcgctctgtcacccagcctggagtgcagtggcacagtcatcaccgtaaccctgaacttctgggctcaagtaatctttctgccttaaactcccaggtagctaggacacaggcgcatgctaaaaatgttatttttccaagaggcagaggctgaggtaggaggatcacttgagcccaagaattcaaagctattgtgcacaatgatcacacctgtgaatagccactgcactctagcctgggcaatatggtgagacctcccctctttaaaaaaattttttttttcttctgtggttgctaatatcttttttaaagtgcaaagagtcgtctcacagtcattagacacaatagatgatgtaatgccattgtttctttttttagtatttagagctttttgccatctgaaaaatactcatacaagattgctgatcgcccaagtttaggtgaatactcaggagaggaaattacacaattattttagataattatatgtaaagatttattaattgtgtaaatgtaatgtgagtttaataataggatatagcttaaatctctggcttctatttgaaaaatttctaaggatcacatccaggcatatgaaataaaaaggtgacatgttaatctgtgtataatttgtatatttctgcataattatatggtcaagtctcagactgttttctaattaatatttactgttgctttcatattgtttttatctttctttaatcttagaatccaaccaatacttttctctacattgctagaggggcaatatatatgtagagataaataataaagttgactcttgaacaatgcaggggttaggagtgctgactcctccctaatcaaaaatttgcatataacttttgactattaataaacctacagttgacttttttattgatgaaaatccatgtatatgtggacctgtgcagttcaaacatgtgttgttcaagagtcaactatatatatatatatttttttctcttctttttgtgaaaactgtccaggagtcaactgtgtataaaacctgggagcagtgaggcacctcccagacaatatctgcattattactaaaccctagaagatagtgtggataatttggagctaaaataatttaattatattttttaaaatatttgttgataggtttgtacccagggctttcattcaagatagagtatcatttatttcatagcctatattccactagcagaagcttactttttttttttccccccttgggtaattttttttaattgtctaagggattaactgtcacctcattatctttgttaatcactttcagagcttttcgctattgttcatcacagtagtcaagaggatcacaaagaaagtgctaaatccttatttacaaagaaaattgattctcagctttgcttatatctgctatatatttcctttgaatatttgttagggtagcaatggttaaaattaaatatttattgagaagtgatttttaatgttgtgggaaaatattttatgtcagaaaaatattgaatttcaaaaccatggaaaatagaaaaaaatcattaagagacttgactaatgtctcctcagaatggtttacaatattctgctattcatttactttcttcatgagcagtgatcttgaaagttttgaagaaagacttttgtcttttgttaaatactttggaatttttttggcaatgtgaagaaattttatttacatgtttgataagaacatccacagacatctcttttaaagataaaaaacttcaatatgaaaattgaagttataaactaaagatcctctctcagctaagaattcctttttagaaatgtataaatacaattatcctttaataaataaacatatcttcaaattttctcagtaatgtgtcactgaaacacattaaaagatgacatcgctactcacaataacagtacaaaatgaagaaaataattgaaacatagatcaaggatgttaaagatgggtgaaaaaaattatcttgctttttataactaaagtttgtttaatattcataacaggcttatagaattcttaattgttccaggtaaaatacctaattttctttgttttgaaagcattctctttttcttactaaatcaaaaacagagaaaacttagggtacacgaatcaattatggtttttagaacaacaatggataagaatgttttaaagatttaggaatcttttaatctctgtgacgtttcatcatttccattctgtgtcgagtttttggttgcaaagtaatagaaactgatgttgaataacttgagtagaaataaattcattggatatcaagcaattctcagagtatattttgaaggctggaaaatgggacttgggaaataaagaggaaccaaggcaggctaggcccaggaacctctacacagatcaacctgcatgatacagtttggatatatgtccctgtcaaatctcacattgaaatgtaatccccagtgttggaggtggggcctggtgggaggtgtttgagtcatggaggtggagtcctcattgcttggtgccgtccttgtaatagtgagtacttacagaatctggttgtttaaaagtgtgtagctcctcgcttgcactgtctcatgagtaaaagctccctgaggcctcaccggaagctgagcagatgctggtgcaatacttatacagcctgtagaactgtgagccaattaaacttcttttctttataaattacccagtctcaggtatttctttatagcaatgcaagaatggactagcacattaatgttgactaacttatgtagaaataaatttgctgaatattgggcaattctcagaacctgggaaggctagaaaatggggcttgggaaatacagagggacccagccaggaacctctacacagatcaacgtgcaggatcagtcttgttgtatggatgctcctctcagacacacatcagtgctagcactactggattcttaatgctacttctgctgttgctgctgcaaatactttatcacctgtatctgtattttgccttactccctcaagattcaaagtccagaattggactatccaaatatattggtcattagttggaacataaatttctttttttttttttaattttcaaacatctcaacagccagatggagcataaattttatcttgtagatcagtgttttactctcacaaagttttgtctcccagttgacactctaatggagtttccagttcagcttctctaagaggtgagctgctttttgatgaagagatacatagaaccagtgaattctctgggttatcagctcatggctttatttttatcactgtaaggtgagctccttgttcagaatcaacgtggtatggtataccaaatgtccattacaccttcagtctcagattttctttctcatcttcactctgtatcttccacctgcagcagcaataaaggtatcacaaacaattattttttagaattcctcaagaggaataatatttgttctactgatcatcctggtttcagtagaattatcctaggagtgagcagtaatcatatgcacagattcagacatcaggactctattttattttattttatttatttattttgagacagagtctccctctgtcacccaggctgcagtgcaatggtgcgatctcggctcactgcaacctctacctcctgggttcaagtgattctcctgcctcagcctcctgagtagctgggattacagtcatgcaccaccactcctgtctaatttttgtatttgtagtagagacggggtgttaccatattggccacactggtctcgaactcctgacctcaagtgatccacctgcctgccttggcctcccgaagtgctggcattacaggcatgagccatcgcgctgggccaaaacccttaactcaaatagcacttcaagcatcagttctctgtctcctccctttctgttttcctgtgctgcagagatgccatcttataaataattctgtgagcctagttatcacaatgaattgtaattttgttttgtacatcatcttcctcatggactatgaactgctggagagcaggaagttttaatttgtctttgtgttttctgcacttaacactacatttgggacacagtaatggctcagtttttaaaatcaaagtaaaatatacatacagttaaaataaaatatattgaaggctttataatgaaaatcaacagtctccttttctaacctgtcctgcttcttagaggccaacatttttaacttttctaagtagtcttctggcagttatttccatatttctttaaaaatatgtttatcatggtatttcttgattcatcaattttagaaaatttattgaccacccgccaacattcctgagatatgtatgtatgtatgtgggtgtgtatgtagctgtttttgtttttatgaataattagcatgtatattatttgaactatgcaaattacattcattacagagccaagtagtgttttgtaattatattttccatcttacacagctttcttttctcgtcctcttatactatttgctattatatttcctttcttatgccacttctataccttatatattatctaatgtttctgtaccgtatgtatttcttaatttttttcaagccctcctgtagtgggagcggtcgcagacaaaacctcttggacaccggttttaggaaggaatgggctttagtcagctgggagcatcggtagacgctcatctcaaggtccaagctccccaaagtaaagattcctgtcccttttatgggcttacaactctaaggggtccatgtgaaagggccgtgatacattgcgcaagtgggggctatgtgactgagggctacatgcatcagtgatgggggctagcagaacagaacagaaggtttcacaatgtttcctcatacaatatctggaatctatagataacacaagcagttaggtcaggagttgatctttaactaccaggcctgacggaatacttctcagccataaaaaggaacgaattaatggcattcacagcaacctggatgagattggagactattattctaagtgaagcaactcaggaatggaaaaccaaacatcatatgttctcactcataagtgggagctaagctatgaggatgcaaagaatgacacagtgcactttggggacttagggggaaagggtgagacgggagtaagggataaaagactacaaattgggtgcagtgtatactgctcgggtgatgggtgtgccaaaatctcacaaaccaccactaaagaacttactcatgtaaccaaacaccacctgttccccaataacttatagaaataaaaaaattagaaaaagaacacagagtggaatggggacaaaactgtaaagtttttgggatatacatgatctagaacatgaaacaaaaaagtacccgttttgataaatagatttcatatcctcctgtaatattcacaattagaacacattcaatattgtgactcaaagttaaagaataaaatgttgcatattttcaaattgcatggactcctttagagattctgaatcagaataataaaataattaaaaataaacataaagaataatgaaaaataaagctatctaacaatagttaatggctgggtttttaaatgaataaaacattatcttatcattatcttaccaaaagacaacaatatttcaaatctacttatgaagacattaatgatatgactatctagtgtctactaaccattattataacaaccattttggtggagatttactaccttgttagaagaatatcatggctaaaagaagagaaatagcaattgcaagttatcgtagaagtataaagacaaggtcattatagactgatagttaatagagcaatagaaaaatgacatttgatatgaactgttttgattacagaaaaggctgagactcatttttacattcatatatttataagaaaattccaggtttataagattgatccttcaattatttttttcttttttgtaacatacaatgagtaattgatgttacatttttcaaagggcaaaagatttgttaaatcaaaagccgtatgtataaggtagagagtatttcagggagaccagtgtattatctctctggttctatgtagtattctatcttttttttttttttccgagacagagtttcactcttgttgcccaggctggagtgcaatagcatgatcttggctcactgcaacctccacctcccgagtttaagccattctcctgcctcagcctcccaagtagctgggattacatgcatgtgccaccatatctggctaatttttgtatttttagtagagaggtgatttcaccatgttggtcaggctggtctcgaactcctgacctcaggtgatccacccgccttggcctcccaaagtgctgggattacaggcgtgagccactgtgcccagccaggattgtatcttttaagcagaaaacttaatagctttgttcatgacttaaaaaaaataccatgagaatcattttaccaagtaatttactttatacaaataattagaaattatgctatcactaaaacatagtttaaatatttttgaaaataacttagtgttgtcataaaatagaattggaaaaggcgggtaaatcaacataattggtaactggcaaaagtttcaagcattctgcctaagaactggagcaagacaaggatgcccattcttaccactcctattcaatttagtactggaagtcttaaccagagcaatcaggcaagagaaagaaagaaaaggcatatagatgggaaaaaatgaagttaaattgtctctcttcattgaccatgtggttctgtacctagaaaaccctgaagattctgctcaaagactcctagacctgataaatgacttcagtaaggtctcaggatacaaaagcaatgtacaaaaatctgtagcatttctatgtaccaataacattcaagctgagaaccaaaacaagaatgcagtcccatttacaatacacatacctaggaatacttgtaaccaaggaggtgaaaaatctctatgaggagaacttaaaacactgctgaaagaaattatagatgacacaaacaaatggaaaaacattccatgctcatgtactggaagaatcgatatcattaaaatgcccatactgcccaaagcaatttacagattcaatgctatttctatgaaattaccaatgtcacttttcacagtattagaaaaactatctaaaattcatatggaaccaaaaaagagcccaagtagccaaagcaagcctaagcaaaaagaacaaaaccagaggcatcacattacacaattttaaactaaactacagggctacagtaaccaaaacagcatggaactggtacaaaaatagacacatagaccaatggaacagaatagagaatcctgaaataaagccatatacctacaaccaactgatgttctacaatgtcaacaatgggggaaggataccctattcaataaatggtgctgggaaaactggttaaccatatgcagaagaatgaaatgacatctacctctgaccatatacaaaaactaacttaagatggattaaagatttaaatataagatctcgaaccataaaaattctagtagaaaacctaggaaatactcttctggacattggcctaggcaaataatgtacgaccaagtcctcaaaaacaaatgcaacaaaaaaattgacaattggtcctaattagacaaaagaacttctgcacagcaaaataaactatcaacagattaaacagacaacatacagaatgggagaaaatatttgaaagctacacatttgacaaaagactagtatccagaatctataaggaatgtaaacaaatcaacaagaaaaaaaatgccattgaaaagtgggcaaaggacacgaacagatacttctcaaaagaagacatccaagtggccaacaaacatgaaaaaattctcaacttcgtgaatctagagggatgcacatcgaaaacacaatgagataccaaaccttagcaccatacaatatactcatgtcacaaaccaccacaagtatcccctgtatcttaaaatgtgtatatgtatttttttttagccttcaaatgtaaattaacatggagcccaagaggccaaaaaacagctgctacaaaatataccagatttgtattatattgaatttgtggcccaaaccagaccatatatttttctgcttggtaaaaatgtgatagtgaaatgggagagttcctttgaccccctcatgggacttgcgacagggttggctcgtttgctcagctgccgtgcccaaaccccttgtgggaaagggagcatacaggtgagggggtgcagtctctggggtgaatgtctttgggcactggcaggaacaaacctgcagcagcctctaggggttgcccacaacctctggagcccctaagggtgtgtgttacaaacaatgctcttttagcatttgccttctactgttggctaagtgttaaccagctcagtggagggtcagggtgacagctttttacaccctgccctcttggtacctaggttcttgtccagtgtccaggaagaatcagatcacacggacttgaaggatggtgaatgcggagatttcattgagtggtggaagtggctctcagcaggatggagagttggaaatggggtggagtgagaagataatcttcccctagagttcggtcgttcccagcccaactcctctttgaccatagtctctgatgttcagctgcctcttctcttctcgacgttcagacacatcttctcttctttccttctctgttgtgctgccctgctcctctgccaatggaggttgtgatttttatgggcacatgataggaagtgtggggggcaaaaaggcagcactagggtaggaaagcggagatgtgaagttctcatttagggccgcaggtccaggctcgagggtggaaccctcgccagggaccccacccttttctactcagtatttccctgcctcctgtccatatcaatagatgttggcagttcttttagttaacatagtccaaggtttttcttgaatttttgtatgtttgtgtatatgtatattttatatgtatgtatgtctgtatgtatgtatatatatcttcaattttctcagacttcataccacagcttagagttatgcagtcacgttaaccataataactcaaattccaccagatacaactccaaatgcaagtttatgatgactccatgagtttgtaaaactgttacagactttcaaggatctcaaagcacgggcagaaggcatttgtttctgggcaatgtgctctgcttgttggagtgacccagctaaacagagcaagaagttattttgccttttcctgccatttctccatgcatttgggggctttaagagtgctttgagtctaagaaatatatttgaaatataggttggaatcatctttgttccagtcatgttgaacttaaggctaaagtcaaagagcccaactcttcttacagggctccttgagccccaccagtgaaattgtttcttatctgaccagcctagacataccagaatctcacttagactcaaactgacatccctaccctacaagctgtgaagctgactttgaagcaatgtggaatgtgtttgctttggtgactcaggaggttttatatatatgtgtgtgtgtgtgtgtatgtgtgtgtgtgtgtgtgtgtgtgtgtgtgtatgtcttatggatggtgaattatactgttaattcaaactaatatttctggataatacatattatattcctactactgtttcggtttgttcaatctgaaatagccctagctggacctgtatctctttgcttctttcctggtctctatgttatcatacttacttcaacatcatttaacataatggagctactaatgactcttccaaggtttttgttgttgttgtttgagattgttactttaatgggaccaaaagaagaacgtataagacaaaagaataaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagacaaaagaataaaacctatcagagtcaggtgctaatttacccataattatgtagggtctcattatatgatcttgttaaagtttgtgatagtgattatatatatgtgtatatatatgtattgagacaaaaatctctaaatgataaaaataattagtaatccaggactctttatagagaagctctctataaagatgagagaattttggggggaaattatgacttcttgatactttcaatgggctttcggctatgaatgtttgagattctcatggtgctgcattaagtcaaagtattccatgtaaaacagtggtactcttggtggaagctaaagaataacctgccttgtagtctctgatgtttcaaaagaatctgcccaaacatatgatctccatcaactgtaaagttagggcctggaatcacacctttcattttctttttgtctcctttagcagccctgaagagttttcaccaaattgcaaactggagtcaggtaataatgtttgtttctgagctttcagaggaagctgtttattttagtaggcaattttcatgtgtgatgaagtgaaatgttgagaaggcagcctctcatcagtggacaaacaatgcctaagaatttagctaatggccccccttcagtgcagagaatagatggtaacaattggacttgcatactagacccagagctacttgtttggctgctaggtgttaatgcaaatttgttcttcagctcattcaaccctggggctcccatcctttgatttaattaaatgtaattggttacattgctcctcccaggcccccgaggtgtttttgtttattgcttactctttgcaataaaacttcaattcatggcacaaaatgctggataaataagagtctttttttcctgtgttggatttgttgggagattatttctttcaaatagtttggctttactgttaaaagtaaatgaccagtgaaataaactcattgggtggcaaatgtagcatatccagaagcaaggaattaagtagggtaaattacatgagattaggaaaagataggaagttgtaatgttaaattagtaaagatttgcaaaagtactataagagctatcaacactgtaaacaaagctttaataagtgagattatcatttttgtagcacgttattaaaaagttactttaaaatttcagttatgaaatactcaatttattttgtaatcatacataattctcttacaaatatgcaggtggcattgattcaggataaaagtgagaataatattgatttaaattaggtcagcacaattaacctattctttttaatgagagatattttccctctgaagtaagtatatatattttttctacctgaagatattataaataacattttttggtaaactgatacttttttttcccctttcaagttttaatcttaatttgagaagtggggtaaattaactttgtattaacttctgaggaataactcagaaacttaggaaaattgagaaaatattattagcacttcccaattcaattttaagtaccaaattgtataaatgacttttttccctttttgttactgtcaatgggataaaatggcctccagaagctgccatttattatagtgctaactggttagttcctttgttgctttcttctttccctggtctttatttttcccttttttactgtagaggtaacatcagtgacattttcattagtgcaatagactttctaaatcttgctgtgtcacaggcctaactcatatctcttctgatggaaaaaatgaaaaatctgtgataagaacctaggtattcccagtgcaatatgaagcttcagtttcccacaataggattgttttgcagaaatttttttctaggctcctctcacattctattgttgagatactggggttttaggcttatcatcttgtgctgtcgggttaggcctttcttctggtggatgcccctgatgaaaaccaagtggtaatagacaactagaaaacactcccattgggaaatggggaactagtctaagatgttagctcaattgtaagtgttcagagaagaaatcaagtacccaatttacttcctggaaatgagctgttaaaaaggctgtgcttcactttcagagcaagctttgttcagctcctaccagctcaggtataggcagaaaacccaactgtggtcctgggtccaaaaatcttggatggaaattacaggctttcttgacagcaaggccaggatgatttaacttcttggctggtttagtcgcatcttaaaataactcttgccccacatacagagaaataagaatgtttaaaatattataatgtagtggttactgagggtttcctttgtaaatgaatgtaatgtcatagacaaaagggagagaaatgttccagtggtcttttagataaaaccagatactcctgtacttgagtaattttcctccctgcacacgggtaataataagcccattgcccatcccctgactctcctgtgactctcctgaatccacagctttgattggaaactctcaacccctgaccagccttgggagcactgattacgaaggcaccccacatacttccttcataaacatttggcagatcaggaagtgctgaaaagcaatgcccctgggtctcagaagagaatactggtgggagaagaaatagaacattttccctcttgcagctgtcaaagagtgattatgtcaaatgggttttcaaggagccacgaagtaattacagggtaacttcttgacattattttccaatgtttgactcagcagatgatgatgaattgatgcatattattttatggctctctgaaactttgtttgatacttcagatagaggcagagctaagtcttcacttagactaacataacaaagttgccttaaattttaacatgttaactctttctttgtaatagatgatttcctaaactaactggtcttctggttgctaatagagactgtgtttgagctaacttttcatgtaaattaaaaaaaaaaaaaacatatgctttccaagtagtgtttcattcttttactaagatgttactgttaattttccgtggctattgtgagaattaaatgagttaaataatgaaaagagcttaatagttggcacatggtaaatgctcagtaaatatcagctataataaaacatgacatagtaatcattaaactcagaaacgtatttccttatattctctctcaaatgttgtccttttggcagagaggaatttgaacacccagctcattttcttgtgtagttatgttacattagagctggtctatctattggtttatatctttttacaaattttagttcaagttaaaatagttgggagtatttaaatacagtggacttgaaatacatatatatatccttttccagggtgtattttatatatgaatgtctaatattatttgattccaagcaagtaattgattcaggtaagccaagatctggacattcatgactgatgcaatagaagtgaagaaagatgaattaacatagtaagtaatacatatcgtggaacttttactgagtttgtaagctttaagtgtatttttttttcaaatccaagttgtcaatgatataagcattttgtgatcttagggttttcataagtttgtatacgaaaagatgttttgtagccagaatgtttcttataagaaaaatggaagtgtctgacattatgagaatttgtaacactttttgcttagtctaaattaaaaaaagtcttaagttttatttttgcctttgtttcatgcaaaataagttctatatgctgaccctaaactgttgattaaaaaataattatactgagcatgataatgtcatatgaatgacttggtatagcatgaaccactaatatttgattaacttttgaaaacatgcttacatatggcttatgcaagtaagtgcttttgagtagaattttttaaaaattcagttatcaatgtttattcaaagtattatttttcctcaatttaagagaaatcttttagaatcaaagatcttgctatagtgggatctcaccatgcccttttacataccaaatacattcatctgtctggtggtgtgtctgtgtgccgtggtttgtaaataaatgtgtgttttgtaaacaaatggagtaggtgagttgtttgtaagctgtgctgcttctgcctgccaactagatgtatcatcaacattccaggtacaaaagatgtttaaccagttcaactgaatagtcctcctttgtgtccacacgtatttcacaaagaaaagatgctgctttcatggtaacagaaggatggtagtctagggtttgcagtgccgtcttcattatgtgtatgctgaatgaaaagaaaccaagtattcaactgtgggctgctgtacgtttgtgagggatttttttttttttggtgttggttgaggtttccattgatagaatattttagacttttaaaaaaccatctgtttatctgaagcacaggaagtgcatccgtctgttgactttattaagtgtattgcaaataacagatggcttagtattaggtttgctcttctgtaggaatttgttgcttctaaaagtaacaaatttttgtctttcaatattaactcatttaggatatttggactgatgtttgatttcattctaaaataaagctttcattgacaatctgacctaagctctccatttatgccctaattgtaatattgtcctactgtatggtaattatctgcttacttggcaatgtccttagcaaagaaggtagtgactttgtcttattcaatattgtctccccaagatcaattaacacaagtatgttgaatgaatgaagcagctttgtgtgtgtgtgtatgtgtctgtgacaatccagaagaaacatccagagatgctgtaaattcctctgatttagggattggtgaaattcagctattttgtgaaagctctcctcccatttttagataaaggttgctaataggtttccaacaaaaaatggcagaaacctagactgctaatttactgtttatgtttgcatatattaaactaggaccctaaatgaaaatatcagagtagcatgttaatcacaatttgaggtcaagtcaattagaaaacattataagtaagtttgctgttatttccaacttcatataatggcatcattgtctctggggcacgtatgttttcaaatatgagcatcgttaggttcttttgaacaacagtacaccatctaatgaatttacatacgtaaatactactaattaacattggtttattattttgcatttcactgctatttactaacagatttcaagacaatggacaattttgtaacctcgattttataaaaaccactagtatttttggtccctagcaaccatttagtatgtaaattaggtattctcaggcttaatgtacttcatttttataaaacaaatacatcattaatctgattaagttcttgggtggaagtgctgtcctcagatcattgtggattatttattgttgggcacgcatccaaaaaaaaattcaagcatggcacttacagtctagatttaggagaattgttgaaaccccctaaatgacattttccagaagaatagaaaggcactgcttacttacaattgcaagcattacctaaaacttaatgatgttcttatccttaattacaactcagttggatgatgattcagtgcctgaaattatgccatgttttgctttgatgttataaaatgtataatgaaataaaggtgatccgagtgaatcaaaaatagattctggctttccagtagtgacttaatcactatgtttctgacttcacaacttgcttgactgtcatggctattatttggtatgtctttagcttttagtcaaatttactacttaagaagtgagaatgtttaattttaaggttaaggaaagttcatgatgttctcattcacatagcagaaggaccttttaaagaaagcttaaaattatttgaattctgcctttttagttcatagtttaccaagttgtatatcttccttttggaggtagtctttgtctaatggagcacgacataataatggttttcatttactgaatgtctcccatagtacgtcattcattttgcctagaaatcctgtgaagttcgttatgtttatacccattttacaaatgattaaacaaaggctctgtgaggttaaggagatacccaaggtcattatagatagcatgtgcttaatctaggaatcaaaccaattctttttttcttttttcttgttttttgagacagagtctccctctgtcacccaggctggagtgcagtggcgcaatctcagctcactgcaacctccacctcccaggttcaagcgattctcgtgcctcagccacctgagtaactgggactacggatgtgcgccaccatgcccagcaaatttttttgtatttttagtagagacagggtttcaccatgttggccaggctggtctcgaactcctgacctcaaatgatctgcccacctcagcctcccaaagtgctgggattataggtatgagcccctggtccggccaaactcaattctcacttcagagcctctgcctcctcagatagggcagataaagaaaggggacaccaatttccaaggcatgctaggctgggatcatttcagacaaggattgggaaactttttctgtaaaaggtcagatagtaaatattttaggttttgaggaccacacagggtttttgtcaaatattcttatttttaatttttttttttttacaaactttaaaaaatataaaaccactcttaactccagggccatacaaaaacattctgagggccagatttgaccaaaagtacttagtttgccaacctcagatttaggactgtgtcagtaagccctataggtatctattctctcaggactatgtgattacagtcaacaataaaataacttatatccataatagtgacttttaaacactaagaaaatggataaattatggttctctatgccctatttaagaaggcttgcaagtattacatcttagattttcatcaaaaaaataaaaataaggttttggtgtttataatgatattttaggtacctgaaagattcaactttttgaaacacttcatttcataacagataaaatgaaaggtattattacaagtggattttgacagttacagaatttataacataccattttagtttcatacctgagcgtttaattttatttttaaaaatcttacctccttgatatttgagtgcttactattctgtccagatttttcatattgcagactgttacttccttacccaccccccaacagtatacattttattgaagaatacaaaggagtagctgagaaaatggttctttatccttcttaagaaaaaagcattttataacaataggtatcagttatctgagatttttgctgatagattaatgtttatatacatatgaatgtttctttctccaactccttaattcattaaccatctatttttgacaggctaaagtgaatcagacttctgcttcaatccctttgcttaaagaggccccaagcagggttactggggggatagttgttctgttggggaataggggatggcaagggacctggggccgtcaaaccagtagttgaaaacgttttttatttaattcctttatgtccatgtttttctgatttctttgtttttcttcaagccataagccgttagtagtgttcttttgaaaaagtcagtattggctgatcacagtggctcacgcctgtaatcccagcactttgggaggctgaggtggttggatcatttgcactcaggagttcaagtccagtctgggcaacatggtgaaacccccgtctctacaataattataaaaatcatttgggcgtggtgcatacttgtagacccagctactcgggaggttgaggtaggaggattgcttgagcccaggagtttgaagctgcagtgattcagccactgtactttggctcaggcaacagagcaagactctgctacaaaaaaaaaaaaaaaaaaatgatcaaacaggattcagattcagagaactactaccttctctgagtcttcttttctatgtttgctcctccagagatccaccaagtaatgtgtgtttttttttcctgccacctctactggttttttaataaagtaaaaaatacagacagcttcttattccatgttctaagctctttatatgtattagtttacattatcttggcagtaactctttgagaaaggtacttatagccgcatgagaaaactaaggcaccaagaggttaagtaatttcttaactagatcaaggtcactcagctagtaaaatggggagctgggagttgaactcaggcaggctagctccagtgttcatgctcttaaccattcctctaaactctttctcaactataatactagacttgcatcttcctactattaaattcaatatgagtgaatttgtttcagtaaaacaacattattcattacattaaattgataagttaagtttgaatataattggttttgaaatttcatttgtgtttagtttataaacttgttttggtttcatggttatataaaagctataactttgaggaagttttacttgtttttgtgcataataattataattacaaaaataataagagttaaagagtagtcctcaacaactataaattttttcctattcatttacataacattgcttaagtttaggaaacactagtctgtgacgtaaagttaggctcttaatgcagtatagagttccttaaagatatgatccctacctgtcttcagtttgatttctcaccatttccacctttatactttttgacactgaactactcaggtgtgtgttttttgtttgtttgttttgttttttttgagatggagtctcactctgcagtgcaggttggagtgcagtggcacaatcacggctcgctgcagcctttgcctcccaggttcaagtgattctcctgcctcagcctcttgagtaccaggtgtgctttttgtttgcttcaactcacccttgcataggactgtctcctcttatctgcccctcctactgggaaaatggacacggcatccccttaaccccttgcctgatcttggttggtgcccttttttggtaaccgcatagtgtcctgtgcacccttctctcattttactcaccacattgtttcataatttttgtacctgttttaattaaactgatgacctgagcaaagggacaggtacagaagaaacagctatagtgaaaagtaaccatactttcctggccagttagtttcattttcttgaagccaccatcttttttttctcactgtcttttggaacccaaattgaaaccaccatcacttgttattaaaacattaagaactctcattgggacacagtttattatactacattctttctcgtataattagatccttctcttaccaccccaatgactttatcctacaattaatcctctctctctcctacatccttaattcctccttctttgtagagtcatttccatcagcaaacaaacatgtagtacttcccttcttaaaaataattctctcttgaccccatttccaatctagttgttgttccacttccctgccacccacctcctcttttgattcctttttatagaaaaactttttggtagagttagttctagttgcttcccctcacattctttctgctgatactggattcaagaaatgccaatatgggccgggcgcagtggctcacacctgtaatcccagcactttgggaggctgaagcaggtggatcacgaggtcaggagatcgagaccatcctggctaacacggtgaaaccccgtctctactaaaaatacaaaaaatcagccgggcgtcgtggcgggcgcctgtagtcccagctactcgggaggctgaggtaggagaatggcatgaacccgggagagcaagactccatctcataaaataaataaataaataaataaataaataaataaataaataagaaatgccgatatgctgggaggacttacatccatctgaaaacgtttccagggcttatgaatgctataagtcaagaaatgtcaggagccaacaacagagttactgaatgaaacccctgaagataaatattttctacttggagacaaaggtctcattggcaggctcaagcctctcatcttttctgacagtgcctccatctcatgggatatggcttcttatggcgcaggtcagaatgagaaaggagagtgcttagaggtaaagagtgttgaattagaaagggttttatttgttgttgtttgtgtttacttatacaggtcttataaaaatgtactcatttgagctggacttgggatgctgcatcctctagtcccatgattctagtgcagcccatgatttccttgagtttcctgaggttctaaaagccaacttgggctcttgatgtaacctcgggacctcagggaaatcacacaaagagtgggtcttgatagcagtaatagaaaatacggtattattttattttttggatgaagaacccaacattcagattgtccccagggcaccatgctagtaaatactagtaaatgtcaatgctggcatttgaaaaccagatcctacctcatagcatgtgctcttcccactctttcacctataaaagatacacaaacactttaagtcttaagctgcactatccaatatggtagccactaactctatggctttttaaattctaaatttaatgaattatgataaaatttaatttaataaattaaatcaaaatttcagctccccatttcacatttcaatgcacatttcaagggctcagtagccacatgtggctactatattggacaggaatgatatagagtatttctatcagaaagatgtattaagacagtgctacttcctttccaagacattaattttccacagtagtatcacatactcttagaattctgtgctattggtattgatcgtaattgtagaaccttttatcccttattttttttattatccatttttaatatcatggtattatttttcacagaatccctcttttacttggtgtagtcagaattctccattcctcctcttaacttacattttctcttttcttaaaatggcctgtttggaattagccttgccacccctactaatttgaattccacatcatgaaatgaaagttcctactttgtgcttacctggccagtacctgggggaattcacctattaaatcatattcttccccttaatatattcctttggttcctcttccttaacaatttttttctcacttatttggtgtctgttaaatatcaaaacacttttcctgtgactcaatatatgtttatatgccaagtctttttttcagtttgaggtacttgaagttcgtgccttttcatttgacttgctggaaaatagttattccttccctacatcatgagttttcaggattaaaaggttttttgacctttaaattgtaactaataatttgcctaaatcagtgttgctgggtgataacatctaggataacaagtgagttacaggttcacagtgatgactcggaattaatccttagcctgtgtcatcaagcttgcaaatagaggagtctttagaactaagactctatctgctttctctcatggcacacggcatagtaccaagcatttcatcttgtgcactcaatagatgtagatgattaactgtataaaaagactgcgctatcttagggtagggttaactatctcttgatacttctttttttttttaaacccaacacagactgaataatatagtgccttcgaatatctttcagattggtgcattgatatttgtagatataatttcaaatttagaaagtgcttggtcttctgccatatcactctgtaggtatgtattctccttatataactagttgtactgtagaaggtgatttggagccttacagctttaaatcattcttgcctttttaatatttataaggaaccacagttttctgtgcattttgacatggtagcttttatacttgaaataatataatggcaaggaaaatatcctcttttatctagacttctaaggcttaagctttgttttttgttttttcattttctttcagcacctgcggtatgcagctatatacaaggctgatggagagcaaaagaggctgcccgatagcactttaaagaaaagttattaggctggtcttcaaattggcccttgagaagcaggtagctcccttgctactaaacagatgtgctggtagcagcttgggaataaagagcagcagcagagtctggcccaaatactcatttttacccaagcaagactccagtctgagagaaaaagaactgcttagataaggtgaatgaaagagaagtatgtatgactcagttctttcatttgccttgcaaacccatctgtggctctagtggagagcaggtcagaagcccaagagcaatggttatcatttcccatagagttgtgtgtatatatatacacacatatataaagcaaaattatatacataaaaatgatatatatctctctatacatacatgttcgtatacatattttacatctgctcattttgctttgttagtctaatgccaaggtttctatgagtatggcacccttgtagtccttcacagaacagacttgaaacctatggtttctaggcactaaacgttatctcttgctactaagccatattgtattcctcacattctcaggtcaaaccttttgatgactccttgcatttcaatataatgttagctctgtcttcaagggctcctcttaattctctgaccgacttctactgatgtttctaaatacaattgaaatgctaccttcttgttaaagcctttccaaattccttcaggccagtggttctatcccttgtgctcccaaagtacttagttcatcctgctgttgcagcactaggcatctactgtaattatcactttatttgtctgtcatccctctttctgatgagctgctggagcagggattgttttcatatccttaacatctagcacagacctagacttcttaataggtgctcaataaatgagtgactgcaagaataaatgaatgaataaaatataccacctcatgtttgaaatgtacttgaattcttccaaccagccttttcttttgtgctgcttttctttatcttcttcccggcagcacgttcttctgtcctacctggtagattttagagcttaggaaatacgtgtttgaagatttaaaatatagttctttgaactccttagaggaaaagtctatgaataaataattagactcatttcacatcaaaatctaaagtgtgaaaaaatgttcgtatcatttggtgctttattcacttgtatggtaatctaatggcatacccattgttaacactgaactgtactgaaatattttactctcagggcttttcatctgacaaaggaggctttttgaaaatgaaaaatcacagctcctgtccctggtatgctatggggaaatttattagttttgtaatgcatgggttaatattaccatttttttatattgaatattacttgaaaaaattactattaatatcactgcagcatgtatgtatataagtcctgtcatctttggggtatgtaaatcaggaatgttgctgaagaactacttagcattttcttgggggtgaagtgcttagttttggaatttaattgtaggttttacatttaagctgctcagtattactcttctaaaggttctataaatttcttgctttgtagtttaacaggtttagtcaccacagttgaaaggcatcatcctcataatgaagccagagaagaataaaggttgatcatgcagggctggctggctgtgacattgaacaatagagcttgacttcttcatgtctgttaaattagactatggggtgtgcttatcttgctgcaatgatactgaattgtaacatgaaaatgttatgttgtgcagctctgcgaagggagttcatccgttctcacctcatatgtatggcaaaagctttaaaatactactgaagctgcctagtgggcttaaagtctaatggcacagaattgggcataataatgaaacaaataaagaaaaagtgcaaaggcttttaaatgtcttgtacaattttatttatagtagtcttttaagggtctaaggcagaacacaagaagggtatgctggaaaaattccatttggaagaggtctttgaaggagataagtgttacggcctgaaggaaaagtaagaagatatgttgcgtaggtgagtgatttattctaaacttttctacacgtgtacttgatacatacaactcaattctttaaatattgataaaatacctactatgttcccagcaccgtgttggataccataggagattttgaaagagcattaaattcagtcctgccttgagcaatttagtattttttgaggcgacagaaatgaaatccatgaaataatttcttagaattgtcggatatgtgaatgacagtattataagctgtcaagatcatgtaaaattttgattctgttattatatgtatcattcccagatgtgtcacatgagcttttgataggcataccttttatgttttcaagtctctgataaaaatgttaaaaagtcaaggccatggttaggttaggggcaagaaagagccttctgacacttcccatacttgttcttcacacatgctttttgtctacttttgaacctgtgttattttctaaatgtgtataagccacaaattagtaatctgttacaaaattttatcgtggatgttaagctactgttcaagttatacacacatacatgtgtgtgtaaaaatctggattaatattctagttctttcagagcaattatcctgcaaatcctgccaggtgatgggaataaatagggtgcccatcacccagaggtttccttttaggggaagtaagagcatgggagctaaccaacaccaagcaccatgtacccaaatcttagcaagcataactatagctaccagttatctgggcatgtcacaggacatccaaggaggactcaattccacagtttcacctgggcattcggcttatgaaaaggagtccatgcaaccccccaagacacatttttgtcccaaattcaattccaagctttgggtcaaagccctgggaaagaaaactggatctaagggatctagaggcagatgataatagaggttaaaaggcacagtgcaggtgagcatggctagtttctgccaattaagccaagcctcccatttcatggataaaggtcaagctaatattcatggcataaatgaggtcccgggaactccaaggctactgacagtagcagggatagagacataggtgagagcagataattcctattctctaggccctccctgcttcatggctacaaactgctttggcacccatgagtggcacctgttatggtttctaggactcagggatgcaaggatggaagagggaaagaggactcacttccttctttccctcacataccccaggtatttgctaggaagagaagggaaccagggatgcctgctcccctctttctagatgagtagccattcatcttcagtttgtatccctttcaaatgcatcccgaacccctgggattcccttgaaaaatgccctcttttttcttttctcctccttggttctctcttcacagataggtaattgtgtctccatactacgggacattcccctaagatgcaccctccaaactgggaaaagttaatttcccaaaccttaaactggttggcttaggactgggctcaggggaagtccaacatgtcggcaaaagggtagttttttttttttttttttttttttttttttttttttttttttttttttaccagttgggcttttggtcttcctctccccatgcaaactggtaaaaggcctcaggatttttgagttgtcctcagccccctcctcttgtttcattttaatacatgttttctaataacccagtttgtctcttcttactttcagaccatcaaactccaaatggtcatgcaaccaaagtcttgaagtctcggacaatgaccccttctgccaggaactcttagataggcttctgactgccattttccccaaaacaagaccctctgtcagcaggaagcagttaagatctgtcttcatccttatctttatccttattctaatgtcagttagacatacttctttagaggggggaatgtgacagccaagtataaaggggtcgctagagaacctctgggactacaggtgtgtgctaccacacccggctaattttttgtatttttagtagagatggagtttcagcatgttcgccaggctggtctcgaattcttgacctcaggtgatcggctcaccttggcctcccaaaatgctgggattacaggtgtgagccactgcgcctggcaacagatatttactgaatgccagttatgtgtcaggttcagttgcgttgattattcactctcagagcctcccagatttggtctttcccttatattatttatttatttatttatttatttgaaacacagtctcgctgtgtcacccaggctggagtgtagtgttgtgatctcagttcactgcaacctctgcctcctgggttcaagcaattctcatgcctcagtcaccgagtagcttggattacaggtgtgtgccaccatgtccagctaatttttgtatttttagtagagacggggttttgccatgttggccaggctggtcttgaactcctggcctcaagtgatccacccacctctgcctcccaaagtgctgggattacaggccgcgccactatgcccagccttttcccttatattctcattcacttcaacaacttaagttccgacctagaggcctccatctcagtcttccaccacactgtataccttgttgtgctgccacagggtttgtggtgtcaaagcaggcatctcagtccagcattgaggcctttcatcatcacagtctttctatctgaagtttatcttctgtcattcctcatcatacccacaagatttggccatacctgtgtcattacctttgttgttgttgtacatacacatgttatgatttacatttgggcttttccttattccttttccacgttagcatttatgaaggtagtctatacttgattacccaggtgttctttatttaatgtaactcgtattcctgacaagcttatctgcacaaaattttggtacattggaccatttaagacaagagtaaataatcaattttaatttatctttgtttaaagttggagttttatttagtggagatatgatgcatctgtatattgctttgtgctttgttaatgttcagataaggaaactgaggttcctagtggttaagagattggcataggacatttggctagtaaatagagagagtaggattaaaactcacattttataactcattgtcgagtatgcttttcactagaatagttgatttccttttattctcctcgttttatgtaattctgttataatatccctaaaggtaagagctgtattttgtatcatacccctcctccaaatattcataacattagtgcctaccgtagttttggataaagagatttaattgccatgttgatatatgtgaatgtatcagtcatagtgggataggttatgttgcaataataaacagcccatcccccccaacctcagtggcttacaacactaacatttctttcatgttgcatgtttatcttgggtttattgtggctatgtttcatgttgtctgcaatgtgcaacctgggatcagtaagcaacttcttgaacacttgtagtggatagaaaaagggcacagtaacccatgtactacttctcaaacagtaatgttttcacatcttattggccagagcaatttacatggtgaagcctgttgtcagtagggcataaaagtataatccttctgtaggtaggggcagcaaatatttttgaaaaataatactccgcccaaaaaatctgtgaccttacatacagagcattgagcaacttgtatttttcagtttatggcatactatcatcattggtccctgtctggccactttgttttttaattcatttgtctgtctgttttaatgtattcttataaaatgcattctattgtttgggatatgtattttaaatttataagtggtataatgctagagattgtattctgtttcttaattttttttcacttaacatttattacaagatttattcacgttgctgcacattcatccagtttgttgcatctggtgaatatagttgtcccttggtacatgtggggaactaaccagttctataccaaaatccacacacagtcacatctgaaagttgaccctgcagaaactgcatatatgaaaagcaccccaccacccactgctccttacgcacgggtttgcatctggggaatgttgtattttccatctgcctttagttgaaaaaaaatccacatataagtgtatctgcacatttcaaacctgtgttgttcaagggtcagctatctatagtattgcatgataaatatccactacactttacctgtccacttccctagagggtcttcaattctgtactacaataaatggtgctgcgtgagaatttctttgggctgtacacccaggtataagattgctgggtctttggacatacatatatttaactatttaagtattgctttcttattgtttttgctaagtcttcacagctattaagccttggtattatgagagtttagtaattgtgtattctatcttgtaagttaaccttactaattctgtaaaaaaagtccacccaactaagaacacacgtgtaagtaatgtgacatgtaattcacctctgtaaacatatttttcactaatgattatgtatatgcgtatgttataaactgttattctgaggcattattttgtatctctgtaaatcagtgagtggataaacaaaatgtagtatatttattcaatggaatatttttcagcaataaaaatgaatgaattaatgatacaacctggatgaacctcagaaacattgtgctaagtataagaatccagtcacaaaagactattttaagatagcatttatatgaacggtctaggacaggcaaatctgtagagacagtagattagtagttgcctcgtgcaggaaactagggagtatggacggaatggggtttcttttgggggtgatgaaaatgttgaaaaattgattgcgacaatgtttgcacacctgtgtaaatacacaaaaaactattaagttgtaccatttaactgggtgaactttgtggcatgtaaattatgtcttaataaacctgttaaagacaaaacaaaacttcaatcagatcgttttccaagaagcaggctagaaatgagttaaatgttgaccccttcatgtagggggaagattttctccccttgtgagaacctgaagggaaaaaattgggacagttttattcccaaactctatcctcaagttgtttgaaaataaacccatgcatgttatttcaactgactatctctgtgctgatataccctcagccctgataatttgtttaactgtttagttatcttcaggatatttttacttgtataacccaccactaattttcttcccaattatccaatttctgctgtcctttcggttttttatatctcagtagtttatatctccataaatcttggtgatctctttcttttttctcatttctagattaaccttttatcatgtcatatcatattatcttgaaattatttttcacatatgcttctttttattctttagactttactctgcccaaaaggagaaaataatttctttcttcaatgttttagaaacaatagcattggcagatgtatgctaattaatacttgcttaaaaacagcaaggaaatttcttctttcaacactattaacaagtatctgacatgaaataacactttcacaagtaaaagggattctgatattttacgttccttagtaaatctttggggagggggttagtactagaaatttttttcctttggaggactggtaaattcagttctaatttttacattgttttacatatgtccttttatgatcactataacatttgtgtttatcaaataagttaaagtatagtaatttttaagttaagtagcgaaatccatgataatccagagatgctcaagtgacttgaatgcttcaacttgagatgggtcagctttaggggtgaagttgtgaagagaaagccatcacacacacttcatcaacactgtggaatgagggaccgatgcttttactgagcagtggatttccagtgagcatataaactaattggtgggtgaacataccccaggagcaatgattttaaggtcatagcaggctcagtgaataatgctgacttacactgcgtctcactgatagctgatcttaccaatgagcagtttagaggcattcaagcctgagctgtcttccatgtgccttgaatggcatgtcagtggtcactgtttttgacatcctttatatttgtccagtcagctctaaatctttaggttcagcttcagagtactcaggaaagaaaagagagaagcaattattttcagtcattgagttttgaagatcttagcgttaattatgccaaacattgttggttcatcaacaaatacaaaccttaaaaggggttatgaagcattctgaacttgcttaaacatagtttatggtgattaagagaatcttgtatacactaatatatttttagttacactttcacccatatattttcatatacagtttcaaaaccaaatattcaaattaaagctaatttcagttttggttaataaattttgaaatgcttattcactttaattagcatttctttcgtatttgaaaaaagaggaataaaaaagtacaattcactatttctctgtggagtccagagtaattttgggtgtgaaaaatatttcaataaaacaaaaatcacaatgtcatagctctagtaatgctatttaaaaattgatttaatagtgggctttgagatttagaaattttctcccacttaaatctttaatttatcaaagattatttgagcattaaaaatgtgctttgcctattgttttccaactctctgtgctctctgacttgttgaagttttgcaggaagtgcccaatcaaaggatttgaggaagcagtactggacattctttggaagtgttcatctgagaaaatgaaagttagaggctaaactagttttcttgtttgcaactcaaattttaaatctaatttcccatgtaaataaaataagtgaaaagcacaaaggatgtaaacttcctaaatctgccagaatcttgtgtcttaattaaaaaataattttatcatagcaaaagaaacacatttagttcctaaagaaaataccatgggtggtattcttttgttgtattagaggtttgaagtagaatagttgtttctcatgtacatgtattacagtagacaaagtgttgaatagttttcatttctgatacattaatgattagaaaaatcgttaccctaatcctttttttataactcaaaaacaaactaaaaaggtttttgtttttttggaggatctgttctttccaagaggctggtgttcttctacctttactgtcctaaccttgcctttcaaattaagatataatagttagaatctactatagaattaatttagattcagttgtctctattaacagaaagtgatatggttttaaaaaatgcagatgatcatttatgagaatctggctgtaatcaaaagcagtaactactatccttagcagttctttattcagtaaagagttatcctctttttgctattctttatttcatttattcttgtgaaatatgtttacctttttaacaaaactttctattttacgtggctagatatgtgataaaacaaacacggtaaaatgttaaggatagaatctaggtggtaggtatatggtcttctctgtaaaatttgcttctctttcacatttgctgtatgtttgaaattttcatgagacaattttagagaaaaaaagctttctattttgattgtaatagccaatagccaaaaaccttattccatttttgaaaaaaaacctagatattttaagtttcttttacttatctaagcataacaatgcaaataccatataatatatattgataatatcacacatttagtgagttagaaaatataaaactggcttttaattgttaaatatgtatactatataccattcatattttagctggtggtttaaaaagctaacttaggcattatttaaactgaattagggtaattacatcaaaagtagtttcttagccagaataattttccattttgttaaaggagccatgatgaaatgaagtgtttagagagttttaggaataaaatgtgggtgtgtattctttaacatagaatgaatatgctttccagtggactttggaatgggaaaagtatcaataaataatgcttattaagcttctaactaggcatagcgccagttatctcatacttgagagagaattttttccttaaataaatgcaaccattgcattttgggggtgcttttcttactgtcttcattcaactgtttgccacatgtgtgcctgatacattattgaatcatagaaataatgtttaaatatatgtgggctccccacctacctcctttttaaagaaatagatattaaacacacaaaaaaatattactattgtttcttccctgaaatctttcatggcacacttggcttacagagtttaattttgctgaaataagagtttataagtcattttacctttgatattccaaagttggaaacctagagataatttttaagtaaaatttatctttaacctttgtattataatctgtatttacatgagtgtgcaagtagcctctctttattaatgaaaataaagactagtgaaaaaattttacaaatgattaacctagttcttgcattcattaggtatatttacaagtcatctgtgatcagtttagttaccatccctttgatatcctgcagccattattggatgcctttggggttgtgatatcatgctggggaagaatggttcggctgcaggttttatgtgtctttttatagttgttcacaatatcccatgctaaattatatggtgaattattatacatttgctagtttaaaagatgtctaattgatttactatgctaaaatatcaaagactatatgctgcaggagtgatgcttccagttaacaacttatcatgtattcatggagacgacaatgcttgctcacatattggcactattgtctaatttggtgtgccttgtgttgtaattcaatcatctattattaaaagtagatgtggctgtagggagcaaaaccacatacaaatccataaacatacatatgtgcatatttacttatactcacatatatgttcaataaggtttttgttttacctgctattaatgtttgtactagtgagtcataaatggaaaatatctattagctctaaggtaaaataaaataggttttgatttagttcaagtgaaccatctcatttaaaattagcccaggggtcttgtaaagaatgcaagtaatctaaacataataatgcacattgcccaattgcttctgtgtatgatacaggttcagtgctgtagtgctttgacagcccattactgaatgtaatgaacagctatttttaaacagaagaaattcaagttgacagcttggcaatgaaattcagctagtgggataatttttgtcatctttagtatagagaatggattcagtttggtttaagcaaatttgtatcatgtagtttatagcgcaaacatttttattaaaagataattttattgtccattttgtggagaggggcagatgttactgttaagaatatgtaatcagcttttaatgaatactttaatgaattactgaaacatcatttctagaacctaggtttaaaatgaaatttctcatttttctttcctgccatgggtgaaatagtctaataaaacgactataagattaagaggtgtttttctatgctgctttttagtctttcagagtttaaaacaagtagttttaagaaataagatagtctttggaaatggatataaagcttgaggcagtgttgtcttaatggaagtaagaattagacaaaataccattgagagagagaaggaaaatgtctgcctgactatattttagagaaattcttttactaagaataaggagacggtaacatctgattttgacaactcttaaaaaataagttggagaagcttcgtctgcaattcttaaataaaacatatatttttaactcatactatgaaaaataatagggtaagtcagagtgagttatttcattctcttctgtttacagcagaaattgtttgagaattctaattgctattttttctaagttgagctaattgccagagcttttaaaatagagacttcaggttcaacgttgtgcattgtgttaaatgtggcttgaaaaatacattactcaacgaaatctgggtgaacaaagtaagtaaactgagtactttacccaatatccaataatgtttctgaccctaccagtaaaataaactaaatatatagcagtggtgaaaattttaaaattgtcagaaatccccctctaaatgcattgccagaaagctttgttcatgggtcttcattaccccttcatgcttccagggcacctcctctgggttcccaaggcactgggaacttaaaagttagctttgcttagtaactatgccttgaagtaggataataaaacaaatcatttttaatagtcagtagattttttttccatttctgatctgtttctctattttacttatctcttggacggcataatggccccaaacctaatatagcaatgaatctgtgtagaagtcaagcatttttggagaggctttcatgttaggtcactactgtactctttagaattgtattgtatcagtgaatcaaaagaatttcttgacatgaaagaattggtacacatctataaacattttatttaaacctagagaggatattatttatctaacagaatccagcttacttctagcaacagtaccatcagtttgtagcctggtctttgaactcttgattttgttgtgaagtgaccctcttgaaatcttaatttacccatggatagaggacgttgtatgaggcagaagggcatcatcacattagccctgcttctctatggcatcatgagatgctaagataagcacttgaaaggtattttaactttcttgatctcagaataacttgagaagaaattcatggtacccacatactgggttaacaaaataattagtcgcatttggttatttgtgaggaggaaactgtgaaacgtgaaagtaggactggggattccaggacgaagcctagagatagattttttttagaaggaggcttatctctgaagatgggcaggatgaaagaagtcaccagcgattccagtggatgctttctgtgttatgtgactacatttttctttctgcttgccctttgaactttgaggtctgagcagtgcaggaagaagagaagaaattgcgttgccatgatacactgtaagggcttcaggaaaatgggatatggcagtggtttgaaagatattgagaaggtttccaacccaattgtcattcattgcagctgtaagaatttaatgggatatggtctaatgaagcatacccattgaaaaattcttaaactagtgtcttgagagtcaaaattgtttgctggttaagacacattctgtctggagcttgactgcctgggcttaagccctatcactagctgtgtaactttgaccaagttatttaaccactttgtgccattgtttctttatttgcaacaaaaatcacaactcccagggttagtataaggatcacatgggttaaacatttaaaattcttaaaaagctattttttttaatgcaaaaagagcttaatttgtgtaatctattgttgttgttttagaattcattgtagttggaatgctgtgtgtcaaaaacgttggtccttaattaaaggttaaagttatcaggaatcctaactttgaaaaaggaaagtctaaatgagaattcaattccatttggttaatatttatcattcataaatattaagtagcatgggatgggatttataaaatattgaaatcatagcttctaccctactaataaactctttgaggatagggaacatgctgtatgctaccagtcttgtaacctaaatggtgccttgtgtaattcaaatatttgttcagtaaaagtcaggtcaacatgaatccaaatatattgctagtacatattagatacttaatatgtgtaacttaagtgaaaggatttatttatgtgcgtgagtatgaaaacaagtgttcattttcactagtgatgaaggacttgaattacaacaaaagagttacaggttataaatagaagtaatctgactatagggttggtaaacatcctagttctttcctaagagaaataacagaatctatatattgtaaagaataggttatcaggtgacatttaactgtctttatttgttgtagaagaatatttaggtcttttagccctcttaccctctatttctcagaattattatataaatatgtacattcttgtgaaagaagaaacaaaaagaccttggaatgaaaagctttaactacagccaagtttaccttttctatacatgtcatcctttctcttttaggggaagcaaccaggggaaaatgaagatatcaccatcagtagtaactcttccttttttgtttaaatggtaaatatgcctggggagatgggacttataagaaaagatgttttggccaaggcatcctacctctgcttgtcttcatgatcttcattacaatcatagcagaaatcctcatgctaaatgtttttcttttccttcttttctgggagatcattaatcagctatcctattttcctattttacgatttctccttctccagcccaattatgttttctacaaagctagtgtctgggatactaactcttaactcattcaagcaagcttctcggctatatcattacaataaattctatttaaaatacttagtgaagtacagtattcataagccagttattgcattaggtgtagctgcagtgacactgattagcattcatcataaagatagttgaatatgatttatttatatttgtatgtaagtatatatattttgaatatgtactatgctcatatgattcaaagttcaaaatggcctcaagagtataaactgtgaaaagtctcctttccatctgtccttcatcaacccagtttccctctctggaaataaccacaatgactaatttcttttgtattcttccagagttattttctgcatacaaataaaaacatgtatggttgcatatatttctgtatacttaaaaaatggagatgactcttttgttttttggttaacatcactttctggaaggcaaaagatgatcataaattccttctgagagtaccaacttgccaacttaccttaagtcatatttctttctttttattttctttctctctttttttttttttttgagacagaatcttgctctgtcacccaggctggagtgcagtggcatgatcttggctcactgcaacctccaccccccgggttcaagcgattctcccacctcagcctcccgagtagctgggactacaggtgcgtgtcaccacgcccggctaatttttgtatttttagtagagatggggtttcaccatgttggccaggctggtctcaaactcctgacctcgtgatccacccgccttggcctcccaaaagtgctaggattacaggcatgagccaccgtgcccggcccttaagtcatatttcttaaaagtgcctagtgtacaagagtctttgaaactagaaataagtaagaagagaaagcaaagatagattagaaaccctcaatatttgttttcttcttttggaaattctcaacagaaattccagatgttacaaagttgaattagctagttcctccatggctgcttggtgatggataagccattcccctgcaaatgaatagtgaaccctcagattctcttggaagcatggaacagcctgcacattagtgtaaagaacatcccccattttggagtcagattaatctgggtttggagacacagatctagcattaggactttgtagctttgtgacttttttttttttttttttttttttgccagagtctcgctctgttgctcaggcttgagtgcagtggtgcattctcggctcactgcaacctctgcctccccggttcaaacgatcttcccacctcagcctcccacatagctggaattacaggcatgtgccatcatgcccggctaatttttgtatttttagtagagacagggtttcaccatgttggctaggctagtctcgaactcctgatctcaagtgatccgcccgcctcggcctcccagagtgctgggataacaggtgtgagccactgcgccctgccagctttgacttttagcaaatgactgagtcacctcgtgaaaactctgtaaatagagagtaatcaaaccaaacctgtggtatatttcacacggttaaatgagatcatgtaagtgaatactgtctggacaaaaagtaggtgctcaataaatgtcagcttctttattcgccattctgccagtacatttaagatgaaaaggtctgctttcaggggtttgtgctgttcagtcttactgtgcttctcagaattgaaaacagcatttagaaagacgtttttatataattattcatcttgtaaggatgcaagtgtcagaatctatttttaatccaacaaccagcttttctgtagtgttttaacagtttacaaatgttaactttccattctctctagggagatgagagaaatcgataaaaggcgattacaagtgaatactcctatagcaatacttgatacattaaattgtttaaaagtgttttttttcttcttcctcttctagttgcagtaatacgaggtttctaaaggccatacgtaactgtgtacataaagaggaaagctacttgggatagaaggactctcagattgggttttaacttctcaagtataaaaataagacaagtaggcaaaaatatcacattctgaagttttaagtgacagataaacaaattcaacatgcaccaccaactttttgagttttaggtacactaacttattgtgggatctgggccagctgctctacctctgtagacatttctaagtgggaaaaaaaaaaaagatttaggaatagtacccttttcagattctctcagaattatagttgtaagcactatgtaaattcatagaacatagttttgaagaccagctttagaatttcaatagttattgtatattcaaaacagctacacaagcactttattttcattttaaagatttacaattaaagtcattttatgtatacctcaaatgcctgattatacacaaacccattacagggtttatacacacattaaatcccttcttattatggggttttgtgcacattaaatgcctggttgttatagattgttgtttttcttgttaccattaaatgtaacatttccctaggtgatgaaatgtattattatttagaacatttattttagtgtgtgttctgtattttaaaagagaaaggtatttaagcagcaaagatgtaactgttatgaaatttatttttataaatagctttcagcagaaatcagaacagtgctttaaaattacagttaaaaaatcatttaatcatcacactccttgatggctaatagagtagtaagtgactcccccatatcccccgcaataggctattctcgatatgctcacttaagtggccctaagaatagtactagtatattttatgttagcaagccttgatagcaaagtgccaaaagttcagggggcatttgtctcctttctcaaaaattcatttaagtcttgctggagctttaactggggcagacagccatacaaatgacttgagataaaatgaaaataatggactgagctgggtgctggggatggtagttatgctgagcacacatcaataagcttggagtgtgattctatgctaatgcaagcctgatggatcagctttctcttttagcctggaggaccattaagctctggaagctgagtcaaactgatagagttggcaaatacagcccatcagttagcagcaatagttaactgactgtgattcctaatatgcgaaactaacattgcttaaaaaccctccatgttcaggacatagatcagaaaggagataatagattctgctttaatttgcataatcaaagcttctcattttcccaccttatagttaacagaagagggaaaaaaagccatggctaccttcattttgttgttagtcttgaatcatagcaaataattttcataaaaatgtaaataacttgtttcaaaataaaagagtatatttgaaagattctctgtgttatttctttggaattaaactgtaggcacagttacatgggttgggtagtaagtgtcttggggatatgaaaagtaacaaagtcttaaaaaattgtgagtctttttagtgattgattattttcatatataatttataaagttctatacttttacttgaggatattggctttgcaaacttatcaaaaacagttcaaattctgttgaattcatatttttgtgttgtgaggactttctgttcatttaaaaacatttgttgagcacccatttatttcaggcactgcattggacactggtgatgtggttgtcctcttggagcttacttttttttctttacaggggaggtaataaactagtaaacaaagacataatacagtttcagtgagtgatagattcttttttttttttttttttttttgagacagagtcttgctctgtcacccaggctggagtgtgcagtggcatgatctccacttactgcaacctccacttcccaggttcacacgattctccagcctcagcctcccgagtagctgagatcacaggcgcataccaccacacccagctaatttttgtacttttggtaaagatggctttttgccatgttggccaggctggtctcgaactcctggcctcaaagtgatccacccgcctcagcctcccaaagtgctgggattataggcatgagccaccatgcctgccctgagtgacagattcttaagtagagccttctccatctgagagattctactctgaccaagtttttgccaaatagactcaaacattaaatatgctgttttcaatcacaggtttccagacggtctaaaaaatttgtaaatgtaaggaaaataataaataaatttgtgttgaagaaaaattaagggcttttgtgtatacctcgttgtaatccagactgacatctctgtgaaaaccctaataaaagtctatatgcacgactttctgagtgtttaatatgtgctggctctcttctaagcagtttactcattaaatatctcattaaaaaaaacctctaaagaaggtactattattcccagatgaggaaattgagacaataaatgttaaataacttgctcaaagttatatagctagtaagtgggtgaggtgggattaaaacctaggcagtttggctccagagtaagtgttcttaatcactgttactctatggcaacctgaagaaatttgtttagctgaaaatgtattgctactttagaatgcaaggtttgagaggacagggaatgcatctgtcttgttcacctctaactctgcacttagcactgaacctgggttatagagggtggccaataagtatttcttgaataagtgagtgtaaatgactactattatatgtttaaattgaataatatttcatacaaattcttttcaaaatttattttgctacatatgtttttctggtgccctaaattagtatatgccttatatgtacattccagtgctagttagaatgataatacgatcaattcctatggatggggtaagggtagggccagaattccttgacctacatcatttctatagcctatctaccctaggtatatgggatttctcagtggatcacatcacatcgagctcatactgtgttcttgtataatacctgctacccttgactcacagaatgttttgtgtgatgtcaagtagcaaatgcttacatatttctacttccaattatgtttcctttctccttatatctttggagaagacaataacattattctgtaagtatcaaactgatattaaatgattgaatgaatggggctttctcctgtacatggtttgtttttagaatataaaaatgaaaaataatttttctaaatataatacacaggacaactcatgtagaaaattcaaataataaagaaaagggtaataaagtaaaaataaaacatattctcattactcaaaataatttatgttatcacttacatgtattaattctcagttaacattttggtaatcatcctttcagataactctatgtatacatagacacttacacatgattttaaataaatgagtttataatgtgcatatgattggataacctgcattttttcactcaataatgaaacttggaaattttttttcatgtcaatgaacattattatagtttttaatgacctactctgttgtttggatttatgattatttaattggccttataataatagatctaaattcctttttttgcttttatttttgatgttccaaacaaaactgtagtgaatatgtattcatatatctatatgaattgttgctgggtcaaaggttttattttttgggtcatgtgtaatctgacagtttaaaattatacaaaaatgtgctgaagtccttgcgttcattgcttagggagtatctgtgtgcaagaggaacattatatgaatgaatagaaatataattcaggtctcagctatttagaaaaaaaaatgcttcttaattctcttaatctaaagatttcttctttatctccttttgctttttctccttgcactttgttaaagaaactattgttctgtaggttttcctgtagagtctgagttttgctgattgcatccccatattgtcatttaacatgaactgctaccttctgtatttcctatacattgatcgttaaatctagaggcttgagccaattcaagtttgattttatttacttatttattcaaagctacttcatagggagagcttttcttctctgccagaaggccacagtatcaatcttattgtagtattgtagtacttacagccattcttgatcaatgccatggatacctatgttaatgtctttgcagtcctttaagttgttccagtttggatttgcataacacaccacttcaaaacttaatggcttacagtaatgtcagcaagaataggaagccctagaccttgttttcccacaaagacactgacttaacaatatatgacccaaaaacatttaggatagctccagaagccagttgtgaattcacagcaccctaggcaggatcaaagccatgaatagttctattgaaagagataagacaagtagttccatttgaatgatgtcagcccctctcttaagccagcatagctcataatagggaggaaaagcccaactcatggcttctgccttgagaggaaaacagaaaagtgaaatgtacatgcaatatactagctttttagggggtgaaaaagtaaggggttgggtgggagttgggctgcccagaatgttgatttcagtcttgcctgactcagagtgctagctgaaccagcataccttggatacctggggtctacagtgaacaaaagagaacttagtagctttttgcagcaccaagaaccctgccagtaccacagacaggcgcaagagggaggaagaaactataaaccgaaaaagaaactgacaaacttctctaattgggaatttacatgcagagagtgagagaagatacatctccccataaaaggattgagaggctgtcagattctctggctgtgctgtttggtgaaggtcttcccctatagaaagccagtatgtaaagattgggagaggtggctgtttttcaaatgcaaaaatcacaacaaaaaataacaaggcacacaaagaaacagggaaatcagtcaaagaaacaaaataaatctccattaactgactccgaagaaacagagatctattagttacctgaaaaagaatttatgataatcttaaagaagctcaatgtgttacaagagaatacagatagacagctaaatgaaatcaggcaaacaaagcatgaacagaatgaggatatgaacaaagatatagaaactataaaaaagaacaaactagaaattctggagctgaagaaaacaactggttaggaaaattcactgtggaagaccaacaagagacttgatcaaacaggaaagaatcagctaactcaaagacaagtcatttgaaattattgagtcagagtaacaacagcaacacaagaatgaagaaaagtaaagaaagcctgaaggacttatggtgtaccatctggctgaccaatatatacattatgggagttctagaaggagaagagagaataggacagagagcttatttgaagaaataatggtcaaaaacttccaaaatctgaggaagaaaatggacattcaaattcaaaaaactcaacagactgtagatatgatgaatcagaagaggtgcacactgtgacacattataaactgtcgaatgtcaaagacagaatctgcaaagcagcaagagaaaagcaacttgacacatacaagggagctcccataagttatcagtggatttctatcagaaatgttacaggtcagaaagagttggaagatatactaaaagtgctgaaagaaaaaaaactgccaataatactgtatctggcaaaattatcatttaaagatgaaggagaaataaagaccttcttggataaacaaaagctgagggaattcatcatttatcatcactagaccttctttacaagaaatgctaaaaggaatctttcaagttgaaacaaaaggatgctagacagcaacacaaaaacatatgaaaatgtaaagctctctagtgaaggaaaatatatagataaatacagaatcctataatctgttatgaagtgcataaatcacttaattccaaagtgattccaatttaaaattggatatttatcttttaaattggattatcttttaaattccaatttaaaagataaaagcactgaaaatagctaactataaaactatgttaatgaatataaaatataaaaagatacgtaatttgtgacactggtaacatagagggaagagatgtaaaggaatgaaatatttatatgtgatttaagttatcagtttaaaagagatcattataactatgttttatgtaatcctcatagtaaccacaaagaaaatacctacagaagctgcacaaaaaaaatgagaacagaataaaaacacatcactaaaaaaatcaatgaaacaggctggacgcagtagatcactcctgtaatcccagcactttggtaggccaaggcaggtagatcgcttgaggttaggagttcaagaccagcctgaccaatatggtgaaaccccgtctctactaaaaatacaaaaattagctgggtggtggcgcatgcctgtactcccagctactcgggaggctgaggcacgagaattgctggaacctgggaggcagaggctgcagtgagccaagtttgtgccactgtactctgtcaaaaaaaaaaaaaaaatcaatgaaacataaagggagacagcaagagagaaaaggagagacaaaataactggaaaatatagaaatagtaagttccatgggaacggtgagagcttctctatcagaagttacttcaaatgtgaatgtttactttaaactccttaatcaaagaacagagagtagctgatttaattataaaaacttcaaacaataaatgctgtttataaggcactcactgtagatatgaagacttaggctgaaagtgaaaggatggaaaaagatactccatgcaaatagcaaccaaaggaaaaaggaggttagccctacttagacaaaataaactttaagtcaaaaactcacaagagacaaagaaggacattatataatgataaaaggatcagttctccaggaactcaaaacaagtctaaatatatatgcatctaacagtagagcacccaaatatataaagcaaacactagcagaattgaaggaagaaatagtaacgcagttaacagtaggatatttaaatatttcacttttcataagggatagatcaactagacagaagatcataaggaaacaaaggacttcaataacattatagtccaattggatctaacagatatacagaacactccactcaacaacagcataacacacatttttctcaagcacatatagaacgttttccagtataaatcatgttaggccatcaaaagcggtcttaacaaatttaagtagattgaaatcactttatgtattttttctgaccacactgaaataaaactagaaatcaacatcaaaagggaaactggaaaattcataaatatgtggtgattaatcaacacactcttgaacaaccactgtgtcaaaaaaatcaccagagaaattagaaaacatctgaaggcaaatgaaaacgaatacacaacatattaaaacttacggaatgcagcaaaagcagtactcagaggaaagtttatagtggtagacacattaaaaaagaaggctctcatatcaacaaaataactttacactcaaggaaccagaaaaagaacaaactaatcccgaagctagtagaaggaaggatataataaagatttgaacagaaataaataaaaagagaataaaaatgattttaaaaaattaacaaaactaagatggcttttagaaaatatcaacaaaattgactagccattagctagacttaaataaaaaaagacaagactccaataacaaaaatcagaaatgaaagagcagacaaaacaacggatgccacagaactgaaaaggactataagagactactatgaacaattacacagcaacacatttgataacctagaaatggataaatttctagaaacatataacctaccaagactgaatcactaagaaataaaaataggccagtcacggtggctcacacctgtaatcccagcaccttgggaggccaatacaggaggattgcttgagtccaggagtttgagatcagcctgggcaacatagtgagaccctgtctatacaaaaaataaaagcaaaattagccaggcatggtggcacatagctgcagtctcagctactcaggaggctgaggtgggaggattgcttgagcctgggaggtcaaggctgcagcagtgagctgtgatcatgacactgtactcagcaagaccctgtctccaaaaacaaaaacaaacaggtggctcacgcctgtaatcccagcactttgggaggccaaggcaggcagaccacctgagatcaggagttcgagaccagcctggccaacatggtgaaaccctgtctctactaaaaatacaaaaattagccaggcatggtggtgggtgcctgtaatcccagctgctagggaggatgagacaggagaatcccttgaacatgggaggcagaggttgtagtgagctgtgagctgtgattgcaccactgcactccagcctgggtgacaagagcgaaactctgtctcagaaaaaaaaacaaaaaaaaacaaagccaaaccaacaaacaaaaactcaccaccaccaccaccaaaatatactacaaagcgacagtcagcaaaacaatatggtactggcatgaaaactaacatgtagaccaatagaatacagaaccaagaaataagtttgtgtatctatagccaactgatttttgagaaaggtattccaaaaatatgttgaggggaaggacagtctcttcagtaaatagtggtgggaaaactggatatccatatgtagaagaatgaaactagactcctagttctcaccatgcacaaaaatcatctcaagatggattacggactcaaatataagacccaaaactatgaaactaccagaagaaagtatgggagaaatgcttcagggcattggtctgggcaaagattttatggctaagacctcaaaaacataggcaacaaaagcaaaaatagacaaatagtattatataaaactaaaaagcttttgcacaacagaataaacaatcaacagagtgaaaagacaactggaagaatgggagacaatatttgcaaactatccaacaagagtttaatatccagaatatacaaggaactcaacaattcaacagcaaaaaagcaaataatctaacaaaaatgaggctataatctgaatagatatttttcagcagaagtcatattaaaggccaacaagtatatgaaacaatgttccacatcactggtcatcaggaaagtataaatcaaaaccatgatgatatatcatctctcactccaggtacaatggctgtcaacgaaaagacaaaaaataacaaatgctggtgaggatacagagaagggggagctcatacactgctggtgggaatgtagattaatacagccattatggaaaacagtatggagtttcctcagaaaactaaaaatggaactatcatatgattcaccagtatcactgctgggtatatatccaaagtaattgaaatcagtatattgaagagctatctgcactcccatgtttattgcagcactgttcatagtagccaagatatggaatcaatctgtgttcatctagagatggatagataaagaaaatataaggccaggtgtggtggcttatgcctgtaatcccagcactttgggaggctgaggagagaggattgtttgaacctagaagtttgagaccagcctgagcaacaaagcaagacccagtctctacaaaaattacaaaaattatttgggtatggtggtacatgcctataatcctaggtactcaggaggctgaggtgggaggattgcttgagctgggaggttgaggctgtggtgagccatgattgctccattgtactacagcctggatgacagagtgtgagaccctgtctcaaaaacaacaacaaaaaaacaaaggaaaagaaagaaaaatgtatgttctcactcgtgtggaagctaaaaatgttgatctcatggaagtagggaatggaaggctaggaagagtagggtgaaggaaggtattgggagaggttggttaatgtatacaatattaaagctagatgagaggaatcagttctagtgttctacagcactgtagagtgactatcgttaacaaagaaatgatatatgtttgaggtaagatatactaattaccctgatttgatcattacacattgtacatatatatcaaagtatcatactgtatccataaatgtgtacaattactatgtgttagttaaatataataataattttttaaaaattagcttattttttcattgagtgtcttaatctatttggctgttgaatcttattaaacctgattttttttttgttataaataatttggtcatgttgtctgaaaatccaaagattgtgtatttggtgtgtgccctttcaatgcgtagctttaagtatatttctttgtttataaattttagaaacattttcttggatgataattccacatttgttgtaatccattacttttctttttcaggagctcctcttacatgtatgttaaatcttcttctttgtgtttctttatatgttactttatctcatgtttataattgctttcttaatttgttttctttccaaattttttattgtgttaaaatgcacctatcacaaaatttaccatcttaaccattttttagtattcagtggtattgaatacatacataatgttgtacgcttatcatcaccatgcatctgtctcctcacattttcagtttttattttgtctttaattgtatccttttcatcttctattacttttaaggtattatcagttacgtttgtttgctctcatgttccttctggttttgttttcatttttgaaaaaaatttctttcatttctaatttttttttgcattttatcaccttatttctgggttttctaattctgatttatatatttaaatatcttctattgctttcttaatttcttctagcttgtttggacataataagttagattttctatatagatattttctgtatctatccatagatataatttttccctttatctttttttttctctctaataagaactttccatgagattcaactgtaatatttcctgcggctcattttaatgtaaaagtagttattctaaatatttaggtaggagggttgtgtcaatatagcttttgtagctttccagttctaacattctcaattctgtttttaaaactatggcctcatactgtgaagtttcctgggttttctcctctcccatttttacctgggtcatttctttgctttaattctattgccccatcctgcccaatttgcattccactaccagccacttgtcctttgtgagggcagcttcagaccctttgtactctcacctgtgagttggaatgggcagtagtgtctctcattttcagttgctgttctcaaattggccctccatgcttctcaaggaataccttggaaggagtttacaatttggaggtgtctggtttcttcccacctgtttgtattttgtcattcatggagataccttgttatagctttgttgtagattgtcaagggggttttggttattctacttaaaaagtacgtttactgtctttatttaagaagctgattattgaattttgctatacattaataaaatgatatccagacaaagtcattgctaatatatatgcatgtctgttttttccttctccaacaaccttgcgtattatctgtcttttgaaattgtcagttggcaaaaagtaataccttattgagttcttatttacatttattgattacttatgagattaaccacttttcatgtatttgaggtccacttgcatttttttctattgtaaattaattgttcttttgtcagtttatctgctatgtttatctttttcttattggattttgagagctctttgaatattaggaatattaatgttttgtttttcactattgttaatgtttcttctctctctctctcttttttttttttttttttttgagacagtttcgctctctcacccaggctggagtgcagtggtgcgatcttggctcactgcaacctccgccttccgatttcaagcaattctcctgcctcagcctcccaagtatctgggattacaggcacccgccatcacacctaagttttgtatttttagtagagacggggtttcaccatgttggccaggctggtctgaaactcctgacctcaggtggtctgcctgccttggcctcccaaagtgctggcattacaggggtgagccaccgcgcccggctctaatgtttcttctctagctgtttgcttttaatgctttaaaaacatttttttataaaattttatggaatagccaggcacagtggatcacttgagtctaggagtttgagaccagccaaggcaacatagcaaaaccccgtctctaaaaaatatatacaaaatttagctggtggtggtggtgggtgcctgtcgtcccagttactagggaggttgaggtaggtggatcgcttgagtcaaggaggtggaggctgcagagagccatgattgtgccaatacactctagcctgagtaacagagcaagaccctgtctcagaaaaaaaattaactaacaaaagaaagaacatgaccttggagtcaagtagttagatggtatagcttaagcatttactagctatgtgagttgagtcaaatcactcttctctgattcttgatgtaaagtatggagtctcactctgttgcccagactgtctgcagcctccacctcccggttcaagtaattcttgtgcctcagcctcccgtgtggctgagattagaggtgtgcaccaccacgcctgggtaatttttgtatttttagtagaaatggggtttctccacatagagaagactggtctcaaactactgacctcaagtgatccacctgcctggggctcccaaagtgctgggattacaggcgtgagccaccatgcctggcctaaagtactattttcaaatagtactttaaggggttggtatgaagattttcaaaagaactatttatgattcttcctaaaagaattaaatgggcaattattttttgctttgagatggagtctcgctctgttgccccggctggagtgcagtggtacaatctcggctaactgcaagctccgctccctgggttcacgccattcttctgcctcagcatcccgagtagctgggactacaggtgcccgccaccacacctggctaatttttttgtgtgtttttagtagagatggggtttcactctgttagccaggatattaaatgggcaattcttttttaatcagtgtatgaaatttgctttggaatttcatttgaatgattattttttattgtgaagaataaatgagataatgtatataaagtacataccatagtagtcagcgaataaattgtagctattactactgttgctgtgaggctcaatctaataacttgtctaaggttcgaacttttgcatcagcccccaaaatcctgtttgtactaaaatatactatctaaaaacattcataatacaaatattccatatatcctctttcatttttaacaaaaatttatggatgatacaatgtaagcaagaacctgaggatacaaaaaagtaagacttggtgcctgtcacctaggagcccacagttggtagagaggacgggcagatataggaaagaagaaattgcttttcctaaattatgcatcccagaaaatagcattctggagtgtggttttgaacagaattctattctgcagatagcaaaacataagttacatgttgatgagattaaatgttcaaatcaaataatgaaatatatttatttagatacatttaatgtcttcttatataagttatcaagttgcattttttctagctgcatttaaatctatgtgcatttccttcctacttctcctgagattgatatgcagccagcatttcagttaccagcgtgaggaataaaccgggagagaggaaagatagtgaagcagctgtcttccattacaacgtgtctaaatggatagttctaccatgatgtttctttcaattccttccgggtttgggtgagaggggtggaaggaatgtttccattggtgaaatggtagctgaactgccaaatggtatgacctgctatcaacactactaaaaagaaaatcagagacatggattattattggccaacatatgtttttttgtgggcatttcctttgtgtttcattttatgaaaaatgataggtatcgcattaaaaaatcaaataatttataataattggaacctcattagtagattttacattttatataccaaaatgttaacaatctatgttttaaaaattaaacctccaaccactaacaaatcagagctaaagaaataatcccattattgaagaaggatcattgtggtagattgagtgccagaattttttttaaaaacagtgctatgtttagtacattttagaaataattccataaaatggtatgttttataagcgtggatttagagataaattatcttgggaaggtaagttaacgaagacaaattctgtttaatatgtaataaccaactctggacaatgaaacctttccatccatgactttactctgtgtggaattttttagtagatacctgaagttacaaaatataaaaacaatcctctctccttggggaagttacagtttaatgtggaataagtaaactccacatttaatgtagaataagtatggtagaaacccaattgacaaaagttaaaacagtttatgcggtgagaattcaactacctagagacttgtggactttctagaatcattgtcttctgtgcctgatctttggttattactgggatacccgtcatttatctctgcccttcttttacaaacctttcaatccgtaaactgggaccagttgttctatttagagattacccatgaggcaccatccaaattgaatactactaagcagcaattacatgatttatagcagagattatttggctatttgcagcacaaggcaaaggagaaggaatataatctccattcacatatacctgtgtgcatatacatggtatatgtgcatcataataaacatcacagttcttctttggaattgtgaaatatcctctgaacttaatagaaatttagtaagcattgggccgggcgtcgtggctcacacctgtaatcccagcactttgggaggccgaggcaggcggatcacctgaggttaggagttcatgactagcctggcaaacatagtgaaaccccatctctactaaaaatacaaaaaattagccgggtgtggtggcaggtgcctataataccagctactcgggaggctgaggcaggagaattgcttgaacccaggagatggaggttgcagtgggctgagattgtgccattgcactccagcctgggtgacagagcgagactccgtctcaaaaaaaaaaaaaaaaagaaaaagaaaaaagaaatgtagtaagtatcgagaggtaagtagtgagtaagagagagataaagagggagagcgaaatgctaatttttttcaaaggaaatataaccaagtcaacatgaaaatcattctgttactatttaattcctatatgtctatcaacccaactagacctataatctctaaggcagtgactgcttcctttcagattcaaattcagcaaacaactgtgttaaatgttattcctgaccttcctcactatgccagaccaaatgctcctccctgtactccaaataacattgcttgatatctctattaattgcactaacagcactgtaaatacatggaaaccctctatgctgcaattctctatttccgtttttgctctctattctgctaaaatgtaagctcctcatactaataacttttctttattcagtgcctggtatgtagaactgagtaatatttatgacattcatcgtgaaagactggccagacacaagaatgacaagaaaagacctgagacatagtgatagatgaaactcgagaatgtattattatttgaacaaacttgattctaatatttaccaaaatgatacagttgaaaagagtcaaaatgtaatccttctatagcatgtggcttagtttaatatccatgttccattatttcttttgtatcctcttgagtatttaataaattttattaatatctgatttaaattttaaagtagataaattaggctttaataaaaacaaatggaaacttttagtaagtggttggacttgttctgaataaaggaatatagaatggaccttatttgaaaagttgaagtttttaaatagtaagaatataggttgaaattttttttttttttttgagatggagtcttgctctgtcacccaggctggagtgcagtggcgtcatcttggctcattgcaacctccgcctcctgggttctagtgattctcctgtctcagcttcctgagtagctaggattacaggtgcgtgccaccacacccagctaatttttgttgttttagtagagatggggtttcaccatgttggccaggatggtcttgatctcttcaccttgtgatccgcccgtcttggctcccaaagtgctgggattacaggcatgagccaccgcgcctggcctataagtagaaatttttgaaaggaataactggtgtggcaagtagagctggcaacattgtgtatattacaaggatggccttcaaaaggcagaggactgttggatacctcactattttaaagagaaattttatttaaaaaagaaatcttatgcatgatctcatttcagtgttgatttactagaagcatatgatggacctacgaacaggacccttcaaatcaaaatgtatcgtttaggaatattctgaaggggaaagtctgtgactgcattctctgagaaccatctgctcacctacttatgtcccttaaaactgaagctttaggatatcctttgaaacctttttgtttcttatcatataatgtatggtaccataaataccattgcatttgatttttgtgtgaaacaacactaaatcactattaaaaaggaaagaatgaggttatcttgctgacaatttaaagaaaagacttcttcataatatatttacgacatctaaaatgccttttgtcctcagggtagcactgtagttcttcggtgcttgagttgatactgcaatttaatactgtacctacaaagaaaattacagtttttaaactgtttattccaagtgctttcaaaatgaagacactactaaagtggtgaaagcatgtggttggaaaaaaaaaagtagtaggagattattaatttcttaaaggtaaagattattgcaaattcaaaagatcccactcattatcaatatgtggtccttctacagttttgcatagtataacatattcttaaaatgggatacatagtgactttgtagcatcaactatttaaattttctagctcctgagtccttttcttgctgtgaaatgtgttcattttattgtgtgatgatattaacatatatcaagaatataagtgaaatattaaatcttgtcatgttcagggttttagggttcttaaaaatgtgtaaaggtgtttttacactgtgtaaaaaaaaactttatatgtttgtgagattttgagttacctaattttataaactaaattactttgtgaaaaaaaaaatgcttagaatcatatgttccatgtagctcaatattgttttctggaattgaattaaattatatctacagttgcttaacagaaagagcacttaatttgtaatccacagacctcgtggtcttaggcaagccatgtaatttacttgtctttcaatttcctcatctgtaaaatggggataataactcaaaggattggtctaaggatcaatgcttatgaataaaaagcacctagtacatgacacatggtgggtgctatatcccagctattattattatccaaatggcttattactgaagtaatgaaagaaagcttttatacagtcatatcaatggtagttctgggttatagtctcagagacatcattactatgaggatatagagaatttaggaaaattttaaaaattatttaaacaaaatttgaaaaacattgtaggcatgtattaccacatacaattatatctgcctacctatgtatttaatcactatcttttagaaaacacacaacaaaagttcagtttgccgtagttcattatagagttaataggagcttggagatttgatctaataacatgcacttcatagtagagcaaacccatgatgttatcagaaattttggagaagtccaggattggggtgtacaggtgtacccaccctgagaaccagtggatctatataagtctggtgtattggtttcagtacaatgatatttatatacaactttgtatcaaataagtttgctaagccctattataagttaaaactatttttaaaccatatttccccaccctggtttggaaattgataaaacagtttaaagctgaaaaacataaactacagtaactcaataaacaatttaaaaataagttgtgtaggtagctggaaaaaattataaatctcaaaagtatagatttaagataaagcccagttatctagaattataaggttatagtacatttttggttgagcacatttagctttttctattcctccattttgcctagctgccatttcttaactatgaaaggaattgaagagtccatcagagcttttgttcgcactaaagaatagtcatttgaagaaaatggtgccaggccagacatgtaaagatatttaaagaaaagaaggaaggtgataggcctaaattcaggactattagcatattcacaatggtacaggtataggctaagcttggtcacaggtgaaaggcagtagtgtgagaactcatggaattaacaaagctacttcacacaaagggacggatggtacttcctccatgtccattcctttctaagatttcagtggcaaacagcgtatgtaaggctgcagtgacaatttgtttcagtggccctaaaaaatacctatatgtaccatagatttaatgtgtaaaattaaaagcaatgtatattaaatattttctaggaatctgtgattttgtgaccaaagatctgaatatacttaaaaacaaatcctaatttttttctaaagaaacatgataaatatctggatagctggctacattttgaaatattcacccaatatttctgcaatagtcagcatttcaataataattttatttgctttttcatggctttgaattgggtattattttgtttctttgttttgttctaagtctatatattttttttcttgccaccatttgctgtgattacagatataggtttagagtttagcctttgcaatatcatcagttgatggcatgtctacagcaatatggtggataatattttttattttcatagtatgagtgctacttgactctgactgaatgattttctgttacaagattttctttagtttatagacctactttaccttggcttctgaatatgctgaaatccttctgcccttggttataacaccttttatttgttaacatttaaaatgctttcaaatctttaacaataataaaggcattagttattttaattaatttgtatggatggaataaaaccaaagggaaggtgtcattttctggttgcaataaaaagatataaaagttaattgcttttcttttcttcctttttttttttttttttgagaggcgtctcgctctgtcgcccaggctggagtgcagtggcacgatctcggctcactgcaagctccaccttctgggttcaccccattctcctgcctcagcctcccgagtagccgggactacaggcgcccgccaccacgccggctaattttttgtatttttagtagagacggggtttcatcatgttagccaggatggtctcgatctcctgacctcgtgatccgcccgcctcggcctcccaaggtgctgggattacaggcgtgagccaccgcgcccggcaattgcttttcttttctaagaaaattttgctgacatccttggtacatattgctattcttaaatgtttgagtttactaatcctcaacagtaaatatctttaaaaatgtataaccttgcttaatattagttacctaagaatgccacaagaaactggcatctttatagttactttatattacagagtgtaataaattctagaaagatgggactaattatggtaacagacattttatactcaataaaaactttccttaatttcacccttatgcagggagtctcagtagagtacctctcttttgtgtcttggttggtatggcatggcactaagtgacattagattagcaactggggaacaactttgtgaaactgtttatggaagtgaattttcagagttcacggttgtgggtttttttcctatctcagatcacctagcaactttagattcaggcggaagttggagtttattttacaaaacatgaaaaagcttttaaaccaacatttttgaggtaaatctgtagcaaaagtgaggccacctgctgttaagaaaagtgcctacacattcatcacatttctgtccccagtagagggtactgctgagtaaaacactgccattgttgttcagatcctataggtggcagcagttcctacagtttcagagcataacaatggctcgatttgtgggtctaagaataaagctgtcacgaactcatggaatctttatactgtaagggctcttctttgaaatgtgatacatgagaaaattaccattaatgtttagtttcccttttaagatttaagtagcttatctttcttttaagttccattttgtatttgaaagtgtgtccccaaacaagtattgacagccgtaattttatggtgttaaattatgaagtataaatttttaggtaatctcagggaaagatatgatgtaaacttttttttcttttcctctcccaccctagccttccaccccaattacaagaatcatccattgttaatgttgactgctgctgcaatcttgagaaggaagtcctagttgctatacaagcataattttctccatgttcaggagctgagtgcttaatggttttaacattgccattcaacttttaggaggctttgaaccaaattgtagcacctatcaaagagtgattttataactctctttaagaaaaaagatttgaaacatactgtagtttctgttaggcgacacagaactgaggatgtaagtactgtactcttagagcaactcaccttttgccactcccaagcagcagagtgcttgttacttcagtgggtcacttgcacacacatacacacaccctccacacatccagaataaactccatattaggtataacaattgtaattcattcagttttaacggtcaagtgaacattaaaaaaattttccctgctaattattgtgtttagttcagagagttgcaaaatgctaaataaaactagttttttggttcaagtcaaaatagagttaagcctatctctagaaatgcctattcagaaattcagcaacccttgtcttattgctcaaattaattatccagaaactgtattatgatcgtttactcaaattaatatgaaaatctgagaattctatctttgttttaaattcaggaaagactagattctttttatttatcatttgagataacaaagtaaactaatggcaatgtatgagtatcttaacgtattttgaagggaataggttaaactgttactcttttggagctgatctctttgtatcaattaggtacatttgtaaactctatatttttgaaccatatttttggaactaatctaaagctgtgaaatgaatacattatttcaaattaaaacatacatatttatatgtattatacatatcatacatagagatgcatatatatatttattgaagataaaggaaatgtaggttttagggttgtagaacatttggatcatataaataggagatacatgcctatactttctatcatccatattatgtgtgtgtgtgtgtgtatgtatatatgaatacatttattcaatagtatgttcagaatgatgtttttcatgaagaattattagtgtcacatatgattccatttcccatttggtggatgtgaaaggaaacagaattatataagcaaaaaagtttgctgggaacctcacatgctcttagtaattattttgtgcattgtcagctactgaaaaaattatttgtttttaaaggaactactaggagcaaagtataaatcaacttatttttgaacacttgtaatattatatgttcatataaaatctatttttgatggcataatgacagtttaattatgtgcatttttttgtccttgctgttgtttttagcatatttataatagctagctgaataggaaaaaatcatcacttaaggcaaggctcttcaggtcatctgtgaacattctgtctatcctttctttaaaaatattttgaacaccaagatatgacaagataaattccatttttatttttgcaattctctttcagaagcttatgttaaaattaatttcagtttatattattttcttatgtaacttatgaacatgtaaggatgatcactttgttctaatttgtaaatttttacaaagtattttagtaaaatgatatatgtccttcagtgaattcatattgctattcaacaaaacattccctaatgataaagttgatatttatgttttgtaagtaaaatcatttcgatgaatgacaaagcttttgatgaatcagatactatcaaagcttggagttgttttcagaaattgaatgtatgctggtttaaaaaataagctaaaatatatttttaggtatcatacatatggggaaaaaatgagatatatagttaagtttgaacagcttagactcatttaaacccgggttttagaaatttcaattccttgtaattaaaaattctgttgatctatttaaaaatgaatatgtatttaactttcccatatttaacaatagtaaactttaatattagtaaaatattacctaaaagatgttcacagaaactgttgacatgtttgaaaggatagaatataattaactcatgcattttgaggggaattttagggcttagagaattgcataatagactgatagggaaagactttcaggagagggagcacagtgactgatatgcctgaatttgagaaagcagcagatacaataaatgtctgattctatgtaacaagtagtaaatggaatttttcactaattgaatttttctgtttaacctagtgtccatgtgtacgtattgtacatatgactagttttgtaagcattagaatataataaacttaatcttaaacatacacccaaaacaattacttccaaaaattcttcaggaggtctattggaatctttagtgtgaatgattatcattgtgagcatctattgctattttagagtcttgcttatggggaaaaataatttgataatgattgagctttctgattacctgggtactacataaataagagtgttaacactaatttctgtacatttaggtaaatatatttacttataaacatttaacgaaaatattattattaaacatagttctattttgagtaaataatttaaaatgctgggaccgttttctctgagtggccttcttcagacttctggaccctagaaatggccttatacttcaccctaggagggccctttttttcacaggcctgaaactctgtagaatccatgttggatattattaatgaacatgtttctttttgtagaggggagaatgatgattagaaaggtaaattagtatcataaacactccagatatttcagcatatgcgtgaaattattctctctcttcatggaatccattgtcttcatgtgcatctagtttcgtgacctacaaaagaggacttctgagccatgggcatgtacaatcaggttctgcttaaagtcaacatttcttataaaggcaccatctgtattacaaagaatcatgatgccaatgctgtggctttgagtgctgtccaatggaatcaacaagtacatatagcatgcatgttgtgggcaagacatgtgcttagcactatataaaaatacactaaaggctcctacaactgacattttcccattcaggcctgactcttcagccctctctactctcttacctgaatagatatgtcaccctcagtcagtgtggggagaataaagctgaatgtgaaatttagctgccttaacatttaaagtcaacttttcatttaactcatttttttcttctgtgctttcagaaaaacaatgatgagatcaaaattagttactcatgaattcaaccacagttattaaactttactatttttgaggtatagggatccaacagtacctgttctgaagttcattttagtctaatggactttattagccttaaagatgttatctagttaatgcaatatattacacataggcagtgtaattgctctcctctgtttagagagtgtatatgagtagtcataaattcttgatggcataacccaaactggtatcctaaatccttgacttctaattttagaccattgtacttctaaagtttgcttgtaatttgagtattaagaaattaaaggacaagaacatatgaaggccatcatgtagctcaaggtctaagggaaaataatgctgtttcagttctcaatataaaacaaaaataattatatgagtaattattcattttgaaaactgatcttcaagtaaaactgggcttaatcaaaaaaggagtaagccctgaagaccttttgcattgtaaaattctagcaaagttgtgattcccgttgattttaaagagtgataggagtggagcttctgaatatcccctgagattttagaagtatatgatactggcagttgtcacaaaaatatatttctagagaagtctgaataattgactctttaaaaattatgttttcttgcaaaatctctaaggaactgaagaagtttctaagaatcacaggcatgctcttaaagcattaccatgagcctttactctgaaatacctcatagtggtacctcataccttctttgcagaaatgagtgcctaagtcctaatggggagaaatgtactccaaaatgatctgaagccattggcagggagacagaagagatactattagcagagcagaaacaaaaataggtggatagagccaatgggttttttttttttggtagaaactgacaaacgattttaacgtttatatgaaaatgtaaagaaccaataatagtcaaaatcatctggaagaaaaggaagaaagttggaagatttacactaccagatatcaaggcttgttataaagctacagtaattaagatagcgtggtattggtgtaaggattgatgaaagtcaaataaaatgataaggagtccaaaaatatacccacatatatgtggaaacttgattttataacataggtagcactgcaaaacaatgaagatggatggtatttttaataaaatattctgattcaactggataacctcatgaaaaaaaatcatggtcctctacctcataccatatacaaatatcaatttcagatttctatttagactataagtctaaatatagagggtaaagcagtaaagcttctaacattaatgcataagaatatcttcatgaccctgagttaggtaaggatatcttaaataggacaaaaaaaaaaaaaccatacagaaaagattgataaattggtctatgttataattaggaatttctgttattgaaggacactatttagaaagtagaaatgtaagttacagagtaggaggcggtatttgaaatgcatataactaaggacttattttcagaatatataacaaattcttacaaatcaacaggaaaaaaaagaacctaatttcacaaatgtgaaaaacatgaacaggcacttcacgaacagtatatccaaatggccgataaacagaaaaagatactaaaccgaaatagtcaccaggtaaatacaaattgaaaccaaaataagataccaacatatttccaacagaatggtgaaaactaagactggcaaaaccaagtattgataataacgttgagcaattgaaactcatatacactactaatggaaaaaccattttggaaaactgcttgacagtgtctgttaaagctgaaagtatatgcatcctgtttcctggcaatttcgttctctggtatagtagaccctacaaaaatgtgtgcaccaaaagacgtatgcaagaatgttcatagtattttttaatagctgaacactggaaataactcaaatgcccatcaacattagaaaagacaaataaattgtggtttattcatataatggaatatttttaaagcaaagaaaatgaatcaactatttccacacacaatatgctgtacaaatctcacaaacataatgttgagcaaaagatgacagactcaaaataatacatacagtcatgcatcacttaacaatggcgatacgttctgagaaatgtgtccttaggcaattttgttgtgcgaacatcatagagtgtacttacacaaacctagatggtatagcctgctgcacacataggctatgtggtatagcctgccgctctgaggctacaaacctctccagcatgttactgtactggatactgtgggcaactgtaacacaatggtaagtatttatgtatctaaacataggaagggtacaataaaaaactgatattataatctgaagggaccaacatatatgtggtccttctcttaccaaaacatccttatgcaacagatgactatactatatgattccatttgtataaagtccaaaggatggcaaaaccaatctgtggtgttagaaatcaggataatgcttacctctggggaagagagaaagggaacaagggaagcttcaggagtgctactaatattccatttcttaaactgggtgatgattatgtgggtgtgttcactttttttatttttattttttgagatggagtctcactctgtcgcccaggcttgagtgcagtggtgcggtctcagcccactgcaacctctgtcccctgggttcaagcaattctcatgcctcagcctcctgagtagctgggattacaggcccgtgccaccacgcctggctaatctttgtatttttttagtagagacggagtttcaccatgttggccaggctggccttgaactcctggcctcaagtgatccacccaccttggcctcccaaagtgctgggattacaggtgtgagccaccgtctctgacctgggtgtgttcactctgtgataattctttcagccatgatcttatttttttacttttctgtatgtacattgtacttcagtaaacaagtttaataaaaaagagaggtaacagaagttgtgttttgtttgttgtttgtttgtttgttttttagcttttccaatacagagcagaggaaaagcagtctggaatgtggataagaagctctggaagctttttctgatttgaaagaggtggttcacgagataaatatttttaacttaggcacaaactcatagtgtgtactgatgttggtcatagaatgcctcaatgttgcaaggttcttcgggctgtggttctttacctacacaggatagtgtttatgaacctgaatgttgttaaaggaactttagtcagagagctgaaagccattgagcatatatgttgctcagcacagataccgcttcttccagaaagccttcccaggcccatcagtttgggccaaatgctttccttctatgttcccacaaatccttggtgtaccccccaagaaaccgtaagcttcctgagtgaagttgtctgtgttgtctgtcctgagagacattgtctgtgttgtttataatttagattccagtgcctaacattgtgcccagtactgaataaaataagtacatgaatgaatgtttgtaagtcagtcgttcataacatgaaatatgcttaactatgtgtttcactattttatagatagatttgatcattttggaacatgtaattcttatcagcactgaatattaggatgaggaatttgggacccttttgtaggcactagccttttgttactgtagttaaattttacgataaactaaaacttgaggataagtggtcaaaataaaaaaaagtttatgttaaagtagaaacttaaaaaggcctggtattcactgttagaacaaactacttttctcagagtaacattgtgctcatctttaagttactttataaaaatgtgaaatcagcttttttttttctgataacatagagcttagtgatattttgaagttgctcttaaatcatctacagcttaaaaagaactttctagcaaagtcattataggtaatgatttctcaaatgttttgagtttttagtatttgtttattatataaagttgaaatatgtactatcatgataattataatcaaatagagaggtcagacttgaattttatatttctaccactgacatgctttctgtcaaattaacaggttttttttaaataaagttttgacattggattcataaggactgatgtctgtatcatactacaaatataaactgtttaatttaatgacaatgcctaaaccaggtaaccggagtgaagacaaatgaaattcttccttttgtactggtcattgtgtgaaggcaatcatagacacaacctgtgtcctgggatgagatatgtgaaatggatgcaagtcctcaaatgttatcattttatgcattcaaatggatagtcagaagacccataaggcccctaatttagaaattcccacagttctcaataaagtggctttccactagtttgagttgtcaccttttccaaagacttgacaccacatcttcctcaatgaagtaattctgcttcaagcaggtagattttcatattcatggcctacaggccagatttcaaatgctctttagtattttctttatgtcatagcacacttggcttttgggtagtttctgcctcattttcatactagctttgtaaagatttctgtagtatgtaagagaactctaaaattgaggcttatgtaattaaatgagatatagtttagacttatgaaagaacggcatgaagtatgtgtctcataccaatatcaatgacattaaagtctccatatgtatcaagttatctatctttagggatatgaaatgtgtaagtttgccagtatataattcagtaatatttgagtgtgttggccgggcgcggtggctcacacctgtaatcccagccttttgggaggccaaggcgggtggatcacctgaggtcaggagttcgagacaccagcctgaccaacatggtgaaaccccatctctactaaaaatacaaaaaaaattagctgagtgtggtggcgcatgcctgtaatcccagctatttgggaggctgaggcaggagaatcgcttgaacccaggaggcagaggttgtggtaagccaagattgtgccattgcactccagcctgagtaacaagagcaaaactctgtcttttaaaaaaaatttgagtatgttattaataacttatttgtatacagaaattagccaggcatggtggtgtgcacctgtgatcccagctacacaggaggctgaggtgggaggatcacttgagcccaggaagtgaaggttgcagtgagccatgattgctccactgcactccagcctgggtgacaagcgagatcctctctcaaatcaaacaaaaaaaaaactcaccccaaaaaacccaaacttatttgtaaagtgatgttcagttgcattgttatgaaatatggagtcatactttttttaagcacaaggatacttattaaaaattagaaaagccttagggtatttgtgtgtgtgtgtgtgtgtgtgtgtgtgtgtgtgttttaagaaatggagtccctttccattgcccagactggagtacagtggcacagtcatagctcactgcagccttgaactcgtgggctcaagggatcctcctgtccccccgtcctgaggagctgggactgcaggtatataccactatgcctggctaagttttaaacattgttttagaaatggagtctagccatgttgtccaggctggtttcaaacttctggtctcaggcaatcctcctcctgcctcagcctcccaaagttctgggattacaggcatgacccaccaacgctggacttttaatttttgacgtttttaaaattcttcctctagtctaatggttttcatatttatttgttcatggaatactattttttttttttttttttttgagatggagtcttgctctgtcgcccaggctggagtgcaatggcgcaatcttggctcactgcaatctctgcctcccaggttcaagcaattctcctgcctaagcctcttgagtatttgggattacaggcacccgccagcatgcccagctaatttttgtatttttagtaaagacggggtttcaccatgttggtcaggctggtctcgaactcctgaactcagatgatccacctgccttggcctcccaaagtgccgggattacatgtgtgagccactgcgcctggccggaatactttttatattctgatgtcgtggaagaactccaaaatgaagtaatgaggtataatagtatattgcaatacttggattacaattgacaggaaaataaaaccttgcaaactaattgccgtgagaagtagcaattgtgattcttatgctttgaaaactttaacagaatggaaaaaataatggtaacatattagaaaaattggattattgtaaaaagaacaagaaaaacctaatttaaaatgaaattaaaaaaacactttcaatgagaacagtgtttttatgtcttatccatacccatctaatataaggagaactacttattgggttccatgttcactatttgggtgaaaggttcacttgaagcccaaacctcagtattatgcaatatacccatgtaataaacctgcacatgtacttgctgaatctaatgtatatattagattaatacacacacacgcacactcacacacacacacaaatatatgggcaatgtttcactgttggatctgcataccagatgcaacatccagttatagtattatatatatttttaatgcagacagatgcaaaaatccttttccacacagatatgttagaaataaaaggaaaaatatatagacttttacaatagttaggtactcttgaatcagaccattccaaagtgtttaattatataattttcaataatagctcatttgtcatctttctttttcttgtctttttctttctttctttctttctttttgagatggagttttgctctcgttgcccagactggagtgcaatggcgcgatcttggctcaccacaacctccgcctcccgggttcaagtgattctcctgcctcagcctcctgagtagctgggattacaggcatgcgccaccacactcggctaattttgtatttttagtagagatggggtttcaccatgttggtcaggctggtctcgaactcccgacctcaggtgatccacctgcctcggcctcccaaagtgctgggattacaggcatgagccactgcacccagccttatcgtttttctagaaactaaaatctccacatatttatcttcattttgaagtattctggatttcaagtactcatgtacttgaaagttatatgtattataacttatgttgtgagagcagtattttactagatgaacagtatgtatttctctccattccagcctaataattcaataagatctaaattcagctttactattttctttataaagtgcttaaaattgaacaaacaggaggagaaaaaggaagagaagaaaacagcaatgaagtcatttaggaatgataagcaaatgtggccaggtgaggtggctcacacctgtaattacaacactttgggagtccgaggtgggtgaatcagttgagctcaagaatttgacaccagcttgggcaaaatgatgaaaccttgtctctacaaaaaatacaaaaaaaattagctgggcatggtggcatgcctgtagtctcagctacttgggaggcggaggtgggaggatggctcaagcccaggagacagaggttgcagtgagctgagagcacgccactgcactccagcctgagcagtagagccagaccttgtctcaaaaaaaaaaaaaaaaaaaaggtaaatgcagagtattccagagattgtgacaaactcttagctatttctatgtttttgagatttccagcaaggttgtgccaatggctggaggggatagaagaggtggtccattctagggcaatgaagtgagttagataatttttcaaaaaaaataataaaattgaaagttgttctgcttttaattatcatatgtgcctaaaatttttttaaatgccagtggtaaaatacctctccctatccttattcatgtagaccactcctaccatgccgtaccttttggtacaccattggcttccaggatatttaaaaactgaagaaaataccgaaaacagggttacaaaaattttggaatattttaaatgtgttaatttaataaagtaactctttgtacaaaggcaatttaattgagctattcataggatagttgtataatatagaaatatgtaacttacactgcactatgataaatgcctgactttcggccctgtcaggttatcacttgtgactatacatctgacctttttttgattttctttatggctatgagggcagaccatacacttttcttgttgctgttcttttacctattgcacccccttaaccagaatgggccctttttaattggtaactaattgccttaaaggtatgttgagaatatagcattctttgaaggtatcaacaaatttataagaaaagtttgtagagcatgaaattcaggaaatgttttctttctttcttttttaatcaattaagtaattagatttagttctactaatattactgatttaccttaaatcgtgaatccagctgatgaactttttgaaatgtgaagcactggttaggaatttgagaactgcagatgtgagactcatctagatcttagttatgattttattgttcacttcatttgaaggacagagaaaaaaaggcaggggttgaacataaatctcagagactgtatgaggattaatgaaattatgtcccttataaaacatttgagttttttttttggtagaatgccagtatgtgagaataaaggaggatattcaccagtgtcttctaacatttaaaatgttaggagaagcagatcatatttgaaaatgaaatttagtctgtggttaatagtttatttcctcttaaaattgttatcaacttccataaatgtaaattatatatttttattttcatattttttgatagtcaatacttgtttccaacatggacaatattaaactgtaaagtttctgaagtactccaggtttctcaaatactcttatttccaggtaagaataaaaaatgtaaaaaatattttaaaagttaaaaaaataatattgcaagtaagcaatgtaggtaaggtgttttgcatctgagagtgcgtttgcccaacttaactaatagggcaaaagcactattgtgatgacatctttgacgaatctttcttggacccaatatcaccgatgatgttggtttgtgggttgggccttcttcactgcttggtttatctttggtgtcaatcagtggtaatgatacaatccatgacaaaatattttttgttgaatatttatcatcactcaaaataggacacagttctttctaaagataaaggctttctcctaaggcatttgttcctactttaaggatttactgtagcagaatatgcttcttggattttatttattagagctaagttatctgatctttgggggacatattgtatcttttttttttttttctttttttgagacacagtcttgccctgtcgcccaggctagagtgcaatggcatgatcttagctcactgcaacctccacctcctgggttcaagcgattctcctgcctcagcctcctgagtagctgggattacaggcatgtaccaccatgcccagctaatttttgtaatttttttagcagagacggggtttcaccatgctggccaggctggtctcgagctcctgacctcgtgatccacccacctcaggcttccaaagtgctgggattacaggcatgagccactgcacctggccttaatattttgctctattaagcactggtcaacaggaaaaaaacatgaatttactttgaatcctaaaaaagttatgactttagaactaaagtcacctgtgccaggtacctgaggcctcagaaacaaatatctgcctatatactgtatatttgaaaacaaagtagcaaaactttttgtttttaagttttagttctggacttctactcctgcagcccgttagaaatcattctgtctttctctgtctctctcaagtctaaacaaccccagaggatgtactgttgtttttatttgttttataaagtgctaatcaaactattgatggtttaaaaaattatttgataataatgattttgctttttgtttttattcttcttcatgagatgtgtttttcccagggcaagttgataaagacatttttgaccacctgatttttgcctgttgccattgacttttcctttttgaagtgtgactaaactttgagagctccttctttggtaatttatagaagaaaaagccttggaaaaaatatttgtacttgattttaaggggtaacaaaatttctttgttgtttgttttttggaattgtgttaaagaaaattacgaaattgtaatgactaagtgcatatttttgaagggttttactttgtttatttccttcatcaaaaaaataagcaaaccagtaactgttaaccctaatttatttttactcttcaagtgacattacttttaactggctacatttggataataaaagccatggattttaaaccacttagtaatttggtttcatttttaacacaaataacaccttttcatccattttatataaacttcaaacaacatatgttttaacttactgccaaataagaagaaatgtgttacattaaagtgcatgttgtttgcctgtgcatttggaaataccattcattttatagcaattttgagttatttttctgtcactttgtattcctattcaaagagacatacagaaaccctcgctcaaaacaactcccttagggtttactcttggatgtcagtagacatgaacgggaggtactgtatacaacaagcttaggtgatggaaatgtcaactcttgttgacttgcatttattattatcctttgaattgtgtcctcttgagattttgtgagtggtattttaatatatttcttttatgtttgaggtgggcaaaagagagagaccacctcactttttttcccccctcttccctctgtttacgtacaaaaatgagatactctcattctctagaatttgatccaaattttaaaactgttgctaagggataatggtcatgcagaatgtgaaatgttaataacataaaacactaggacataaaaatggaaacattttcagtgctaacatgcaattcaaagtgttggattgtttttaaattaatgagaaagtatttttaaagccctttttctttaggatcttaaattgtaccaagagaacatggattcttttaaagaacacaggttagagttagttaaaacctaccaattagtataggaaagagagactccattatgacagataaggtttagatagaattattattagtaaattagaaaatttaaaaacatccccaggaagctttctctgacctctcacctcctgcccttgttgggttaggtgcctgccactctgtgaagctcaagtaatcagagcactgtgcttagcacatcctcactagtctgtgagctctttcaaggcaggtactgtatcttatttggcttagttttttcatccatctcacacagtagttgctcaggaagtatctgttgaatgaacgtgagatgtagagtgatgatggatagaccctaattatgtccacatccatgtaataaaataagcagtatatttaggtttgagaataatctcactacttttttaaagaaataaatgcctctgcaatctttctaaaaataattgatttttatttttagccaggttcttgctctgtcacccaggctagaatggtagtagtgtgatcataggtcactgcagccttgaactcctaagcttaagcaatcctcctgcctacgcctcctgagtagcctggactacaggtgcatgccacctgcccagctaattttttaaatttttttggtagcggtcaggatcttgctatggtgcccaggctggtcttgaactcctggcctcaagcaatcctcctgccttggtctaccaaagtgctggaattaaagatgtgagccaccgtgcacagccaagaattgatatttattttgaggactgactagaagttttaaaattaaaaagaaaattcattgcagttttgtaatatgtgaaaaaaatcatgaaaatatattgttaaaaatgtcatcacaattctggtaatctaactttgggtttctaaaagcttttgtagtgttaatgttaatactgccctttattgtaggccaaggatgtcaattggaagcaattcttactactggttgttggcaagttgcatgagcaaggcagatttggacccagcctgaaatctctagtcagctccattctttagcagctgtcacagtgtagttccagcagtggtgtgtacctttcttgttccacattatgagcccacaaagaaagccaccagtgaacaggaccagctaaaagttttattctccttctattgggttgcttttgagtagatccaatttcatttttattagtgattcagtttcttccacgtataatcacatgtctttggcagaatctcttactttcttatgaatacctagtaactcaaagtaaagaacagtgaataatccttaaatacagagtatttagtttttttccctcctgcattcagagtaaggccatggttgcactaggccatacccaagttaataatttgtaaaatgccaaagcatttgaagcttttcagatttctattgtaaaagtcctcagtacaattttacactgtcctttatattgaccaatctaaagatttgactattaatttaaccagcattattgtacttttcctctggaataaatcagggctttttaaatgaattgatcccttactgtcttataacaataaagcatattcagcgtcatatttttccgatactattgcacaatattgtcaatacttgaatagaagaacagctgttgtctagggagtgaaggttaaaggtaaacactccctactgattcaaagaaacacgggcaccctatttattatgtatttgtaagtagagctctgcagagtattgccacatttaatgtatatttcatagagtaacaaaagcattttccacttttgactaatacagtttttagagcccatccttgtaggtgacttgtacgtatgccttacaggcacacaataaatattagctgatgatgagagatgaatatccttgcttttcacttctgaacatgagataaccaagccttttaggtagagttaattaatatctggtggtcttctacgttcctaagggaatatgactttgaattctctctcttcatcatagataaatgtgtagtcacaaatgtggtgttccagttttgggcttgggaaatgaagtttaaatgaataatggtaatccatggtaatagaaatgcttagttctactgggtatttaagtctaatatgtaggcatctggggactctgatacactgatttacttgtaggtaaaaacgtttagagctgctggcagtgttttttgttgggatcatttgttgcatttttagtgtaacagtggacttagaagttaaatgtcaacctttggccgaaataatctgctagtcaaagaccttggacatttaggggtttttaaattggaagtggaagggtatcctcatttattattcatagctacagtatgttagttattattcttttgttaaaaatgtgacaaaattaaaggcaaatgtagttttaaaggctccagagtaaattagaaaactgatttcgtacatctgcaaaaattttattagctgattattttacctcaattaatattgggaatgttgacagataactacacatcgctgtttcacaagaaatattttgtgtatgtttattctttatgatcagaaaaataaatagtgtagattggacagtgttcatttttcataaatggaaaagaacattgttcttttactagccagagttggaagaaagtacttgggataagaaataaaaatgaatgtgtacatttcagtatgtgtagtggaatggattcaggaaattcattctttcatattaatttttctaaacattttttatgtagggataacagataagagagagtaaaaaaaatcccatttagtaaaaaaacaaacatatttgtatagatgtagtaaagatacacctgaaagttacataccaaattattaactgttcttttgggggaataaacctctaaccagggaccttttctttttaagaatttttatacctccatattatttgattttattttgaggagcatgtattatacctgtaatttaaaaaaattaagcaggcaaagagagagagagagagagagagagagagagagagggatagtatatgaagggctataggcagccccagaagagcaagaaaggcaaagaccaagcaggcatcagagctggatcctgacatagcaagcaattcagacacctgccgggcatcggggcagggtgaagtcttcttaccagaagagaaatctggagcagggaagttgggggacctgtgtggggtagggagtaggtttgtaaattggaatgttgtggtagagtaagactggaaaggttaggtcattcattatggagatagtctgaaataaagacatcagggatcatggagtgtagttaggatataagcattttgtacaagagtttgatgcttgtttcctttatatttttaccctgtggagcccttgggagttcaagtatgtgtctattgagagagatccatcatagcacctttatttatttattattactatttattagaaaatgagcaatgcttaacctctctagatagctttaatacagtgacatgacttcatgttgtggagttggacaggttatatgaacatgcagaaatgtagctattcagtttctcagttttggtgatgacccatgtcaaataatttttaaattgtctaatatgagattaggctcttacactgagaaattaaagtaaaacaagctatttattaacagagtaggtggactaatcctttgctagagtaaatatgaggagctacatcaacacacatatacattctctacgtaaggttaagatgtatgtagctaaatatattcattagtattacttaggagatgctctttcttttgtcatgtttctttggcaaaagctagcagttctgttagcagtggttttgatgataaaatcctgtaattcaagaggttggcttattcaactaaacaactgctaccttgggcaatactggaccaactgcgaggggactgttttcttgagacctggaaagctgttctgtttgctaaacaaaggaattgttgatttcagtgatttaattccccttttggctaaaggctgctgaatgaaaacagtgcttgtttgggaaggaatctgttgctaaggcaactgatatctccttaattattggccaatattcccaaatgagattggtctcttttgactgttggaaataaccaaattatcctgagcactttcaagtcttgaattttgtggtaatggcgggggttgggggagggatttctctcaagtatataaacagatatctcccatttgggttggcatagtgtgagcactgtgtttatgagggtaaaaatatagatgatatttgcaaaacctcttttattgtaagagatcttattacttaagacgagttgcaattctgagatgagtgacctatgtttaatctttttttaaaaaatgaattatttgatttctgtaagaaaatagaatacatctaatcatttatcctcaagaataggcagatatatggagaaacttgtaagtattatttgaatgatgctaacaaggactgtcttcagaagcgtctgcagccatttatgtgaggttctttacttgaatgtttctagcactgcatatgctgaccttggagagtgacctcttttctgtctattactttgtaggatcatgtaaaagacctgtggtttcttgtctcttggcagtacagttgtttgatcatttaaaattaattgaagctttgaatatagtcaggctcaagttctagtgtattcatatcatactttgtaattgctctctagtgtgaaggacatactaaaacatcagtacagttcttacaaaatgggaatttgtctttataattttattgtatgtcttttaaattcttatagtgaatcatagagatcacacattattatcttatatccttacaacaaaacgggaattcactgttctttggtacttgtcctgtgacaagcctggtgagtattgatgaaattcttctaatattacttggggtatcccagatcttccagttgagtgaacatgaggttctgaagtgtgactgtttatgatttctgtgttgtagaaccatgaaaattttgtaggagtctcacatgaaaggcttttggcacaatagcactgagtaaaatctgttttgtgatacttctgaatggttatagttcttacttaggagtagtctttccatgtttcattcatagagatgacattgggtttataccttgggttgaattgaatataaaaagctttgtgtactatgtattggaagaatacttgagttggatttcatgtacatatttattatctatcctagatttatgaaatttcactcttcattttaaatagcttcaagaagtaaatacaagattcacttgatgaaaatattaaaatacatgaaaaggacaatatcctgcgaaactgttgactaaaatataagcacagaaccacagaatataagttcaaagctgtccctacatgtctctagagtatcattaatctagttctcactagggttttagagtatctaagtaggttttacactatctactgaagttcttccatatcagactataaatataagcatacagttaaatctgtgatacattttgaattagcctccctttttaggactcttttgagcttgtcttatttaaaatatgttgaagtatgaactatcagacttcaaaaacattgttctttgaaaaacatttttgtgctgtatttttaaattccttgatatttataattatttaaaagatttttgttgtagtcatctagtttataagattaattttttcctggattattgtaggaaaaaaacaagtttttaaataagataatgtaaagagaatttatatatttatgttgattagatcataaaaatttgacccaagttattatatatgttaaattctatgaatttattactttgttttgtcacatattagttgactcaattttccaacatttccagcattttgcccttttctcagatacttttttttttttttttctggagtcttgctctgttgcccaggctggagtgcagtggcacaatctcagctcactgtaacctttgcctcctggattcaaacgattctcctgcctcagcctcctgagtagctgggattataggcacgcaccatcacacccagctaatttttgtatttttagtagagatggggtttcaccatgttgaccagactggtcttgaactcctgacctcaaatgatcctcccactttggcctcccaaattgctgtgattacaggcatgagtcatcatgcccagcctcagattagttgaagatcaaagatatagagagaatattttgttagcaatttcttagctttttttttaaccttatatattttggtttttttttttcctggagacttgtacttagtactaacttcagtttgcataatatatatttatatattcaatgtgaatattttatatacatacctatgacaaatcttaatttttatatacaaatatatggcagtgttctttttctttctgcaatggtaggttttttcttcaattcaagactaattcagtattttatttacctttatttataaccacgtgtggtatctttcttttgagaaagcattgacactctattgctattaaacactttcactgggtgagatagaactgttgttgactgtacattatgtgtgtgccagagaatataaaggaacaatggagaaatgtcccatcacaattttgaaagggtctattttaaatgctacgtgtttctactagaatatagagctgtaatttggaacaggagtgaagaaagagacttgtagaatttaagttgcctatctcctatctcctaactcattgggaggctgggtcttcattgtgaagtctctcatgtatacctgttaaatgaatttgtatgccttttgtcctattaaaaaattaattaataaagggctcggacaaattgaaacactgggtctactcaggaaatatttttataggtgcagttcgaatgtttgaattaggatgtaacattagaaaacgtaaaggagctgggcatggtggctcgtgcttgtagtcccagcaggaggctgaggcaggagtttcgcttgagcccaggagttggagttgaaggttgcagtgagctataattacatcactgcattccaacctgggcaatagagtagcggggtgggttggaggcgaaacaagaataaaatgatacaacaaaaacaaaaaagcaaaacaacaaaaagagaaaatgtaaaggctatgtaaggcttgcctcaggcaaaaattatcaaataggccaggcgcagtgcctcacacatgtaatgtcagcctggccaacatggtgaaacttgtctctacaaaaaatacaaaatattagctggatatggtggcaggtacctgtaatcccaactactcaggaggctgaggcaggagaattgcttgaacccaggaggcagaggttgcggtgagccaagatcgcaccactacactccagcctggacaacagagttgaaactctgtctttaaaaaaaaaaaattaccgaataaatatacatttatctttggtgtttcccaacttagatttgaattgttgtatctctcccctaaaccctgccctgtgctcttgtgtgccctgtgactgattagtatccttgtctctgtcactccaggtctgctctctttttcttttccctttctgcacttcaagccttccttacctcccatgcccttgtacccttttaactttctttaaaaatggccagtgctttatttcagtttcactgtgtccattctctagaaattaatctgatgcactaatcaccattaaattgataatgcttgataatgtcttgccttgatctggtttgccatcttaattagaattttaacttagctttttagaggagaacatttcaagacataccaccttgattgttgaacttgggttaggtaatatttcaaggtggttcataaaggtatttattttaaaggaaaaagaacactgagagcccagcatgcatatccaccttcaagatttaataatttgagatttcaactgtcccttaaggaaagctgattttagaagagagaaggtaaaactattcaataattattatccataataaaatatattatagttcctttttcttagccaattaaaggaaaatactatgtattaataggatatgtaatttgggggtatagaaaacatttttttaactcatctaattatttttagtttttgtgatgatgactactgatttgtcctgtgctacatataattctttgtcacagttttattagcatatattatagccaagtgcttgcttggctatgaagagggcatttttattctgttccatgttatttttcttaccaaaaaatgcaacaaaaaactaaagtctattcaaaaaaagcttatttcattatttaaaaaaattctttcccatattccatatttcttttgttagtgtaataaccaatttttttttccagaaatttaacctctcccctgcttgtgtcattcaggtttggcccaaaagcaaacaatggaagtacttctgacctacctttgttagaaactttgcatatctaaatcattgcttgcaagagtgtgagggaaagtaagagtaaagaggatagaatataagagattgctctgtcctaagatattgatggtctattgggaaatcagataaccacatatgacacactctatcagcaagccagattacttttaagttctaagatatgtgaaaaagttaatagtatcagtcttcagagagaaaagagaaattacagcaggcttgagatgtcatagaagttttagactaaactttggtgataaaagggaagaggacctttgagatgaaaattttcaaatattcctatcagaattctcagcccagagatgatacatgcagcaaactgagaaaaagaggaaaaaagaatcgcttctaggcttcttcatttgtccacgtgaagtctgtccaaacccagtgtgacagagttgtagtttcaagcacgctgttcttagatcttagactgctgtgacaaaataccttagactggttggcttaaacaacagaaatctatttctcacacttctggaggctaggaaatctaagatcaaggtgcctccagattctgttcttgctgagttcgtctcctggcttgtcctagaagggctgtcttatccttatgttcttacatggcttttccttgatgaatttacttgtggagagaggtagagaaagaggaaaagagagaggggaagagcgggtggggagagagagagagagagagagagaaaacgaaacgggaagggggagagagagttgtctctttttgtaagggcccagatgctgttatgaaggccccatcttcatgacctcatctaagccttattacttcccaaaggccctatcttcaaataccatcacattagggattagggtttcaacatattaattttgagggacacaaacattcagaccataacacaacccagaactcatctgtgttatggtgagtcccacccttgccttaattccctatcttcccccagaatcctagaagataagacacactgctcaaatgacttaggacttagtttagggcactccctttagggtcatatgttgtattagttcagatttcaagtatttatagatatttttgaatttatgtttaattctttattcaaaatgagctttttgagagctcataattggcttaccttatgattccataaaagtgaatatttggctttagacaagtgtaatttgtttatttaacaaccatttaatggatgcctatgatgtgcttctttctgatttttggcctaggggtttgttcaatttcctatgcctcttacaagggcagaattgaggtggggccttttagtttttctgcgtccttgccagcctttggtgttgctgttatttttattttagccattttaatagatgtatggtgatatctcattatggctttaatttgcatttccttaatggctgatgttgtcaaagatctcttaatgtgcttattttccatctgtatatccttttttgtgaaatacctgttcagtgtcttgcccattgtgttagtctggttttttgttgctatgaaggaatatctgaagctgggtaatttgtaaagaaaagaggtttatttggctcatggttctacagcttgtacaagaagcatggcaccagcatctgcttctggtgatggcctccagctgcttccactcatggcagaaggcaaaggggagccagtgtgcacagaggtcatgtggtgaggggtgggaggagagatgccaggctctttttcacaactagctctcactgaatctaatagaccaagaactcacttattactgcaaggatgataccaagccatttgtgaatgatcccatccctgtgaaccaaacacctcacgttaggccccacctccaacactggggatcagatttcaacatgagatttggaggggtcaaacaaaccatattgaaactagagcacccactttctaattgtttttttttaataattgagttttgagaatttgtaaatatattctacatgctactctttgttggatatgcagtagtttgcaaatgttttctctcagtctgcagctactcttttcatctgcttaatagggtcttttgctgagcaaaggcttttagttttgatgaagtccaatttatttttctttgtgggttgtgcttttggcatcaattctaagaactagttttgtagctctaggtcctgaaaacttttcttctgtttttatctgaaagttttatagtcttatgttttacattaagtctgtggtccagtttgagttaattttttgtataaggtgggagtttttggtgaagattcacttttttgctgatgtccagttgctctattctttatcataaaggtcttcatcctcatcatcttaccattgaataggctgaggtgaaggaggcggaaaaggaggagtttgtcttgctgtcagaggcggaagaaaatccatgtgtaagtggacccgtgcagttcaaatccgtgttgtccaagagtcaactgtgcttcctttataaaatgtcagcttgttcctgttacattaaggagaaacaaggagtttatttactttatttatttatttatttatttatttatttatttatttatttgagacagagtctggctctgttgcccaggctgaagtgcagtggcgcgatcttggcttactgcaacctcctcctctcgggttcaagcatcctcccagctcagcctcccaagtagctgtgcatcaccatgcctggctaatttttgtatttttttatagagacaggatttcaccatgttgctcaggctggtctcgaactcctgggctcaagcagttcattccaccgtggcctcccaaagtgctagcattacaggcatgagccaccgcatcctgtgaaactaaaagtttaaatctgtgcttttttcaaggaaagaaggagcaaatggtaaatgttcctaagctaagtggtaggggtataaaagtgagaaaatgaaataaggaaagttgaaattcaaggagaatgagttgaagactacttgtatacctcatctcttctacacaatatatttatttctattggagaatttttctcatgccttaaggattttgtaaataaagggatgattctcttccttgcatgtgagacagttttcagcgattttcatttaaatatgtgagttatttttcatatttctttctgattatactgttttaaacatctggggataatagtggttggttttagtcaatatctgtataatttattctttgtttatattttgggatagatattatgttaaaatcctagttatgttctggtcggacagaaataaacgccatttctcaatgtagggggactctatgaatacagatactggtaaacccagatttttagtgctaataatgaataacaacatgagacatttcacatagtataaatatagttcaagaaatccatctccttataccaaattggatttctgtaataagtgtgctttactgactaattttctttcaaaattaactctgtttaaaccgttcttgctttttgtcatatttcaaaatgtgttagctaatattactttaaataatcaaggtatcatttttatcttgcaaatttatgctgatcaaaaaatcttcaaatctgaaatgtttataaaaatgactatgtgacggaatggcaaacatactctttaaaacgttttaattcgaaaagctcacaaggcatttagaaaggtagtgcctacaagaaaattcttatcttcaatattatttacctgttcattttggaattcataaaatttgtgcaatctttttttttttgaatatgtgtgtccttatcagaaaggaatagaaaaattgaaggcagtttggagctgaatagaagttattaatgagcttaactttgactgaaatgacagattaatggctaaattttcttctatagcaagtctgttagaacttctaccttgcttcagtaaattctttttgtcattacaaattggaggcaaaaggcaaagtaggtttaatttcaattttgaaactcagaccttaaatctttaatgaccttcactcagaaccaggattggttgtacttctttggagcacttataaaaaaaaccttatggatagtgtgcatcatggaacacatcacattttctcctttttattgactgcaaaaaagcactgaaccaaattcatggtggcctacttctaattggtgtactgtaccatgtagtatgccttttttgtaatgaccctgatttcatctcatttttttcttgtctattttctgtttgcagtgatctcctcatcattttagaagtcctgttgtgataatagtaaaagtaataattattcatatttatttagttctgtttataagcactctacatgtttcattaagtttaatgtttaacatcgctttgtgatagttactctcattatccccattttactgatgaagtagagtagtgctactcaaagcactagactgagaggagtttagcagcttgtaccagaattaaatcaacttactgcttccttcatcaagaaagtcatgctgtgaaaaaagtgtcagccgaactaaacaatgtgcttaatgatctgcattctgatgcaagaaacttacctcggcacaaactggcaacagacacttcattgtcagcctggacatcaaactttgagtagcactgttccagaacagtgtttctcaaactatctgtggtgaaggacttttatgcatgtgtttaaatgtttagcacttatgggctgagactttgataaagtaaaaacgttgtggtaatgtgaaaagtttctaagtactttaatgtaatgaccttgtcttgaacaagtaacagtgactttaaggactggcataggtagaccctgttttgagtagcactggtatagagtgaattagtgtatcaattgtgattgattctagatcctagggagaatcacagtgccttattcagcatcaacacatgagagttgcctaatttgcgtaaatgtaaacctatagccacattggtgggaaatagcagagcaaatatctaggtattaatcctgtggcatcagcaccttaggtttatctggtttgcatatagccagtcacagcaagggagtgagtaggcagtatacctataggtatagaaccagttacaggaagggagttccccactacagtgtttaaaaattccgagctttcatgcacaatgaaagcatgtttctttccttccctcacactcaaaggttgtgaacatcctacaagagaccattgtagacatccacctagaggttccagtactgtggctaaacgtttaccttatctcaaaggaatacgtatgtgtatatgtaggatgtgtagtaaaaggaaagtttggcctggatagattgaataactttctatgggattttttttcctttaggtaaataatcctatgataaatataagtaatctggttaggatatccttatcaatttctataatattatgttaaaggcagtggaaaaatatgatgtaacttgtatgtcttaaattgtatgtctcagctgggtgtggtggctcacgcctgtaatcccagcactccgggaggccaaggcaggtggatcacctgaggtcatgagttcgagaccagcctgaccaatatggtgaaaccctgtctctactaaaaatacaaaaattagccgggtgtggtggcatgtgcctgtagtcccagctactcgggaggctgagacaggagaattgcttgaacctgggaggtggaggttgcagtgagccgagatcatgccactacactccaggctggatgacagacccagaccccatgtcaaaaaaaaaaaaattatatgtcttaaattcctgtagctttaatgtgagaacactgaagcacagaaaggtgacaagagctaatgagggactgagccagggtttcagctcagccaggatttgagctcagggaactgtctccaatagcctaattatttttctttgtttttaacttttagttattttagactattacaaaaaaaaagttttttgtttttgttttttgttttgttttgttttgagtcagggtctctctttgtcacccaggctggagtgcagtcatcttggctcactgcaacctccacctcctggactcaagtgatcttcccacctcagccttctaagtagctgggactacaagcacatgccaccatgcctggccaattttttgtgttttttgtagagatggggtttcaccatgttgcccaggctggtcttgatctcttgagctcaagcaatcttcccacctcggcctcctgaataaaagttttaaaataagtataattcctgctgtggtttgagtatgtcaccagaattcatgtgttggaaatatggtccctggtatggcagtgttgggaggtggggccttaaggtggttaagagggattaatgctgctcttgcaggactcggtaattctcatgggagtgagttgtcactattgtagaactgaattggtaccatgagagcaagttgttataaagtgaggctaccctttgtgttttgctcacttcctttttgacttctgtgctatgttacaacgtgggacaagactttcaccagaaaccaaccagttgtggctgcccaatcttgggcttcccggtctccagaactgtgaatcagaataaaccttttttctttgtaaattacccaggctcaggtattctgttatagcaataaaaaatggactatgacagttctcaaatacttttcccctggcttccctgaatgttaacatcttacattaccatagaataattattgaaatctcaaaattgacattgatactgttaactgctctacagagcttattcaaatttcaccagaattttagtttttctattaatatcctttttctggtccatgatccaatccaagagcacatactgcatttagctgtcattttattttagtctctttaaatctgtggtaattccttagtctttctctgtctttcacggccttgatactttaaagagtactagtcaattattttgtagaatgtctgttaatttgagttcatctgatgtcttctcatgattacattgagattttaaagtttaaactagaatattacagaagtgatgtgctccttctcagtgaatcatactggggctacatgattctaacatgactcaattactggtaatgttcaccttgatcacttggctgaagtggtggatcctaggatcctccattacaacactactattttcccctttgtaattaatattaataaatatcttgttgagacatactttgagactatacaaatatcccatttctcattatactttccctctcagattttacattccactgattccatcgcctacattctttttaaaaaacttcatttcaatagttttcggggtacagatggtttttggtcacatggataagttctttagtggtgatttctgagattttagtgcacccatcacctgaacggtatacactgtacccagtatgtagtcttttatccctcacctccctgtcaaccttcctcctcgagtccccaaagtccattatatcactttttttttttgaggtggagtcttgctgtgttgcccaggctggagtttcgtggcatgatcttggctcactgcatgctccacctcttgggttcaagtgattctcctgcctcagcctcccaagtagctgggattacaggaatgtgccactgtgctcagctcatttttgtatttttagtagagacggggtttcaccatattggccaggttggtcttgggctcctcacctcaagtgatctgcccgcctcagcctcccaaagtgctgggattacaggcgtgagccactgtgcctggcccattatatcaatcttatgccttttcatccccatagcttagctcccacttttaagtgacaacatacgatatttagttttccattcctgagttgcttcacttagaataatggcctgtggctccatccaagttgctgcaaaggacattatttcattccttttattttttaagacggagtcttgctctgtcacgcaggctggcgtacaatggcgccatctcggctcactgcaacctccgcctactaggttcaagcaattctcatgcctcagctacctgagtagctgggactacaggtgtgcactaacacgcctggctaatttttgtatttttggtagagacagggtatcaccatgttagccaggctggtctcaaactcctgacctcaggcaatccgcctgcctcagcctcccaaagtgttgggattacagatatgagccaccacgcctggcctatttcattcctttttatggctgactagtatttcacgtcctacattcttaatcgttacattggacttttgtaaattatctgaaagtaaaaaggtacttcaactgagggctgagagatctgcctcctaaaaccatctggggctcttgctccctccagctgttccctcctcctggactgttcttccctcagattttatcttttggttgggtccctcacttcaagtgtttacacaaatttgaccttgttagtgagacctccttgaccaccctatttaataatactgcaaaccaatctgtccaacctgcttactctgcccaccccccatcttctaatagtactgtactttgtgcttacctaggctgtccctcttgtagctccttgtaatttcagactttagaacaggtatgaatgaaaacgttctgagaactttctctgcttgtgggtggaggaaggagtgcacagtgaaattgttcttccgattgcgtcttccttacgtcagccatgacacttgtagtcactgctgctaccacttaccaaggaactcagactccaggctgccactaccttgcaggacaatattagctgatgcttgaccatgtctatgtaattttgtacacaagacaaaaaaggggcaaaaagttactagctcctccccttagccaacattttgactttggacaaataagttcacctttctgtttctcattttctttataaactgaggctaataaatcataggtttgctgtagggatgaaataagaaaacatataaagcacttagcatagcacctggcatgttgtaagcattaaatgagtggcagccattattattattttctagcttttatggatgtattttacacatggcacaaaattgtactttcatttatctcattttgacagtatacctcttcttctgacctacaggtacctaaatttaaagaacagtttttcctaccctttcattgttgctagcctttcaagagtctcctactttttttgtgctttctcaattcctgtatgatgtttctaaactacaataaattaaagctagtatttcttctctattggaaggccagctggttaaagacaacatcaaaatatctatacctaaatctgtatgaaattttgaaagacatgatgtatagtcaacttacaatgggcttcattatacttgcttaaaattatatttttatttgatttatattttcaatgtttttttcttaagataaatgcaaaccaacttccattctcaaagcaaataaaataaatgtcagtattcctaggatctcctgaagagcttggaatgatatgatgtatgctgtcccccatctgtatggatgaagccagttcaggaaaacaaaaacaaaatatctatttaattacatttggtgttaatcttttcacaagcagtcctgcattttcatggaattaaaaaacattctgatgagagctttggtaataaaacattctgatgagtgctttggtaatttgctgtatgtgtttattttcacatctatgctagctattgatcacaatttccaagccatttagagggagaaatgccctcaggccgctcttctgtgtggcctactgcagacagccaaattaccccactgacaggccccttcctgcacccacccccacccacccaataccttattcttcacacagaatgcgacaagggccaaaggagagggggactggaacataggagtgtgactagtacatagtagtagctcgataactgttgttgaattaatgaattaacaaatgaacaaattatgtttctagtacactatgactgctagtaaggtcagagctcaatttgctattccattgcatcagctaggatagtgtctgatataccttatctctattcctacttgtttttgaatttttattatcctgcttatggatgctttaatatcataagctccttcccatgtttggactgtgaaacttaagaaagatgtttcaagttcttggtacacaagaaaggagagctcctctcgggaccataggccagttccaaatgcgccttcttctaatcatagcccacagaacttacttctctttcccttcttgggtaggagcactggaaaggacatcttcaatcactatggatgttgacttattctgacagtgcagagcagtgtgccgtaaaatctggggcagacatttcccccaacttccaatatagaagagaaaaaattactaagaaaatcctggccaggaatggtggctcacacctgtaatcacagcactttggaaggctgaggtgggcagatcgcttgagcccaggagttcaagaccagcctgggcaacatgatgaaaccccgtctctacaaaaaaatgtaaaacttagccaggcatggtagtgcatgcctgtagtttcagctatttgggagtctgaggtgggagaatcacctgggttcgggaggtggagtttgcaatgagttgagattgcgccactacactctagcctgggtgacagagcgagaccctgtctcaaaaaaaaaaaaaaaagaaaatccttcagtgcttagagaaatcagagggtgaatggttatatagaagccagcaggaaaagcatcattagaggaggtgaagaatctgaattaattgtccggggctaggacctatatccaagaagggcaaatgtgtttaggagtaacataaaacttaatgtttatgccagatgatgtaggaaaaataacttctgccagaccttggtgactgactagatagagaggctgataaagaggtgagcctattgaatgaagcatttttagtatggcatgatataggtggcccagagtgtctcgagtttgcccaagctttttcctctctaagaactaaccaagcctagtgcttctttgctctgagagcaggcggacattggtttatggtggctagtttgtactaggtagaaaggcaaaagagggaatgctacatggattaatcaaggatgtccaattctaaaacaaaggatgctgagatgacaagaaaggccaaggaagaactattgagattgtaaatgccctgagagcagggaccttttctgtcttgttcactgctctgtttccagctcctagactagggcctgacacatggcagatagagtaagtaagtttgaatgactacattaataggagaaacttttgaaagataaaatgcaaggtcaattatatgcaacggttgttgctatagcaatgatattcgtgcctagattcttccccatatccttcctgaatattttaagataagtatatataaaaggaatatgatggatactcataaatcataggatatggctgctatgacttatgggatgggacagatgagaacttggtatatttacgagaaagggaactgcatagcctctgagaagttgggtagtcctgtgtagaccactcacttatttctaccaggccaagaggcaaataaagctgacctgatatacttttgtgtcttaatctctatgttttaactctaaggggtgggagaagccagtggctagggaaagacagaggttttaggattaacatcacaatattagctacagagattttacctagaagtaactggagcctcatttgtgttttgaatttccataagggagggtttgatatactgccagatcagtactggctttggtgtctgaaagctttttgggagagtggctctggtcactagtagaggcttttcagtgggactgggaggagttaggtagaactttggatttgggtataaagggacttgtaaaactcagtcaaaatgcttacaatctggcaaaggtagctcttcaggctctggtaagggatatctataatctctgtggaatatcttagaacacatgggattaggggagttacatgatcaatggaataggcaattcattcacctgtcagtcacagagatcttacttctagggaaaatctgaaattggaggacttactctgttacatgaatcaaagatatgaccttgaaaaatgggagtaaccatggcaccagtgagtgagtcagtgatttgggaggggaaactggtttgggaagaaggattatcatttcggttttagaaattctgagtttaaagctacagcacatgttgaaatttgtagtagacagctgggaggaactaatggaagcttaggtgagaagacaagttaggggttgttagctctgtcttcttctttgtccaactcctctgagaaagcagaaagtaaagatgccagctttagtctgtggctacttagtttttaggccctttacctatttttagtctaagacattgctgggatacatcaaatggggagagcacaagcagttgcatctatttatgagaaagaacaagtctaaagaatgagagtcacggagaagcaattttctttgcattttatttttatttttattttttgagaacttctcattattaccaagcttctgtcaggaaatatgtactagaagccaaacaaaattatttcattgcttacggtgaaatgtaccaggggtgctgatgggcaaaaaagagcgcctcatatgaaacaccaaatgttccagtaatcctgttccaaaccatgcccgtttacttaaaatttctttcacagttcacgttagactcatgcagtaaataaattaagtacctttcccactgcgagttttttagaaacacttaatgaagtaaatgccacagtgttaggccagggggaagccatgcagttaaattatttttagcatgcattttctagtttaatttttgttggtttcttttgatctgggcttgagtcttagccagatagtgtgattcaggggacagaggacatggatgaaagagaggtttgtctttactgcctagtgaatataactaagggaagcttcttttttttcccaaatgttaaaaaattttgtccctctctaaatatatttaggattgcctctctaaatatcaaaataattctatttgggatagctataaagagatatactattaactcattacccttgaatatttagaaaagctctgtatgtttaattttaattatatggcctttcaataaaagtattatatatgctatttttaaaatacttaaaaacataagattattttaaatatagtttaatctttctaattaaggatgtttcttgagattttttttttttttttttttgagacggagtctcactctgtcacccaggttggagtacaatggcacaatctcagctcattgcaacacccgcctcctggtttcaagcgattctcctgcctcagcctcccgagtagcagggattacaggcatgtgccaccacgcccagctaatttttgtacttttagtggagatggggtttcaccatgttggtcaggctggattcaaactcctgacctcaaatgatccacctgtctcagcctcccaaagtgctgggattacaggcatgagccaccctgcccggccttgtggttttgaagagcttgaatcatcattttgagaattaaatgattattatattataaatgtgcataagtgtttgttaatgaaatttctgattaatatttccttttaaaaaaacaggaactataaccacattcttttaatagctaaaagcatttgttaaagtgaccaaaaataattgtttcaaaaatttttttttgaatgaagacaacgcaaaaatgtatcagagaagatacactgtgtctggaaacaatctgtgtctagaaagaagtcttcaattttgattaatatgttttatgagcaacttaagaattaatgcaatatgttaggtaaaatacagcaataatttttcattgctaaattgttcagcagactctcctaattttcaaggggtgtgctgttgtgagtatgggattttattctgaaggaacaaaaaccaaagtcaaaaagatggtttcctttttgcacagaactctctaatacctctgtcactatctcaacagggagtggtgcttcttattttaacttgaagagtatagtgaggactgtccagcctttctgcaatctccaagtaatcagaaagtattgaaaggtgtaataggaacaaagtggaaaacggcagtatcctcaagttacaggccaaattggtaaccctaagagaaagattttgacagccataaatatttcatctctcaaggccctgatgctactgtgtgagagcaatttagttagaaagatcatcaacaattagttgacatctctatcacacctattactgagttgaaatttcactgacatgaataataaggggtcttgtttgacatttagcagtttaattaatttgtttcctaaagtgaatgatgttttacactgtgatttttcaataccccgtctccatacacttgaatttttttattttgcttttcttggggaaaccagttaattttccttttcacttaacaaactacctacccatcttggctctggtgccagccagtgttttgtggggcttagggggcggggatagtgtggggaaattgaggaagtgctgcagatcatcctctactattcaattttggaggagagataatgtaggagtatggaaaaggaaaacaaaaacacttttttttttcaagaaaatttagtactttttggcattattgttagacaaaaatacaagtcttgtctctctggttattctagtcatcgagaatcaacaaggaaggggccgttatgggtagtcattgcctgccatgtggcataactatttgcattattctttatatattactggctttattggtttctgtacaccttcaagatatgttgtatattaatgtgatttctgtaatgctatttttgaaaataaaaaacataatgtttgctaaaggtcacttctaaaacagctgatgtgaaagtaggaggaataatccaatgtaacaatagaacacatgaatctactgtatattcttacagataaaaatagacttttgaaaaattagtcaactcaattaaattatttactctaattacctctatacaaacccctaaatacctaccttaagctgcttccctttgcagagttttttaaaaaccgaagatatgtggaaaagctatttctctcccactctaaactgtaggtcatgaaggtaaatgatattctgtattcgccagagtgcaagtgtccttaactacctgatgatgatgtatatttctgatggatggggcttagctaggtagacgtacccagatgaaatcaagtgagtgcatattcatgacacatgtgagtgggaagaatgtcttagaacatgtcatgctgaagagacaatgctgaagtgttgaaggttgaatgttaaaaggggaagataggctccagcttttggaggaaaggcagtccagtatatacctaccataatgatacttctttccgtgttgtcggttcttattttataatggtgtctaaaaaataaacaggtaccactactttactaacctgcttttagaccaaatgtaatgaaagtgatacggaactgatttttaactattgaacctctaggatagatgaactcttaatgctatcacaaaccaccatgagatacttcagcataatagagtgctagcaaagttgaaattgctgctattgtgtatctcagacttgttaaagctgttccagactcatggtgaaatagattgctttcttctactggtggacattgaactttttccctctatacatgtgtttataaacaaacagtgacataaacttttccattggaacatattttgaagcagagatatgtgtttgtagagagcattatatatatcatttaaatgtattttttttccaaaacaagtttccaggtcataattttgaacctgtataattttcattatgattttcctgtctgaactgaaaggccatgcaataagtgaaaatattttatgtttatttttgttaagtacctctccctctctgccttagtacgaggcatagcaaggaaggattaaggataatttcataaagataattaaacataagccttgagtgacttctttctatcagaaagacttcagaaaggaaagagttgaattagcatggtatgtttaaaaacgaaacaaaacaaaaaagtgtgacttaggacacaggagatgtacgttactaaaaagttttactatgtgccgggcactgtgcttcaaactcaacatgcactatttcatttggtcccaacaacccagtgaggtagttgtattatcttaattttgtacatggtggcatgatcatagctgagaattcctgggctcaagtgatccttctgcctcagcctcctgagtagctgggactacaggtgcacagcatcatttccagatagtttttaaattttagttgagatggccgggcgcggtggctcatgcctgtaatcccagcactttgggaggctgaggcgggcggatcacgaggtcaggagatcgaaaccatcctggctaacacggtgaaaccctgtctcaactaaaaatacaaaaaaaaaaaaaattagccaggcgtggtggtgggcacctgtggtcccagctattcgggaggctgaggcaggagaatggcgtgaacctgggaggcggagcttgcagtgagccaagatcacgccactgcactccagcctgggcgacagagcgagactctgtctcaaaaaataaatacataaataaatttattttagttgagatggggtctcgctatgttgcccagactatgttgcccagttctagactagtctagaactactaccctcgagggagatcctcttatctatctcagcctcccgatccgcctgccgtggactcccaagttgctaggattacaggagtgagccactgcatccagccctcaaagcattttaaattactatgcaatacttctactcatcaaccctctatcattaagtggttatatcatcatgagtgaattacttaggctttgagagaggtaatttctttccctattaagtgatggtcatggtacctgctcctcttatttcaaatgcaacatgatacaatggaaaaggcaatggacttagagtcagagaatatgaattcaaagactgactctattagttattagttgtattatcctgaattatgcacctaatctctctgatgtggtttggctttgtgtccccactcaaatctcaccttgaattgtaatccccataatccccaagtgtcaaggtagggacaggtggaggtaattggatcatgggggcagttcccccatgctattctcgtgataatgagtgagtcttatgagatctgatgggtttatacatgtctggcatttcccttgcttgcattcattctttctcctgccgctctgtgaagaggtggcttctgtcatgactgtaagtttcctgaggtttccccagccatgtggaactgtgagccaattaaacctcttttctttataaattacccagtcgtgggcatttcttcatagcagagtgagaacagactaatacactctgtaaacttggtatcttcagcatgtaccatgggaataatatcagcacaacctatctccacaaggttgatactgaagttgaaagtgacataatgtaggtgaatatggcttgtggtaaatggtatggatttacgtttattagatgctctgctcatggtaatactgttttcaacagcattttacaatttatctcttttattttgaatgactttatgttgtaggcactattatcccaatattttttttttaatagacagagtcttgctctgttgccaggctggagtgcagtggcacaatctccactcactgcaacctctgcctcccaggttcaagcgattcctgtgcctcagcttcccgagtagctgggactgcaggtgtgcaccaccacacctggccaatgttttgtattttttagtagagatggggtttcaccatgttggccaggatggtctcaatcccctgacctcgtgattcacccgccttggcctcccaaagtgctgggattacaggcctgagccatcacgcccgtctagtatcccaattttatagttgagaacactgaggcataacgaggttaggcaacttgcctagaattatgtagctaataagtggcagagccactcagtttgaatgtagtaatctccctgcagatcccatgctctcagccttccataaagacaggttataatgtcagctactgggctgactgagatgggagtatcccttgaactcaggaatttgaggctgcagaatttgagggttgtaccattgctctccagcctgggcaatagagcaagattctgtctctaaaaataaaaataaaaataaaataagatagaattgtggtaaaatacatgtaacataaaatttactaatgtaaccatttttaagtgtacagttcggtagtattattaagtacattcacagttatgcaacctctgttttctcttcttttctttctttctttttttttttttgacagactctcactctgtcaccaggctggagtgcagtggcacaatctcagctcactgcagcctgcccctcccaggttcaagcaattctcctgcctcagcctgccgagtagctgggactacaggcacatgccaccactcctggctaattttttgtatttttttagtagagatggggtttcactgtattagccgggatggtcttgatctcctgacctcgtgatatgctcgcctcggcctctcaaattgctgggattacaggcatgagccaccgagcccggcccctcttttcatttcatattctatctgtctctttctgtctaaactgatacaattcctttaaaaattttgtaggtttactgtgtatgttacaatctatcacattagacaaaagccacactcactaataagcacttctctctcttgggctccttgtaaacctgctgtggggcaatccccttaagatacttagaacccctattgttatcacaggaggtcttctacacatagccttaagatcttcagaagttcttttgtctgtctgaaagggtttataatgcattaccttaaatcattctggggtcattgagggttttacagccacactctgagatgctttcttgataggacctgggattttatttttaccttgaaggcatttcttaatttgagaagtatttcctgtctgaagagtctgggaatgagaaacaaatttagttttttaacgcagcaagtcctggatcctttacattacctctaaattttgtttgagaatggaatagttcattcttcagttcatctttctcctctgacattttattatggggagcaagaataagccaggtagcacttccagtgttccacctgcagaattccttagctagatcacaaatttattaagtacatttccttttttcatactaccaaatttcaagctgttacacaaggatcttctttctcctaagttccagtaacatctttgttacattttttatttatgcttcagtgttagcctctagagtactgttccaaaactaatgccatgtgttttagattttgttacaacagcaccaaacttttagtaatgaaatttgttctggttagctttgctgcattaaaaaaaaagcctaccaatattaattgtgtaaagtcacaactttttaactttgctcatagattctgtaggtcaagaatttgggatagtcacagcaggcatgtctcttctctgctacatgatgtcttgggcttctgctggggtcaaggggacccactttttttttttttttttggagacagagtctcactctgtcgcccagggtatagtgcaatggtgcaatcttggctcactgcaatctctgcctcccaggttcaagcaattctcctgactcagcctcctgagtagctgggattacaggtgcctgccaccacacccagctaattttttgcatttttttgtagagaaagagtttcaccatgttggccaggctggtcttgaactcctgaccgcaggtgatccacccacctcggcctcccaaagtgttggcattacaggcatgagtcaccacacctgtccaaggggacccacttataagatgatttctttgctcacatgtctggtaactgagctaggatgacctaaaggcttaactgggaccatagactatagagtacctgtatatgacctctatggggcttggacttcttgcatgattgtgctgggttcagagaagagcctccagagagcgagcatttttttttttttttttttttttttgagatggagtctcgccctgtcacccaggctggagtgcagtggcgtgatctcggctcactgcaacctttgcctccccggttcaagtgattctcctgcctcagcctcttgagtagctggaattacaggcatgcaccaccatgcccagctaattttgtatttttagtagagatggggtttcatcatgttggccaggctggtctcaaactcctgacctcaggtgatccgctcgcctcggcctcccaaagtgctgggattacaggcgtgagccaccgtgtcgaacacagagagcaagtattctaagaagatcaagtacaagttgtgtaaccttttctgacctagcctcagaagtcacagagcatcacttccactgaactctattggtcaaagcagtcacaagtctgcctagatttaagggatggggacatagaatataaaaaaattgggggctcatgttttaaaaccaccacaggggtggtaaaattcaaggataatacagtccatcttcgtagccagtaacattactccccaatccccccatcccataaccaggagttgcttttttccaggactaacgttggatgcttggagataattattttattaagaatgggaacatttctacccaaaggtgcattattattattgttttccattttgctaatggtcttctcctttttatttttcttctcttcttcctctttcttcttttttccttctcctcctcctttcttttttttcttcctcctcttctttcctttaccattcttcttccttcctcttccctcatcttcatcatcaagcagtgtacactggacatcccttagcatctgttttcatttagttttgcagttagctatgccttacttcatgctccagaaatactttttatatccctctgttagcctttatctcattctgttggaattatttgtgtatttacctgtatgtcacaataactgggactcctgatgggcaaaggccatgtcctgttcatcattaatccaccaggccttggcacagtacttggaatccagcaaatgtttttggaatggttaaatcattgaatggcttttttctgcctatcttctatgcaatagatattatgcctcctaagatcttttgtttttactttgagcagtttaagagcctctccataagtgcaaatttcataaaaaaaaaaaaaaaacttagcttgttaatcatcccttttgtattattttcattaaatattcatttaaagccttttattttatatgaggataagtgagattaagatagcacacgttagtagttatagtagtagtaatactggaaatttttcaggcatttatataaattttataggttagatgacacaaaatatatagtaaattagattattattttagaactgttcatgtttagcttgttgatgactgaaatccaacagtaactattataaaattgtcctaaaattactaaagagatattttttttttgagatggagtcttgctctattgcccaggctggagtgcagtggtgtgatctcagctcactgcaacctctgcctcccggattcaagcaattctcctgcctcagcctccgagtagctgggactacaggtgcttgccaccatacccagataattttttgtatttttagtagagacagagtttcaccatattagccaggatggtctcgatctcctgacctcgtgatccaccctcctcggcctcccaaagtgctgggattacaggcgtgagccaccatgctgggctgagatattcttttcttttgaaaatattactatacattttcacagaataaattttaattgtttctagttttttgagtataagctggtttataccatcgtatgtcatgcagttcttttcatcatcttattaggtgggaattagtgtacttattttatagatgagaaactgaggctggaagagggtaattcatttgtatgaggtcaacagctaataagtagctgagctaagattcaaatctggatctatcagacccaaaagcctcttaagcaatatgcctctttcccaagaattcttttcttttcttttcttttattattattatactttaagttttagggtacatgtgcacaatgtgcaggttagttacatatgtatacatgtgccatgctggtgtgctgcacccattaactcgtcatttagcattaggtatatctcctaatgctatccctcccctctctggattaagaaaatgtggcacatatacaccatggaatactaggcagccataaaaaatgatgagttcatgtcctttgtagggacatggatgaaattggaaatcatcattctcaggaaactatcacaaggacaaaaaacctctttcccaagatttcttaagcaatatgcctctttcccaagatttcaaagtgaaattttgtcccaataaattgaacataatctgaataattttatgaaattaatattgtctgcctagaaaatgtataatgctaagagcattcactagtaatttcctatttttatacatgtagatataaaatttctattagggttctacagagaaatagaaccagtagagtatatatagatggatatacagagagagatttattatgaagacttggctcaggcagttatgcaggcagagaaggcacaatcgattgtctgcaagctggaggcccagaaaagctggtcatatagttccagtccaggccctagggaccaagaaccaggtggccagcagtgcaagtctgtaagtcctggtctgagtccgaaggtccaagaactgggagtcctgtttgagggcaagaggacggatgccccagctcaggtagagagagagcaaattcacccatcctttgtcttttccctctgtttgggccctcaactgattggatgatgcccacctacactggcaagggcgattttttttacagtctactgattcaaatgctaaccttttctggagggttcccaggcacaccccaaaatagtattttatcagctatctgggaatcccttagtttatgcataaaattaactattacaaaagcccccaaatattttcttttttataaggacttcagtaagatatagttcatacacataccatacaattaatccctttagggtgtataatttagtggtttttagtatgttcctaaggttgtgcaaccagttttaaaacaattttacaaccaattatagagcattttcatcacccaaaaagaaaccctatacccattagcagtcactgcccatttcctccagcccccttattccttgacaaccacccccagttttttttttttttttctttctaagacagggtcttgctctgtcacccaagctggagtgcagtggtatgatcacagctgactgcagccttgacctcccaggctccagtgatcctcccatctcagcctccctagtagtagctgggactacaggtgaacgccaccatatctggcaatatatatatgttatatatattatatatatataatatacatatattattatatattatacatatatacatatataatacatatatacatatataatatatatacgtatatacatacatataatatataatatatatgtatatacgtatatatattatatatatatatatatttttttttttggtagagatgaggtctctctctgttgcccaggctggtcttgaactcctgggctcaagacatccagctttggcttcccagtgggattatagacacaagctaccactcttgtttaatgtcaaatctttaatatcctacaatattttaaagatttactcactgagacaataatagagctttaagaagcagcagtgttctgattttgtgcaacatgttcatgagtgttttacagttcctttttttctttttaaaatacttcattttttagaacagtgttaggttcacaggaaaattaaacacaaagtacagagcatcctcatgaccccctcctcccacatgtgtacagcccccccccccattatcaatatactcaatgtttgttacatttgttacaattgatgaacctaccttgacacattatcacccaaagtctatagtttacattagggattactcttcctcttttgacattctgagttttgacaaatgtataaatgacatgtatttgccatgactgtatcatagagaatagtttcagtgtcctaaaaatcttctgtgcttcacctattcgttccttgtagttcttttaaaaactacagaattacagaaattcgtcgtgggaaggtattgagagattatttggtgcagcaaaccagttgggaaggatgtagtcaaaattcccagtctcttcagctgaatttgtccctttctttcttttgttgattgtcataaatataagcattttttttctttttttgtagtttcccctttcttaccacaaagggtcatttcctaacttagaatgagccaggcaacaaattttagaatttaacaagaaaacagttatttccttagttcttgttttatgaaaaataagttatttatattagaaaaatttaaaaatatacaaatagtagagagcacaaaaatagttatccattccccagttaccaacacttggccaatctcttttcatttgtccttccactcattgccacccccttaactgcattatttcaaaatgatttatagatatatcattttatttgtatgtattttaaaagatacactttaagagaaaaaaattatcacaaccattatactgtaatactgctaattccttaataccaccagattggtaatcattatttaaattcccccaataattcataactttttctttattgtcagtttgtttgaatcacatccaaacagtatccacacattgcatttgtctctttcaatctatagcttccctcccttgtttgcttcttctcccttgcttcttctttgttgaagaaactggactattcatcttgtttcttgcacacaggatttgcttattgcatctctgtggtatttaatgcatttttctcctgtgaactggcaggttacttaagaagtttgatctgattccagggtgtttttttgttctgttttgttttggtaagaatacttcattgatggtacactgcattttaatttctactaagtttctgtttgtctattttatgatgttagtggccattatttcgttaggggtttgcaaagtggtgatattctaatgtgtttatctttcttcatttattagttggactatttctataaagagaaacttatcaataacctgaggtatagtttgtatagaaaaggcagattaaatgcttgatttctttccctttaaccgctagttttcagaataatgaattggttcactagcatcctccaaaggagaccaatcaggttttgtttggtttgtttctttaatatcattatgaactcctagattttttaacctatttcatgtgtttcaatcaaatacagttattattctactgatactcaaacttgaaaatcaccataaaatttaaaaattgtatcacttaaaggtggttttattataaattatttccccctagaatttatgaaaatgaaaagcttccctgtgtagttacacatgaatgttcaggagtatacctaccatgtaaagtgggttgaactttcacaggggtttatttatgcatatacactgaaataaatgtgttagtgtggttatctaagacagtctatgatactctaaggaatgaatacatgttcacctttatacaagaaatctggagtcatgtactttgggctagggttgcttctgaggtggcagccattctgcagcagcccttctgtaccttaaaaaccagcacagtctccttggaacacattcttcagctctgaccacaggagaccagctgggctaacactcagtgatttgtcagatttacctgcattttcatagtatttctatcaaagaaatttgtcctaagtgtcaaattgctgatttttccagtaactaaaaggtttcatgtggacttctgttgttatttacatgtatatggagaaaattgcaatctgtgagtaatttgagaaatttcaacactttcagcagtagtgatctagaaattaaatgggtttcaaatacaatgttccagtgcagtgccgcatatataatgtatgtgcagcatatgctgaggtctttttcaaaacatttacattaaacctgtcaggtatttatgaatagcaaaaattaatttcccctagttctgtcatcagttagagaaatggatttcagcatggaagactgtcaatatttcctgcatactagaacagctcacttcaatgtcatagtattacaccaggtggccttctaagagtcagcttaatgtgatttcaaatgatagggtagtgaatgtgagggaaattaaaatagtatcatacttatgatttaaaagcaagttaattacaagggcttgttaataaacaaagaaaaattctgaatgtattatctgttatatagcatatcaataacaagtgtgatgctttgaaaacaaaaaactctaccactatgtgactttgagatgacttaaaaatatttaattaaattgttgacaaatgtgttaatctactaatggccttatagcatttgaaagaatttttagatattcatttagctcttaaggcacttctaaaagcattgtttaactgaaaagattagctacattgttggcattttatctagaaaatcactgatgtgtttgctgtgaatgatcctaacagcactgtactttgtcaatgttcagtcaatgcatttttcccaatcgggtacttttaaggttcttatagggccaaagcatgtgcaatatcactattactaaaatgagagacattttatttgatgaattatttagtattttttgatggttttgggtgatgtgcctccaccctgcccctatcttatatattagggggaggaaaagggaggatatctgatgcattttaagaaattattaacgttctgatttttaaaaatattgtgaaattttaattttagaaggtattaaaaatgtccactatttatgaacctgtgaaaatttcataatatttttaaatctagaggtttagaaacaattattattaataatttcatagtgtggtagccttagaaggaacaagatatgatgacaaagatcttccccattgtgcatatgaacttgctgggagtctgatatatatatacatatatgtattaataattaatatgaggaacacaggctgattttttaaatatatggcttatgaaaatctcattttctagtcacaagacaaactgaggataattcttcccttcctggattatactgttatgtagttaataaacctattcttttaaagattatttcaaggaattttaatagtttttgttctgcgcggtttttaagattaaaaattaagcccaattcttaagaggttgccttttaaataatgggtctaatacaccagggtcacatagagttcaaatcctggaaatatatggctctacttacacaacgttttatgtggtttttcttttaaaaattgtcctctttaatatactgtggaataatgtgagtctgtacaatcccattttaaggacttctttgtaaaatccagctgttttaaggttctttaaatatcctggctgacaaccacaactgacactgctgtgctgatgtggatataagaaatttcatttgaatgagaaggacagctgacattatattcatagttttatcagcggccatagggttattagtcatgggagccaatactttgttctggtcatgtatcccttttttcatagggctttccactttatgattattgtttgttaacattttatcttttaagtaaataaacagtgatactgcaaatctctgtggtacaaatctgcatctgttttacttgaggattgtctatgttattgcaattttgataaacctttgaatctcatgatattacacttgtatttccttggttatatacagattccttttaagaaaactaaggcaaatattttaaaatacatttaaaaagaacataatttttgcatgttttgtcttatcacagttttaaagtgctataattctgaggcttcttctagaggaggttaagcattacaaaataaaaggcaggaaaggacaattttaggaactgtgcaactaagttaaaacaaatattatatcctagtaattgaggattaggactcttgattccattccttgtagtgctctcctatagacctctgtacagaatgtgtatatgtaggtatgtacatgtattttctgaatacggctacttgctggtatagtgtcattttaatcaacattttaatctagtcgttattaaaatgctacttacaatgtagagagaggctggctatttgcttttaaagtgtcaacaaaaatgctggaacagtcacatgtttttgttgatcaaagaatgtacaaatgtctaggagatcacaatcactattaccatatatggattatgttgacaaaatacctgggtgtgtgaattcaaaagggaataaatctgatgatctgttaatttgcaaacagaaaattattataagaactgtgcagctggagtgaattcaaaagttaaggaaagtttgaatatctgcttgcatgctatagcacttgaaatacatttagacctgtgtcacagacattgagttcctactatagtcagcttctgtatttggtgtattagatgagtatgacaatttgcctcccctcaaacagcttaaaccatactggggaaaaatggcatggaaataaacagtgacaatgcataatagctgtaataggatgcatactttccaatgggaaagcaaaagggggcaaatttatttttatgtggaagccagaaaagacttcaccagtaaggcacatttgtaagggaggcacaaaatggaaataatgaagctgaaaaaatttatgaggacttcataagatcatgttaaacaattttacttttatcatgaaggtaactgtatgccattaaagtttttttttttttttgagacagagtctcgctgtcacccaggctggagtacagtggtgtgatcacagctcactgcaacctccgtctcccaggttcaagcgattctcctgcctcagcctcctgagtagctgggattacaggcatgcaccaccacacccggctaatttttgtattttttagtagagacggggtttcgtcatgttggccaggctggcctcgaactcctgacttcaggtgattcacccacttccacctcccaaagtgctgggattacaggcatgagccaccgctcctgacctaaagatttttaaacggagtaatagatcacatatctgtgttagaaatacaactttaagatggcagataactgcatcttttttctgaggggcaaatccagtaatctcattaaaaaataattaataacagatttttttttttttgagacagagtttctcttttgtcgcccaggctggagtgcaatggtgtgatcttggctcactgcaacctctgcctccttggttcaagcaattctcctgcctcagcctcctaagtagctgggattacaggtgcccaccaccacacccagctgatttttgtatttttagtagagacagggtttcaccatgttggccaggctggtcttgaactcctgacctcaaatgatccatctgccttggcctcccaaagtgttgggattacaggcatgagccactccatccagccaagaatattatatctggcaaaattattcttcataaatgaaggagaaataaattctttcccaggcatgcaaaagctgacagaattcattaccactaggccctagaagaaatacttaagggtgtcctaaacctggaagtgaaaggttatctaccattgtgaaaacatgtggaagtataaagctcactggtaaagcaaacacacaaatgaggaagaggaaggactcaaatgttaccgctaaagaaaaacactaaaccacaatgataaacaataagagatgaagaaaggaacaaagaatatataaaacattcagaacacaattaacagtataacaggagcatatcaataataccctcaaatgtaagtggattaaattttccacttaaaacatagaggctggctgaatgaattacaaaacattacctaactatatgctgcctacaagaaactcacttcacctgtaaagacatgtatagactgtaagtaaagggatggaaaaatatattccatgcaaacagaaaccaaaagcaagcaagaatagctatacttacataaaacagactttaagtcaaaacagtaaaaagacacaaagaaaagttatataatgacaaaggaatcacttcagcaagaggatataacaattcttaatatatatgcacccaacactggagcacccagattataaagcagatattactagacctaaataaagagatagacttcctatacaataatagttgggaattcagtattccactcatcgtctaatgcaactagcattagacagatcatccaaacagaaaatcaacaacgagacattgggtttaaactggactttataccaaatgggctttatagacatttatacaacattttacccaacagctccagagtgcacattcttctcatcattatattgaacattctgcaggatagaacatatgttaggccagaaaacaaatctcaataaatttttaagaatagcaatcctatcagtatcttctcagatcacaattaaactagaaatcaatagaaatcaacaataatttgaaaactatacaaatatatggaaattaaacaacgtgctcctgaatgaccattgactaaatgaagaaattaacatgaaaatcaaaaaatatcttaaatgaaaatggaaacacaacataacaaaatcctcaggatacagcaaaagcagtgctaagagaagtttatagcattcaatgcctacatcaaaaaagtagaaagatttcaaataaataatctagcaatgcacctcaaggaacttgaaaagcaagaacaaaccgaacctaaaattactaaaaggaaagaaacaataaagatcaaatcagaactaaagaatatagagattatcaaagaaaacaataaaaaggatcagtgaaatgaaaagttggcttttttaacatataaagttgataaatggctataaccaaaaattgctataaccaaaggggagagggggagagagagagagagagagacccaaataaaatcagaaatgagaaaggagatattacaactgataccacagaaatacaaaagatatcagaggctattatgaacaactgtattcgaacaaactttaaaaccttaaggaaatgcataaattctggggcatacaacctaccaagattgaatcaggaagaaatagaaaacctgaatagaccaataacaagtaatgagattgaatcagtaataaaaagtctcccaacaaagaaaagcccaggattaatggcttcactgcctaattctaccaaatgtataaagaaggactcactcctcaaaccattccaaaaaatgcaagaggagggaatactccccgacttgttctatgaggccagcattaccctgataacaaaaccagtcaagaacaaaacaacagcaacaaaaactacaggccaatatttctgatgaacataggtgcaaaggttctcaacaaaattctaacaaactgaattctacagcacatcaaaatgataatacaccatgatcaagtgggatttaaaacagggatgcaaagattgctcaatatatgcaaatcaacaaacgtgattcatcacaccaacagaatgaaggacaaaaatcatatgaccatttcaataggcacagaaaaagcattagataaaattcagcacccattcataataaaaactctcagcaaacttgctctagaagcaacatacatcaacataataaaggccatatatgacaagcccatgtaacatcatactgagtgggggcaaagctgaaatcctttcctgtaagaactagaataagacaaggttgcctactttcaccactcctattcaacataggaacaatcaggcaagaggaagaattaaaagcatccagattggaaaagagaaagttacattgttctttgcagacaaaaataattttatatttagaaaaaccaaaagactccaccaaaaaactcattaaactgttaaattcagtaaagttgcaggatacaaaatcaacatacaaaatcagtagcatttctatacaccaataatgaactagctgaaagagaaatcaaataagtaatctcatttgcaatagctgcaaagaaaatatctagacataaatttaacaaaggaagtgaaagacctgtattagaaaaagtataaagtactgatgaaagaaattgaacagaacacaaacaaatggaaagatattccatgtttgtgggtcagaagaattaatattgttaaaatgaccatactacccaaagaaatctgtagattcaatgcagtccctattaaaataccaactttttttttttttttaaggtggagtctcactctgttgccccggctggagtgcagtggtgtgatcttggctcattgcaacttctgcctcctgggttccagtgattctcctacctcagcctcccaagtagctgggattataggtgcccgccaccgtgcccagctaattttttttgtatttttagtagagatggggtttcaccatgttggccaggctggtttcatactcctgacctcaagtgatccacccgcctcagcctcccaaagtgctaggattacaggtgtgagccactacacctggcctccaacgttatttttcgtagaaatagaaaaaataatccccaaatttgtatggaaccaaaaaagagcctgaataggcaaaccaatcctgagcaaaaagaacaaagctggaggcatcatactacctgactttaaagtatattacaaggatatagtaacccaaacagcatggtatcagtataaaaattgacgtatagaccaatggaacagaatagagaacccagaagtaaatgcacatatttacagccaactgatttttgacaaaggcaacaagaatatacattagtaggacagtctcctcaataaatggtactgggaaagctggatatttatatgcagaagaatgaaactggacccatatctctctccacgtaccaaaaagccaactccagatggattaaggacttaaatatcagatcccaaactatggaactattagatgaaaacataggggaaacagtttaggacactggtctaggcaaagattttatagttaagacctccaaagcatagacaacaaaaacaaaaatgtacaaatgggacaatattaaactaaaaagcctctgcacagcaaaggaaacaatcaacagaataaaggcataaccttctgaataggagaaaatatttgcaaactatttatctgacaagggactaatatccagaatatacaaggaattcaaacaactcaacagtaaaacaaacaaacaaacagttccattaaaaagtgagaagggacatgaatatacatttatcagtagaagacatacaaatggccagtaggtatatgaacaaatgtttcacatgactaatcatcagggaaatgcaaatgaaaaccacaatgagatattgttgtatcttacgtcagttagaatggctgttattaaaaagacaaaaaataacagatgctggtgaggatggagagaaaagggaactcttttttttttctttctttctttctgagacaggatctcatttctgtcactcaggctgagtgcaatggtgcaattatggctcactgcagcctcgaccccagggctcaagtgatcctcccacctcagcctcccaagtagctggtactacgggcatgtgccaacacggtcagctaattttttatattttgtagaaacagagtcttgcaatgttgtcctggctgttcttgaactactggactccagtgattctcctgccttggtctcccaaagtgttgggatcacaggcgtgaaccactgtgctgtgtaaattagtacaacctctatggaaaacagtatggaggttccttaaagaactaaaagtagatctaccattcaatccagcagtcccactactgggtatctacccaacggaaaagaaatcatatgaaaaaggcacatgcacacatgtgtttatagcagcacagttccaaattgcaaagatatggaaccaatctaagtgcccaccaatcaatgagcagataaagaaaatgtggccgggcgtggtcgctcacacctgtaatcccagcactttgggagaccgaggcgggtggatcacgaggtcaggtgttcaagaccaccctggccaagatggtgaaaccctgtctctactaaaaatacaaaaatttagccaggtgtggttgtgggcacctgtaatcccagctactcgggaagctgaggcagagaattgcttgaacccgggaggtggaggttgcagtgagccaagattgtgccactgcactccagcctgggcgacagagcgagacgccatctcaaaaacaaaaaaaaaaaagaaaagaaaagaaaaaagaaaatgtagtatatatacaccatggcatactactcagccataaaaaggaatgaaataatgttttttgcagcaacttggattgagttggaggccattttttaagtgaactaactcaggaatggaaaaccaaatatggtttattctcacttataagtgggaactaaactatgagaatgcaaagatacagagtgatataatggacttcagggactcaggaggagaggttggggtgggggtgatagataaaagactgcatattggccacaatatatactgctagggtgatgggtgtgctaaaatctcagagttcaccactgtggaattcaaccatgtaaccaaaaaccacttgtacccccaaagctattcaaataatcatttaaaaaaagttttttagcttcaaacccaaggaaaagttgcataccatttacttacacttgtatgccctttataataataccaattattacatctgtcccatttattatataccaaataattggtataccaattatttgcatctacacttttctttctctctctttctgtgtgtgtgtctgtgtgtgtgtgtgtgtgtgtgtgtgtgtgtgtgtgtgtgtgtgtatgtatataatacttctcggctaggcgcagtggctcacgcctgtaatcctagcactttgggaggccgaggtgggtggattgcctgagctcaggagttcgaaaccagcctgggcaacatagtgaaaccccatctctactgaaaatacaaaaacttagcctggcatggtggcggatgcctgtaatcccagctactcaggaggctgaggccagagaatcacttgaacccaggaggtggagtttgcagtgagccaagattgtgccactgtactccagaagtctcaaaaaaaaaaaaaaaaaacccaaaaaacttctctatatctctttatatcttttaaatctattttaatctgtctatattgtttttctgaaccatttgcaagtaagttgcagacatgatatccctttacttaaaagtatttcagtgtgaattttctaagaacaagaatttcctcttatgtaaccacagtacaattatcaaaatcaggaaatttgatgttggtgcaaaactgtgatctaatccttaaaccatattcagatttcatcaattgcctcaatgatagtctttatagctatttttcttatgctagtgtccagttcacaatcatgcctttcctttgcttgttgtgtctatttactctcttttaactttgaacagttcctcagcctttctttggtctcttttgccattgacagttttgaggaggccagttattttgttgaatgtccttcattctgggtttgtcttctgttttctcatgaccatatgcgggttaggcacttttggcaagcatattaccagaaatgatgatgcactttattggcatgtcatatcagggaatgacattgatgtgtctcattattggtgatcttgactgtgatcaattggtgatgacaaaggtgatggcttccaggttttccagtgtaaagttactgtttttctttttataactaataagcaatcatgaggcgatactttgaaactattgaaacatattgttcctcattaaactttcagttttagcatacattgacaaataatcatgcccaaatcaattattaatataattgttgccaaattgtcccttctacattcattaattggcattctgttataaggagaggcttcccattttccctctcttatatatgtatatacatatatatatatgtacatatgttttagtatggattaattgattcctgtgttattcagtggattaaaatctttgctttcattatttattttgatgttcaaattgtcccagattttgtctgtgagaaccccttcaagctggtccctttgtccttttatcttaccattctttgtgtactttttaactttctaatacaacagtgtgttccaggatcatcttgtactttctctgacatagccatggaaccagtgagtcctccagggaacattgattctttttagtggaaagtgttatttaaaaactcagatacgaggccaggccagtggctcatgcctgtaatcccagcactttgggaggccgaggtgtgcggatcccttgagttcaggcgttcaagaccagcctgggcaacatggcaaaacctcatctctaaacaaaacacaaaaattagccggacatggtggtacatgcctgtagtcccagctacttgggaggctgaggtgggaggaacgctggaccctggaagggcaaggctgcagtgagctgtcattgtgccactgcactccagcctgggcaacacagcaagaccctatctcaaaaaagaaactcagatatgggttctagatatactcattgttactgagatgtaattgcttttaggcccccagaggggacaaagctaaaaaaatttatatttatatatgtggatctgtgatccatttgaagtttattcttatgcatgatgtaagatatgtgtctaattacattttttccaaatggctcagcaattatcctagcatcatttaccaaaaagttcatctttgtctcaatgatttgacatgtcattttattatatactaatttctatatgtacatgggtatatttctgtaccttttgttctattctattggtcagtctatttgtgtgccagtatcacaatgttttagttatagaagcttaatgttttaatgacagtatggctagtcccatctcataggttttcattatcagtattttcctgactaaacttgcatgttgttgtttcatatgaactttagtaccaacttagttccattttaaaaaaagtgatatttttattgagattgcattgaatttataaattagcttagagagaatagacatctttatgctgttgagtcattctgtcttatagtaggagatgtctttccatttgttcaagtctactcttggggctttcagaagtctttaaaaattttcctcacttaggttttgccatttctttttatgtttatctatattttattatctttgttgctattaaaaggaagttttccggttattatgtatgtacagtatttgaaggctatcagtttctgaatataattttatatcctgctacctcactgaatttttactgttgaaggatacatatatatatgcctgggtaacatggtgaaatcccatcttgacaaaaaatacaaaaattagctgcgcatagtggtgcatccttgtagtcccagctgcttgggaggctgaggtaagaggatcactgggtcccaggaggttgaggctgcagtgagccatgagtgtgccactgaacaccagcttgggtggcagagtgaaactctgtctcaaaaaaaaaaaaaaaaggatacatatatatttttactaagactattacttcagaaaagctgtaaaaacagccatatcggccgggcacgatggctcacgcctataatctcagcatttgggaggctgaggcaggcagatcacctgcagtcaggagtttgagaccaacttgaccaacatggagaaaccctgtctctactaaaaatacaaattaaaccgggcatggtggcacgcgcctgtaaatcccagctacttgggaggctgaggcaggagaatcgcttgaaaccgggaggcggaggttgcggtgagccgagatcgtgccattgcactccagcctgggcaacaagagtgaaactctgtctcaaaaaaaaaaaaaaaaggccatatctttgtctctaacagtatagtcagctcaaatctaagtcttcccctgtgaacataaattattttcagatactgtttggtgcttaaggaggcacataatttctttcaagtcatttggagtttatgcagcaagcatagagttgtcattgtacaaataaatgttttccatatagggcccccaaaaatcaactggaaaattctcaaaccagtacttactgagatatttccatgcataaacactgctaggcatttgggtgttgcaacaaaaaaaatagaagatgctgacagcaaagacctccactcaagttgcttagagtctaactcaggaggtaagacacatacacatacacacacacacacacacacacacacacacacacacacacactctctctctctctctctctttctctctccatatatgtatatatttctatacatgtgtaaagaaacttggctggcaattcaaggcattatatagaaagatctaaatgagttagttgcaagataagaagaggtcagagaaagaaggaagagggagaggggaggtttcctggaagaggcagaaccactgtcaggcctagaagcagggacagtattccgagaaactggggtctcaggatagcagttatggggtacttaagacagagaccagataaaagatcatcccagaatggcttcatctggtgagctgtgtgtgggagataaaactggaaacctagactaatttaggtcagatggcgggagatcctgggtgtcaggttagagagcttagactttacttcccttcatcctccattcctcactattattaagcttttaacagttatacttacttattaaaatagagaaccgagtttaagtatcatatagcttcttagatgcaaattatcgtttactagtatctttaactaggggaataaagtaggaataacctggaaattatgttcatttatatgtgattttcctgctttttaaattaatgctttgaagcaactggggcacactttctcccaattaaagagaaatctcattacttactgaagaccttaagagaaaagctgagaatctacagaagtgccttcttttagtgtaaatagtggctcatttagtgccttttagagcctctatttcttccagtatgatttctgccgtgtaagtgtagccaccagcacaaatgaaaaggatgcaaagacatttccctgtattaaagcaatgaattaataaagagagctctgttctggattagttatgcttttaattttaatataaaatagtctctttagaatcaaatgccctgtgggacctatatctagaaggaggaagaatgagcccccaggattaaggctacaaagaactgactgtggtgctgaatgtaaacatcagctgagattaactatgctagtatttttattagtattgttattatttttctttatgtgccgggtagagttttgagtggtccaacccaaccctatttttcttataagccatattattattttttggtgcataatttttgagaatgcaaggattttcaggaaagctaggtggttggttttacaagatagaaaattagaaaataccaaatttttacacaacatagttgatgtaatgtagtaatcatgtattttatttctctggaaattgtatcctcacttatgaaagccagaatactattttagtagcatttatctatttaactttcattgtctgttgacagatgtatttagaaaatcaaagttaatgtaggataacctggtcgagttagcatttattttagtttctgttcagaaggtagcaaatattggtttaaccaaagctcaggggctaagataggtcaaatgaagtttatgagattccatacactttctggacaaaaatctactatactactcttggaaaaataatttgaaaaagacgtttttgagtaggcttaatgttcttaatttagtgctccccaaaagaggagtatgagaaaaacatttaaattttggtattatgttaaatacatcccatgtttatacctaaaatagtcaatgaaattcttttcctgtgtcaatgattatttcagtgattacctggacatttgggaaagttagcaattaatgccaagggttatttattttgtcactggttcagaaatgcctgtttatacaaatcaagacttccagcagcttgagccttctttttctttttgagctggtagagtcaatggttaaaggacaaaaattctacaattgattgagttacaaatgaatacagtgttaattaagccaggccattgtctttaaagtggagtcagtacattggaagtcagatttctcttgctgtttagtcaaactgcctaaggctgcaactgcttccttattaggttactagctttggggagatgtcattgtttgctgctgtagctaggctttctgttaaaaatcacagcatgaggcttaaactgctgcaaccattatccagtgctaacatgtcactaaaggtctgctaatagaacaagaggaaaaatatcaatctttaattttagatcagccaagtaatctgtagcacctgttcattttctctcatcaacccatttaaaacaagactagagtgattctttgatgggcaggctataagattctaatattttttgccttttcttatcagaggaaaatttagactttaagactaaagaatagaaaaaataaactgtaagtacatttcctttaaaaattttatttaagaggtagaattatctgatgtaatccaatgatgactaggttattataaataattttttaaagaataattttgtttaattttctgaaatttactttttagataaaagctaatcaatgaggacataatacactggtccaaacagcaaattttccatagagagcagaaactctttcaagctttagatgacaaccaacttacatttacctattcagatataataaacagaattagaacttagcagctgctagctttcccttacatagacctcaaggctctgtcacggtatggggcaaaattaaagaaaacattgtgtcctgctcttaggagaggtgaaaggattgcttctgcaaaccaccattagcaatgcgagttccaaaacattcccagtgatgctagaccaagtactacacttagcaaataaacatataataagagaaacataaaacttagtaaacctttacagtccccaagtatatccatcttttatttaaattaaaaaatcagttactactctgagcctgtctctttactaggcattgagaacatcaaaatgagtcataatacatgtaccctgctcttcctcgtggaacttatggtctattattgatcctctgtataaaacctttctcagagctagtacacatgcagtttttgttttgttttgttttgtttttgtttttgttttttttgctggtgaggaagttgagatacagggaggttgtgacttgtctatggtcacaagataagtggcagagtaaggattagaagaatccggtgttctaacttctagactcggtctttttttttttttttttaactatatcaagatgaagataccggaggggagaaggggattatgaaggcacagttttaatggacaccttgtagaataatacaagagtggagtgacagtatgggagcctttgattaaaaaattaattctaatgatgaaaatctagaagccagatataatttaagtatcttcaaaaggagggatcatcaactcatttaaaacaagtctacagtgatcctttgatgaacaagctataagattctaatattttttgccttctcttatcagaggaaaatttagactttaagtaagactaaagaatagaaaaaataaactgtaagtaaatttctcttaaaaattttatgtaagaggtaagattagcaaattgcatcttttatatagagagttatcttttgtctataacattcatcagtatctgatcatattcttttggatctggctatcttagactgctaggacacacacacacacacacacacacacacacacacacacacacacacacatacatgcacatacccctatacctatgaccaatttcacatctaagttctgacatttagccctaaaatctccttcttagcccaaagccgctgttggccttgtcctggaaattccaacttttagcattttcttcagtggtcacttgtgtgatgcatctctcctgaggtctacatcagagcaggctcagcctcattctgccacgaccatttccatcatcacaagtacttgatctgtttcacgttttatggaatcgataaatctcatccctaaagagtccagcaggcctttgattcctgacctgacatttgctaatgctattcctgatgacctgccactacggatctgcagcactgcactcttgtgtttgacaacactcataatatgaatcaatattcagcattcagtaagtgagctggggagtcatttcactgctgcaaaaggctgcgttgcccctgggcagctgtcagaaatgggtagttattaatagccctctcttttcacttagcatagtcagtaggggtcaggcatgaaatgatttaatcagtttatgatatctgtgacagagagcacttaaaatgtaatcacaaaatttaggtagaagtgtccctgggctgttgtaatgtttttctcacttaattttccctaatgctgatacagtgtagtgcacactgagagactgaccatacaacaaaatgacatatgagttggtgttggtttcatttctctctcagtaaagttgcctttttagtgggggtttttacttcacaacatagaccacaaatcctaagggtaagtgagtataaatcccttgggttggcttgcttggctctgcaaaatgtgtccaaaatgtgttgaggggtcctgagggtggggaagaacttgattgagcagaaaaatatcaagcttaggttttttgttattgttattttctgtatcctcaaagaaaatgttaatgtgctaggattcagaggacattttccaggtacacaaacctagttgaacaatatcagtagtcttattgggtcctctagcagtcacttggaaataagctcagcagaagtaaaagtaaaaactgttctatgctgatagttggaaagacagtacctcagcagggattggtcaagctgggaattcagggttcaagtaagaagagtggctctaaaaaatgttagatgatgctgacgtggtggtgcatgcctgtggggctactccgaaggccgaggcaggaggatcacctgagaccgggaacttgaggctgtagtgcaccatgatcatgtctgtgaatagtcactgcactccagcctgggcaacatagtaagacctcatctctaaaaaacaagaaagatatgataggtgaaagatgaccctaaacttaaaaggcagtgaaaaaaatcatcacaggtgtaaaagttagcaatgcatggaacaagattagtacaatgtttaggtcttggggtctggaatacccaggttcaaatgccatctctgtactatcatttcctcatttgaaataatacccatttcatagggttactatgagaattaaatacgagcttatgtaatatatctgacacataggagaagttcaaataacattacttctctctttccttatctctaacggcctaaatttggttaattataatgcaaaagggagggcaagttttgagctgaagctgcagtggaaagggatcatcaagacagctgtccttgagtgtccctcctgcagtactgtctctcattggctgcttgcccatcagaggcacactgatcactctaaatatcctggtagagagtggggaaaaacttggccctggacatcttcctgcagatttagggagacagaagaaagaaaaaagcacagaatatgctgagttcagatttgtgattctaatgttaattaatgcttgccttcaaatgggcttagttcttttattcaacaagtatttacttagcatcctactatgtgctttctatgtgctggcaaaatttatgggaacaaccagctcgaagtcccctcctgcctcattcctgactctgttgggtatcataggatgaacattagacaaagacatacgccttctgtgtttctctgtgaatccagagccttaaaagctctggcattgtctaagacccacttatctctaagtgctttggtttgtactggttctttatctttctaagctagaaagccatggtctcacatgaaaccacaagccctgataacaggtgtctcctgtggtaggcagaattctaaaatggcccccaagattcccggccctgctgtacacacaccctctcccaggtatttagccatacgttatctagatactgctgtggaaggattttgcagatgtagttaaggtcccaaatcagttgaccataaagcagtgacattatctgagtggatctgacctaatgacataacccctttaaatctgggtctagaggtcagagacgggaagtcagagacgaagcaggagaaggatttgctggcttgaagatggaggcagctacgtagcaaggaatttttttagctgagagtggcccttgtttgccagccagagaggaaatggggacctcaattctacagctacaaggagctgaattttgccaggaagaatgaggttggaagcagaacttttttagagcctccagatgagaactcaatctggttgccactgttatttcagccttgtgattccctgagcagaaaactcaaccatgccataccagacttctgacctaaagagttgtgaactgataaatgagtgatggtttaagctgctaaatttctggtgatttgttatgcaccgataaaaaactaatacatcttgtttacatcttgcctgttccacatttgtttcctccgagatcagatggaaacatgatcccctttttctgttttcaaatcttatgtctctttctggtacatcggctaagctcttctttctgttggagaaaaatgttctatattcatttgccaaaagagatgattgcaatcttctgaatctggtgaatgcctgaggctctctcaccagtttaccagctctgtccacttctttgggctctctttggtgactaatcactcaagcatcctccttcccaacccctatgggaattctctgccagattactatgattatagttttataatcctaaaaaaaaagacctgaaaatgtacagagtgacaaacataattcaccccaagggaagagaagaacctctctcacacagcaggaagactcagtttttcctgtccagtcacttgccacaatgtcttgaactgaaaaccacaattacttttgcaccaacctaaaatgtatatataattttttttctttttttcttagacacagggtctcactctgttgcccaggctggagtgcagtggtgatcataactcagtgcagcctcaaactcctgaactgctcatatatttaagaaacacttcgtggcagaagattatgatactcttgcttatttattggcttaaggattaaggatccccaaagtctcagacttcagtaagtaagcctatgtcctacatgatgtctgtaaactccactccctcttagacttacatcctagaacaaagacatagggggcttcttcaactgtggccatacatttttgtcccagacccagcttcattgtgttaaaagtcttggtgttatgtgaagagtgtctttatccatccttccgtcattcagtgtagagttctaggatttttgaaataggatagattcattctgacctgcctgaattgaaagtcatattaaaatgtgggcagggaatcgggaagggaaatgtggagaaaaggaatgtgtgtgtagtcatattcacaaaaataccttgataaagagccaataccagcacaaagaacatcagcatatatgtttttaagactgacagccactgggcgtggtgattcacatttataatcccatcactctgggaggctgaggtgggtggattgcttgagcccaggagtttgagaccaaccagggcaacatagggagaccccgtttctacaaatcattaaaaaaattaggcaggtctggtgacacatgactgtagtcccagctactctagaggctgaggcttaagcctgagaggttgaggattcagtgacctatggtagtgccactgcactccagcctgggtgacagagtgagactctgtctcaaaaaaagaaaaaaaaaaagaaagaaaaaagactgacagtcatgtaagatcacatttacatataaaatgcatatatgtaacatttcttatatgaagatgaatagtaaaggaattaaatcaatttaatttctactagtatagaattaaatgtctactataaagttatcactaagctgagctcttagggagacactgaacccaaggaatttataggctccgtctatcttttttctattccatgtggtgtgagagaagtcagttaccaagatctattgaccatctatccactcttttctgaaccaaaggcatactctaaaagcttgcagtgactggatgagtcaaattctgtcacttcctctttacaagttgttttgtaatgattaaaccagtgatacattgtatcatacattgattgaggaggcatttaatacttaaagtgagaactgttgcaagttatcaaaggaactgtgggtgttctgtatattctctgtatatcttcatagagactgccgagaatggggcttgagactaaagttttaaacaactcattcatgaatgtccatctacctaaacttctgtacacaatatatgacaacttgcaagacctggaaaccagatgtttttaaaattgttttcttcagtgttttattgtaaaaagtctcatctattctacctagccacataattccaggtggtgttctagggttcagggtagagtacgtggcagtaatgtagtcacaagattatgtagtcctgtttaatggggcagaaacccacatctgcaagatctttattctctcagattgctgagacaaagaactggatacggggctttacacagtgtcatgcagtgcgtgggcatgccttctatgtcacattaattgtatttataaatttactccagaaacctgagcatgaagactctaaattctcactgttcaggtgactctaagcagatggcttatgcataagattggaaggattggaagttctaaagggaattgtgcgtgttgccctttgtgttccataggccattaccactgggccttgaaactccctggagttttatgcataagaaagaaagatgtcaaatttgccttcttgagtagttttatcaaggtcacctatgatctgtatttaacatttggttgcaagggagagttcccaacaaaaagatgctggaacacagccagtccattagcattgaggccatgctttcttcaaaacatcctgggctctataccaaagtatgctttttaaatggcagcagtggaaaagatttgtcgaaaactcatgtcactgtagatgaatttgctctgaagaatagagatcattatcagcccagtaaattttgagacatcagagtgaagcactgtactaagtgcttttgtacatgtcacttcacttcatcttcataatagtcctgagaatcacataattattattctcattttacagaagagaaaactgagtcctatatatgacataccttgtatacctatggagagctttcctttgttggcaatattataccagaaacagtttagcttactcagggcgaagtgtaatatgggtttctaacatatagatttttttttagttttcattttttaatagatttagagggggacaagtgcagttttgttacatggacatattgtgtagtagtgaaatctgggcgttgaatgtaagcatcacttgaatagtgtacattgttttacccattaggtgatttctcatctctcatcctcccctccgagtctccagtgtctattattccactctatgcccataggtatgcattatttagctcccgtttgtgagtgagaacactaacctacagtttgaatgtatgttcacagtgatacacaatgatatttcgattgtactcattattacttttgagtcttttaaataaaattcagaagagaattttatttaaaagactgtggctttctcattaacaagacaggcaaactgaaccaattcatttacctatctagtgcttgacatggaggatttaagaaatcctagaaaagatttctaaaatggaagattttacttggtgatctttacagtcaataacaactccaaaatcctggaatcttatgcagatagagtcctttcatacaaaatactgtggcagtgctcagaatctggtgtgaggtctgaggcaaccactcacctccatattttccatttattgagcacttacgtttcaggaaccatgctaagcgatttacatacatcatctcatttaattcttacaactgttctgctaatattatttccattttacatatgaggaaactgagatacagagaggcttaagtaatttgtccaaagtcatatggtatgtgatggtagagctgagatgtgaaaaccagcctgtttgaccatcaagctagcctcttaccattgggctatttactttatttatttattcagccttagggacaggataagtttatgtcatttagtcaggaccctttcccctgataatctttggacaaatcagcaataattttaaaagaaagagacaaatattttagaggaagggaataggataattggaaagaaactaagagggtgctgtgaaagtatacataaggcgaaaggaggcttagccaaagagttcaaagtcagaatgctcccttgtcacagaaattaagtactagatgtgtgctatgatttaaattttcatggcacattaaagtcttttgttgaaaaacctgtaacatcttcagcaagtagtagacactatttaagtacctgtaattgaccaatacgatactatactactggtgttctgttcactgttgacccagaaggccacatgtgtagatagcatatgaaccgtcttcattttatactctgttctctcatacaagtgctctaaagtgacttttaatctctgttatatatagttttatccattaagaggatatgacatcttttcattcagagtgagacacttttttttttttttttgggacagtctcgctctgtcacccaggctggagtgcagtagcgcaatcttggcttactgtaacctccacctcctgggttcaggtgattcttgtgtctaagactcctgagtagctgcgactataggcatgggccaccacaccccactaatttttgtgcttttaatagagatggggttttgccatattggccaggctgatctcgaattcctggcctcaagccatctacccaactcagcttcccaaagtgctagaattacagttgtgagacaccgtacttggccacgtttttgttgttgttgttagaaatgtgctctgagactggcatttcctctctgtgactaatcagcattagatgggaagatagtcaactgttgcattctttttctattctaattattgtcatggctctggtagtatttctaactataattttacactaaaataaaaagaataatttatcaaatgaagctattttagtgaatttaaaatgtatgacatccctctcataaggtagctttgcttggttacttttattgttttgttgagtattctgattctataaaacataacatttaaaaaagaggttgtaggcattaatataatattaagtgacttgcaaataaagaagtatggagactcttaggaggtgggtgcctatttatctctttaaagaacacagttttagaaatgtttgctttatccattatgaccttttgctaactcattcattcattcagtagacatttagtgtctgtatgttcagtcggagttcctggggtaagaattagacattcaaagacaactaagatagagtttatacctttgagaagctgactgttttgtgagggagatagacaagggaggaggaaaatccagtagttagttaaacattatgatagaggtatgcactggatggtgtgtgagcacagaaatcttcctagtaacccagattgcctaggttcaaatcctggctttgccacttgttgactatgggtcttggacaagttacttgacctttctgtgcctcatttttcatacagcccttagaacagtacttgatacacaataaatattcgccgggcacagtggctcatgcctgtaatcctgacagttcaggaggccaagacagaaggattgtgtgaaacctggagttcaagaccagcctgggcagcatagtgagaccctgttcctacaaaaatttaaaaaattacttgagcatagtagtacatgcctatagtcccagttacttgggagtctgaggtgggaggatcacttgagcccaggaagtcaagatcagccttggcaacatagttagaccttgtctctataaaataaaaaataaaaaaattacccaggtgtggtggcatatgtctgtaggcccagctatttgggaggctgaggtgggagaatcgcttgagcccaggaggtcaaggctgcagtgaaccatgatcataccctgcactccggcccgagtgacagagtgagactgtcctcaaaataaaatgaaatgaaaacacaataaatactgcattaggatctgttaaataagatatttaaagcagaatggatgaataggaattaaccagatgaagggcgttctggttggggtgggagtagggaagataggatggttttgaggaaactgcatatatggaaggccttggcaagagggatctcggaactgttgaaaagggtggaaagggggcagcagcaaaagaataaactggagaagtaagcagaaaccatattacacagtcgtgtctgaaaacatggcaataatttacattattcattcaggttcatatttttaccatattttcatggaggatggattggagtagggaaaccagtcagaggctgttgacatggttcagataaaaactgattgagaccttaaactaggggtattggtggtagggatagagaagaagtgaattgattagaaagctgttgaaagtgtgggataagggacaagggacaggtgggagtcagacacatctgacggtttctggcttgtttgacatattgctgaagcagggactacaggaagaacagattagggtgaggatggggagggaggatgggttccattttagatatttttgagtgagtggagcctgtgggacagttagaagagctttcccaataggcctttggctgttgagaaggtctaggcatcaggagagtggtctcatctgtagaaattgatttgggagtcatcttcaaatgaatgtgggttgaagccgtgagagtgggtgagattaagaaaaggaataaagaaagaatataatagaatttaggatagattcctggtgatcactaatttgaggactgggtatatagactgaaacagactgaaaggtaatgcccaaagaggaggaaaaccaggagttgtcatagaaaccaagggaggagaaactttcaagggcaagagagtggccaaccatgtcaaatcctgcagagcttttggttaggatggggacagaaaagtgtccattgaatttagcaacaaagaggtcattattgattttggccagagaggcttccagcagggaagaaggagtggcagccagattgcagtgggctaaggggtgagtgaatgggaggagcagaagtatagcttgtctaaaggaaaatcaagacatggggcagcagaaaggggaatgcagggttatacctgtctgtgttataggtagcatcttcattgcaaagtgaaaggctatttaaaaatacctacaattttttttattttttatttttatttatttacttattttgagatggagtcttgctctgtcacccaggctggagtgcagtggcgccatctcagctcactgcaacttccgcctcccaggttcaagtgattctcctgcctcagcctcccaagcagctgggattacaggtggctgccaccacacctggctaatttttgtatttttagtagagacagggtttcaccatgttgtccaggctgttcttgaactcctgacctctggtgatccacctgcctcggcctctcaaagtgctgggattacaggcatgagccaccgtgtccagccaatttttctttcttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcttgatctcctgacctcatgatccacccgcctcggcctcccaaagtgctgggattacaggcgtgagccaccgcgcccggccctcttttttttttttaaaggattaatccgctaggcacagtggctcacgcctgtaatcctagcactttgggaggccgaagcaggaggatcccttgaacccagaaatttgagaccagcctggcaagataatgagaccccgtctctacaaaaaaaatttacaaaatgatacaagtgaggatgatgtaagtttatttcagggagaaaatgcacaggaactacccactccctgctggaatgcaacagcatgcaaaagttttatcttttttactttcacctatgtggtttgctttaactcttttcactgaggaaatgccttgtttattaacttttctagacataggattcattcatcattaatgataatgtggtttccaagtattatttgtcagagaaatgtccactagaaatgataatggtactaactgtgtcctctttctgccatcactttaatcttactcatatctctgtgggaggatggagctgaaagataaacctttggtacattttctagttttgtttctggcttttttttttcctatttaaaagtgttagtacattctcttatttgaggaaataaaactaacacatgaaacaaataggaagcaaaaataaacggtgcttaagaaggtagttaattttatggtacaataagggcaggccattggttggtttctttgtttagagggcagtccttttttgaggaaggggaatattagtggaatggtctggtgatgttgctcctcatcttgacctgagggaatgtcttgaacaagtcaattaacttatttcttccttctttcctccctccttcccttctttccttcctcccttcttctatgtgtaaaatagaaacagtaacaacagtaataatctctttagagaagcttgagaaaaaaaggtttctaaataaatagaagaatggttagcaccatatttctgagtccttgtccattttcttgttaccgggaggtgatcactttttgtggagaaagtatttttaagtcacttttttttattttctacatttttctaatttcatgttgctgtttttaaaatataaggaatagacaaagaaggaagtttaagattaaccattgctctctgctctgtatcaatttaggttggtctccactccccactgcgcatgtcagtcagtttaaaatatctgttatcaggaccctgattggcattaaaggaaaacttacataatgagtttcacccagggatgatcaactgcaatactattgtgagttttatttatttatttattcattcattcattcattcattcattcattcattcattcgatgagatcttgctctgtcatccaggctggagtgcagtgatgtcaatatagctcactgcagcctcgaactcctgggctcaagtgatccttctgcctcagcctcctgagtacccaccaccacactcagctaattttttaaattttttgtagagatggcatcttgcaatgttgcccaggctgatcttgaactcctgagctcaagtgagcctcctgccttggcctcccaaagttgtaagattacgagagtgagccactgtgcctggataattgtcggttttctaagagctctattgcattgccccagtttccttggtacttgctaagtttagacctcgggtggaccaatttacatatatgggaatatgcaggaaatgcttttatcatctgttgtatcctcaaaagatagttcctaaggcagaagtctatcttcaatagatagagttcagagagacaaattaattaattctcagaggtggattggataaggaaattgtggtacatatgccccatggactactacacaggcataaaaaagaaggaaatcatgtcctttacagcaacatggatgcagtgggaggccattatcctaagcaaattaatgccagaacagaaaatcaaatgtcacatgttctcacgtataactgggagctaaacgttgagtacacacagactcaaagatgagaacaatagacacttgggactcctggggtgggatgtggaagagaggtgagggttcaaaaactaactattgggtattatgttcactaccttggtgatgggattattcgtacaccaaaccttagtgacacttgaattactcatgtaacaaacttgaatacataccccctgaacctaaaataaaagtctggaaaatgtgtctctgtgtgtgtgtgtgtgtatgtatgtatggatagatagatagatagatagataaacagacagacattatctgtctatctaactatctatctatcatctatctagaatccaaaataaaattaattctcagtttctacaacagatggttcttcaaaggcttagatccactaaagctatccaacttgaacacttttggattagggatgcaacttagtggtggtgctgttttaattaggacacactatttgcagaatcatgaaatgatggtgttggaagggactgtatagtcctctattgcagcttccccttcagttgaggaactcctccgagagcatctgtcacagacttgtgagcatcttcactaataggaagtgcattccttttgaggtggtacacagttaaactgttgcaggtgtgaagaaatgttcttcatcaagagcctatgtgttcctctctgtgataatgtacattctttgctctgctctctagagcaccaccttattttcatgacagtccttcaagtatttcatgacaactctcatggcttttgtaaacctttatttcttcaaactaagaatttctattttacataaccactttttttttaatgtggtcttcagatttttcaccctcttctctaccaaatctgttatccctttgaaagatgtgtcttacacagggtctagttgagcagactagtatgtctgtagagctgaaccctctatctacttactggaggataattatggaggaggggaaagagtctagctcaatgcctgaaacagttattgatttaaatttacataaatggttcatgataaagcattttatgactattcagaatcaagttttttatttgaactgctagcaaactaggtcttgtccaatttgtacatgggacctaattttttgtttaagataaaaaagcttctctatgtttttgcctgcaaaatttcatttgactttgaataatattggtttttaaactcatttttatattgactttgaataatattggtttttaaactcattttatgccaatcaaagtcaattcaagtttttattcatcatctgtattattaactagccctcttgctttggctattgggaaatgtgtaagtttgcctttgaagtcgcttttcaagttgtcagtaaaatatttgaataggctagagctaaacacaacacactgggagtttctgttaggaaaaattgacatccatcaactgacttggccagtttttcttagtcttgtccataagaatctatctgaggcttagttaaatgtcttcttggaactaagagatactctaacatacttgttttttaaaatttattttcttttagagataaggtctcactctgttgctcaggctggagtgcagtggcatgatcatagctcactcctgggctcaagcgatcctcccactcagccacctaagtagctaggactacaggagcataccactatgcccagctaattttttaattttttttttctggagacagtgtcttgctatattgcccaggcaggtctcgaacttctggcctcaaacaatcttcctgccttggccttccaaagtgctgggattataggcgtgagccacggtgcccagcaggtggcatccttctaatgatagactgattgaccagtctaaaaagaaaaaagcatgctctcatttattaatatctaatattatatagtttgaggtggtatatttaagctctttggacaatagttaacctaatctaattttatccttcaaaatcatctgaacaaagcctacctatgcccatctccatttccctggcagctcccccattctttgggatgtctcaaagttactaatattgattttgcacacttgccctcaagttgtttcagaaccctggagtgtaatttgtctaagcttgaaaagttgaattcacttgaagtgacttcatgctgttttcctactatcttacaccttagatgggggctttgagtctttctttttgattcttgttctaccattttcagagagaaaattaaatctaagcaaaacaggaattgataagtatagctgccttcctgtcaccctttattattatgtcatatggcctgaccactggttttgtaacattcttgtttgtcttcttattccaaacaaccttcttataatctttatcatttttttttctttcttcttgcatgcctcagcattctggaatttagcctttctgatactgtgttttgtaagttcctaccaacttggcagcatactcctggtgaggtgaagctcctcaacattactacgtcttaccaaaatcatggttttgtatctagacttagaaatagattatctgaattctccatctagctggtggtttatagtatgtgtacttccacaagactaccattactgttttcctttcttaatctccactttttctttccttctttgtgtttgatttttacatagataaatatattctgaacatacagtttacttattattcatcactatgaattgataaataagcatgtgactttcttttcctcgttgctttcacttgggataacctggtgacatttcccaatataattcttctaagtcatacctgtaggcctttttattaatattcccatttactctcaatcaattcagctagttttttgtcaaacatgttctgctcccttttcaggaggtgaatgatatctcttattaggagtttttcaatctgccagcttaagctatagatagacaacaatattatggggtttagagcaagttgcacttaagacattgatgagggaccttaagatctggtcacattggatcccctcactcatttctgataaagaaaataaagtagatctgatactgctaaatgaacaaggaagtggaattgtctgtaagagtctttgaggacatggatgggtcaggaaaagtcaaggaaatcactaggcgatggccaggtagggaagtgagccatggacagggctggagaatataagagggagaaaaaagtgagcctccattccaagtgatggtgatggtgtgaagcagttgtggtggtggacttgcttgtgacaggtggtgaacttgtgtgaaatgaaaatagaagatcaagctgatgcttggaaactgggtaggaggtttattggggtattctgccaagggctttgtaacttgccacccagctgctgtctttgagtagaaagtcctctagtggtgagccagtgagaggggctaagagccatgtcccccttcccattccactctgtgttctacatcagaatttcaggtccagagcagtttttacaacaaacgaattctatttttcttggcactatccacagtctctgtttacccttctttcttttctaatccatttgcttattataattattattacaacagaagcataaccattaacaacaataatagctagcactttatgagctttcattatatgccgaatataagtattaactcatttaattcacacaacatccctgggaggtgagtattattatttctatttcacaaatgatgaaaccaaggcttagagaggttgggtaacttgcctaaggtcacacagctagtaagccgtgacttcaaagccatgctctcttttttttgagacagaatctcactctgtcacctaggctggagtgcaatgacacaatctcagttcactgcaacatccatctcctgggttcaagcaattcttctgcctcagcctcccgagtagctaggattacagatgcctgccaccacacccagctaattcttgtatttttagtagagacggggtttcaacatgttggccaggctggtctcaaactcctgacctcaagtaatctgcccgcctgggtcttccaaggtgctgggattacaggcgtgagccacagtgcccggcccaaagcagtgctcctaatatcatattcccatctgcctcccctgctcaagaggaccttactctctcagtactggtggtatttgtggtaagatatggagaaaatgataactaagtatgtatttcacaatatgtaaaggttttttcttttttaacagacattacattatttgatctaaccaactcctatgccataactagtgttattcctattttatggaagagaaaaataaggccgagagattaaattaaaacttacaaggtttacttttattgaattaatttttaaattattgttataaaaataatcctacaatcccacaacttagaggtatctactcttatctcttcgggatgtatttcccataggtgtatatacaaatttttgtttctttcttaaaaaaaggattatactacctgtactgttttataacctgactttttttacttcaaaatgtactatgaatattttcagtgtgattaaattttcttctacaatattattttaatagtattattgttttgccttatgtagatattaccatttgtgctcctgacacagtaaaacagtaaagatgataatatcaagggagagtatagtcattagtttctttttttttattattatcccccatactttaagttctagggtacatgtgcacaacgtgcaggtttgttacatatgtatacatgtgccatgttggtttgctgcacccattaactcatcatttacgttaggtatatctcctaatgctatccctcccccttccccccaccccatgacaggccctggtgtgtgatgttccccaccctgtgtccaagtgttctcattgttcagttcccacctatgagtgagaacatgcggtgtttggttttctgtctttggcgatagtttgctcagaatgatggtttccagcttcatccatgtccctacaaaggacacgaactcatcctttttttatggctgcatagtattccgtggtgtatatgtgccacattttcttaatccagtctgtcattgatggacatttgggttggttccaagtctttgctattgtgaatagtgccgcaatgaacatacatgtgcatatgtctttatagccgcatgatttataatcctttgggtatatacccagtaatgggatggctgggtcaaatggtatttctagttctagatccttgaggaatcgccaaactgtcttccacaatgattgaactagtttacagtcccaccaatagtgtaaaagtgttcctatttagagtcattagtttcatattatttatacagttggggttcaaagcatactagttgatcagaactttttttttttttttttgagacggaatctcactctcttgcccaggctggagtgcagtggctcaatttcatttcactgtaacctccgccttccgggttcaagcgattctcctgcctcagcctcccaagtagctggattacaggagcgcgccactatgcccggctaatttttgtatttttaatagaaacggggtttcaccaccttggccaggttagtctcaaactcctgacctcaactgatccacctgcctcggcctcccaaagtgctgttattacaggcgtgagccaccacacatggcctagaacttttctcagagtgaataaaggcctgcattgctattatttgccaagctgataacacattttgtttgtttgtttgtttgtttttaggcagagttttgctcttgtcacccaggaagctggagtgcagtgtggcacgatctcagctcagtctcccaggttcaagcgattctctcctgcctcagcctcccgagtagctgagattacaagcatgtgccaccatgcccagctaattttatatttttaatagagatggggttttaccatgttggccaggctggtcttgaacttctgacctcaggtgatccacctgctttggccccccaaagaactgggattacaggcgtgagctaccacacccggcccaagctgataacactttaaaccttggttggacttggtagtgtcattacatatatgcaggtatccactcttgtctgtaagtgaatttcatgaactaagccaccctgttagggttgtgcaagatgaaaccatagtccaaagagatttccagggctatccactgtttcctcacttggtctgcctggcgttgctgtcatgtgtattcgtgtcctaatttttttctactgggttgagggttcttcggagaaggcatctttctcatctttgtctctcacatttcctagcatagtgctggccaaagggaccccccaagtggtttaactttatattcacttaactatggcaagggtggcttgatggcaacaccttcaaacatttttatccatatacatttgatctataaattggatcaagaatgctcagaaaaagaaataaacattaaaaaaataataaagtaggcaatgtggtgtcctggaaagaacactgaattgcagcaagaagatgtagctgtaaagctttggcactaacttctggagagaacttggtaaagtcacttgacttctctggttctccatctctccttttgaaaaatgaaggagagatgagatacttttttagatccttcccattagtgatgtgtgaggattacgtaatttaatattgccagagtttgtgcttactttacaaaaagcaagaaaaaacttcaggaataaacagattctaaagcagttcttctaaaatttggctacacattggaagcacatagtgagctacaaaacaaaacaaaacaaaaaaacgatgcctggatcctactcagagaatcggatctaagtaacctggagagtggtctgagtctggaattaaaaaaacaaaaaaaaaaacaaaactccccaggtgattttatgtggagccaaaaccactgttttaaaagttttccccattgtcttattcacaagtgatcaattactgggcagggcacaggtattactattttgaccctaaaaataaataggaaggctgactgttctaaagttgatgatgctatttcagatcttttcacacagatgtcacttgccctacaatattgttttgtcatgccacaacatgtgtttgtgtaaccgcacatgcatgtgtacgtggcttgtaaatctgtggggtaaattagatggcgctaaaaagtaattgaggattacaaattatctctaccggctgttgaatattttatgtcaattaaacatttgtaaaaaccaagtatagtattatgatctactcataactattagaagactggcacatctccatacagcaagagccattgctaaggctactgtactactctggcatgaatcataataaattgggatccccctggacataatgaacagtaatataattttgtagttatcctcctagcatgatgaagcagcaagccaaattgagtttctagataaattttgacatatgggtcttattcctaaagaaaaagagctattgttgctttggctttgttccagaattctgcagaaatccacatggtagcttattgttgtattacaaaaaggtactacaagtatttttttatgaaaaagaataaattgctaagttcaattagtcctttggggcagaatttggaatttcttttcagtcaggctgctgggtcgtatgtgaactattgtttgactcacacaggggctgtcctaaaggcctgtgagccataaggccaccgtgggggcttctagttgatggtggaaggatcaagcagccctctttgccacagcagcaaaaaatgatgttgacatcatttaaaaaaaaaattagccataggaaggaggttaagaagttgtggcagaattgaaacaaatctaggcctctcaactgacaagctgagaaccctgcttgacatttatgagtggatgcgtttgaggaattatgtaagaatagtaagttaaaggatgcttttaatttaaaaaattaagataacctgaaaacatacctgtaaaaacatttcagttgacacagtctcttatgcttataacaaggattactgttaatgtgtttttgcggagttgggctctgatctgtaaatatttctcagggagataagagtctatggttaaacagtcgtagtagtagtagcagaatttgggtgtcattgtatagccaaattcagaagcttgggggaaaagaatagctaccataggaaccagtatttcagaagcaagttctgcttgtgagagttatcagttgaccaagggattcctgtgtaggtttgtaaagagtgtcagatctggcattctcagtatggaattactggcatgatgcaatggaggaacaggaatttttctgcagctctttcagtagtattggtttggtgttgggttatccaaataatgctcagattgtcctaattaacattaattcatcccctctgttgggctcatgtgacatatgcaacccgaccatcagtcagtggcgtattaaaatgctctccacaggaccacagagcagtgggtgatctctgcatggacgtgatctttgttgagcaggaatactcatatttctgccctaagcacagagcaaccggctatcaactgggatagaaaaattatgttcattcaggagactactgaaacatcttgcttctctcccatgtcaatcctttgtaatagagtaagggaaaagtacatacacttttgagtaacagtttccatacaaatgctctgatgaaagtagggtcccatttggaggaagctcagttcagggctcagcttgttttctggaagcaaaagactgctattagacagagacagacatgggaaggatgagaattgaaataagataaaaagagaggattttccttgtcaggtttcttctgcagttatgtcttgtcctgtcacgtcctgctagcacaacttttggcagaatccaaaatttgggagccaaactagacattaacaatgtttcttcaacagctcagccatagaagctgatttcaaagttaacagtaactgctctctttggatcgagagtcattcattcattcagcagttatttatcgagtgcttacttagcactggggaaactggtgaatgaggtaaaatgctactcctgttcttatttacaagtaagtactggggaccaaggttaattgtttacttgcagttatgataagggtcgctcttagagcttataataaggagctctaactttgccaggggccagggtgggggtgggtgatcaaagcatgcaaccttgaggaagtaacagttgagcataaatctgaaggatgcactggagagcgagatgaaggagtagggcaaagtgttctaaacaatgggaagagcataggcaaagtcctgaaatgagcaaaacgagcaaaacaagctgagcctgaattgagcttcctccaaatgggaccctactttcatcagtgcatttgcttggaaactgttactcaaaagtttatgtgtgttgtgtcttttgccttagtctattacaagaacttacataggagagaagcaagatgtttccagaccctcctgaatgaacataatttttcaatcacagttggtagctgttgctctgagcttagggcagaaatatgagtattcctgctcagcaaacatcatgtccatgcagaggtcacccacagctctgtggtcctgtggagagcattttaatatgccactgactgatggctggactggatatgtcacataagcctgacaggtagcaaggagattggttttagaggaactgaaggtctaaaaaggccaccctggctgaagcaggtcagcataacaggagaggaaggagaaggggccagactgtgggtccatgagggcacctcatggacatggcaggggtttttgcctttatcctaaaaccaataggaagacattgaaagtacaaagctggggaagtgacatgtgcagcccctgcttacagagggcacaaaagactaaggttagaatagggtgtgggttctgagaggccctgtggaggctagtgcggaagcccagaccacagaacaggaacgagggagatggcagtggaagagaagtggaagcatgcaagctacatttccaagttacaagggtcaagtcttggcttagaagcaatggtggtggttgaaatgtcagtctctagggcagtgtcagaattccacctgatggctctggccatcacatctcagtttctggattgttcgggttaatgctagacaggtagagccccaaactaagtatgtgctctgagagactctgcctcatgaataaaaatcatgctgtcctgtgatttttattcatggaacaattgtacctagagacaactcaataggaaaactattaataactggtgataatatcatctcacttcttcaaaataaatgtttttcattttcaaaagttctaagttcagttacttgcaatatttctgcttacatggtaaaggtctataaatcaagatgcaaatatcatcggcttcttacagggtattatacgaatggcgattttctaggagttatttcactaaatttgcatatgtaatccaatggaatatattcattgcaaatgattctgaaaatcattttctttttttattttaaaaatgagtttttgtttaataaccttacattcccaatctgtgtactgttactattgtcattctccttcagtagtgctgtgaaatctcttccaactctcagattccatgattttcctttgtccctgcctctcttattatctttcattgcatctcttctctcagtgtcctgtctttctctctttgtggaggtagtagctggcatgatagatggaagttagaatgctgaggaagggtagttatcaagggaagcttgggccctagtcatcgccaatcctctttcctctatttcctctgtgcattagcttcaagtgcagtcattactcatttagtcctcaaataaaatgctctttgttgcaatgacaatttttttctagtataaggcaaaatggcatatcagtctgatgatgtggattttatagcaaccggcagattttatttgtgtaaggagtttttatagttgttggttaccttttttttaagttgccatttggatcaaggaggattttatttcttaactaggattattcctttatcggatattaacttagccttttttctctaaataccaaattcatagagatgctacatagttaatttttttctttgtaactagattatccccatatcaggtatttcataaagccaggataaatgtatttaacagaaaatatccatcttataagtaatgtttcccccaaatacaatgaggtccatttaaatgaatgtctgaaataaaaataatcctaatgatagatctaatgcactttgtatcagacccattgagtttctttaaactctattcaataaatgcctgattaataaataatcctgttaaatgaataaaaccccagtgtgccaaacggagacatacaaagcaatcatgatcagacttgttatgggagaatgatagatgaataaatctactgtgcaattaatttatgactgaactatgatgaaatcccagtggcaatactaaatctgttagaggaatagatttatcatcttctttcaaacaattacattccaggaactttacaaaaatactattatctgaatcttatcataatagagatatctgttcatttacatggggaagaattccttctgtgccgtcagagctaaattagtgtttattatttttgatgctaaccaaaacagaaacaatataggacagaaactactaatgtggttagctattcttatctgcttctgtttcttcaaacttgattaaaattgcctaatttttagacagtttttttgtttgaataattttactttttaaaagatgaaaagcaaacgaataaaaaacaggttataggctattttgaaagcaatctgtgttacttcataatgtggttacatgtaggttatgaaggcacaaatttggggaccatgttttaagaagatcattggggattggtagtatttcaggttattgttacatattttagcttcaaaagacagtcgactgtattttagtgctgtcgttcttttagacaggcacttattgataccaaaaaacaccacgaaaagtaaaaaggaaaacccaaaccacaagaaacattttgatttaaaggttagatagtctgaattcatgagaacttagattcagagcatggcaaggttaaaagaaattttattaggatcaagacacaaaccatgtttaatgcagtctttttgttttgggggaactagagctgatattttaaatctagtcgtttttaccaatgtaagggaatttaagagataaaatttgaatagaaaggtaagatttgtatagtgattacaaagatgtgacctttaacagagggttttgttgtgtttgttttccacataaaagaatgaagaatttgtgagggtgaggtaaaagagaaggggtctccttaaaacttgagagaaggaaagaatttgtcccattgtagcaatatttgaaaacaggttttattaaggttttaatatgtgttgaagtaaataattatgcaaattgaactagaaacttcttagtttaaatctagtctgctatttacagtgttagtagctggacatcatacttttttaaattaatgtaatattgataaatagcaatcctgtgtattctcttatttctcagacttaataacaaagactttataaatccacatatgtagtgggtttcagttgtttgcacgttattcatgaccaatattatgtacatagcattgttctaaggccttctttgatctgatcttgggtataaagaaacaaaaacaagccgggtgaggtggcctatgtttgtagtcccgggtgccctggagactgaggcaggaggattgcatgaactagggagttcgagaccagcctggtggcaacacagtgagaccctgtctctaaaaaataaaaattaaaaactaaaaaagagacaaaacaaataacagttattacttgcagagcttatacttgagatgatattaacatatgaaataacaaattcgaacactgacacatcactcatttgtgaactaccttcatgaattattaccaaaaatcctattttaaaatattttttatcatggtaaaacatatataatcttttacgtatcttaagtatacaattcagtggcactaagtatatttatgttgttgtgcaaccatcaccaccatccatctctagaactttttcatctccccagactgagactgtacccattaagcagtaattctacaatctccccttctcccagtccctggcagccaccattctacttttgtctctgtgaatttcttttttaaaaaatttaattcttttgtagagacaggttctccctgtgttgcccaggctggtcttaaactcctgggctcaagcaatcttcccatcatggcctcccaaagtgctgggattacaggcgtgagctgccatgcctaggctctatgaatttcatataagacgaatcatacagggtttgtcctttagtgaatgacttaattcacttgagataatggcatcaagattcatctgtgttgtaacgtgtcagaatttcattcctttttgaggctgaatattattctattgcatgtatatattaatactatattttgtcagtccatttattcattgatggacatttaggttatttccgtctgttggctgttacgagtaatgctgctgtggacacaggtgtacacatgtctgttggagtccctgctttaattttttggggtctatctctggaagtggaattggctgttatgagtaatgctgctatgttggctcttatgagtaatgctgctgtgttggctgttatgagtaacgctgctatggacacaggtgtacacatgtctactggagtccctgctttaattttttggggtctatctctggaagtggaattgctggatcatatggtaattttatgtttcattatttttaggaaccaccatagtgttttccacggtggctacatcgttttacattcccaccagcagagcacaagggttccaattgtatctcttgtggtttttgatttgcatttccctaatgattaggaatgttaatcttttcatgtgctgtttggccgtctatatcttagtaatagtaatcttttcgtgtgctgctattactgttagtaatagtaatcttttcatgtgctgctattagtaaaagtaatcttttcatgtgctgtttggccgtctatatcttagtaatagtaatcttttcatgtgctgctattactgttagtaatagtaatcttttcatatgctgctattagtaatagtaatcttttcatgtgctgtttggccatctgtatattttctttggagatatgtctatccaagttctttgtccagttttcaatcaggttttttgttgttgagttgtaggagttctttataatattatgagtagtaatgtcttgttagatatatgatttgcaaatattttctcccttcctataggttgctttttcactctgtttttttttagtgtatattatcttttatttacctatgtagtgactttaatcagtgctcattatttctttgtgtggattccattcattctgttgataatgtcttctgatggacaaaagtttttaattttgatgaagtttgattttttaattttcttactgcctgtgcttttggtgtcatatatagttttcattttgtagtttcctttaagtcttctggcttttgtgttttgttagggaggccatctacatcataagattataaaaatattctctgaaattttcttcaaatactattgtaatttttttaaacatttggttctataatctcatctggaatttagttttgtgtatgatgtgaggtaaaattccaaatttattttttctatgtggatattcatttgttcaaaccaaatgtattagtttattttttcttcactgttctgaaatacaacctctaccatatactgtatccacatatgtaagtatgtctatttctgaatactctattatgtctcactgatttgtgagtttctgctttaattattttatagttatgttttgatttctgatagggcaggtcccttctgattattctctgtaaattttttcttgagtgtttttatttattcttccagatgaacgtttgaatctacatattggatttttagaaatacagtagtatattacagtttacccaggatttgttttaatcaggtttggtaagacatgcagacgtggacataattatcatgaaggaaatgtttagacttatatatccctagaaacggctattatacaatgccactcagagccacatggggaagaccaagattgggcaagaggcagaaccagggagcatggcccagtgcctttattggggttttcacaggatcgaatgggtgaggtagggtaggtatgttgaataagtttaggattggagagtttgagtaattttggtgggctctgggttatagctgcggcccctaattatctgatatctagccctaggcagatttaggctggcaggaatattggcttggtgtgtgagagttagttacaggagatggttggggatgtgtggtctggattggttgacttaaatatcaaaggtgcacttgcaaagaaatcctttgtcttctctaggaattagctagccctgagaggggcaatctaagatgaagactccaaaatgccagagtatcaagaatacagggggaaaaaaaagtcaaaacaagctatgattttttttttttgactgaggttgcgttgacttatagagtaatttgataatgaaatgacatcattactacagagtgctcccatctaggaaaatgatatgtcttattaattaattaattaattaattgagatggagtctagctctgtctgccaggctagagtgcagtggcgcggtctcggctcacagcaacctccatctcccaggttcaagcaattctcctgcctcagccttccaagtagctgggactacaggcatgagccaccacgcccagctaactggctattttttcgtttttgtatttttagtagagaccaggttttaccctgttggccacactggtctcgaactcctgacctcaaatgatccacccaccttagcctcccaaagtgctgggattacattgtgagccaccatgcctggccatgtttctccttttatttattttttattttattttattttttgagacagagtctcactctgtcacccaggctggggtgcagtggcgcaatctcggctcactgcaacctccgtctcccggtttcaagtgattctcctgcctcggtctcctgagtagctggaattacaggcacataccaccactctcggctaatttttgtatttttagtagagatggggttttgtcatgttggccaggctgatcttgaactcccgacctcaagtcatcctcccacctcggtatcccaaaatgctgagattacaggcatgagccaccacgcccagcccttctccatttatttagatattcttttatattttcagtaacattgcatatttttcttcacataggtcttgcccattgttgttattcttataaatattcctaagatttttatcgctattctttttttctgtatggctttaccaaacatgacacccttacagatcttgttcaatattcaatcattcatttattttcccagaaaatatttgttgccaggtgcattggctcacgcctgtaatctcagcactatgggagactgaggtaggtggatctcttgagctcaggagtttgataccagccttggcaacatggcgaaaccccatctctctactaataatgcaaaaattagcttggcattagtaccagctattcaggaggctgaggtgggaggattgcttgagcttcggaggtcaagactgcagtcagccatgtaactgcaccactacactccagtctcggtgacggtgagaccctgtctcaaaaaaatttaaaaaattgttaagtgcttgtaaagtatgagtgagactctaaggtagccactaggcagtccccttcctagtgacttattatatcctgatctgggaaatgttgaacatagagagggcacaggtggtgaaactggtctcagagaagttgagaaaacatgggttcaagaacgcaggtgggaggctgggtgcagtggctcacgcctgcaatcccagcactttgggaggccgaggtgggcagatcacctgaggtcaggagttcgagaccagcctggctaacatggtgaaaccccatttctattaaaaatacaataaattagccaggcgtggtggcacatgcctgtaatcccagctactcaggaggctgaggcaggagaattgcttgaacccaggaagcagaggttgcagtgagccgagattgcgtcattgcactccagcttgggcaacaagagtgaaactctgtctaaaaaaaaaaaaaaaaaaagaaaagaaaaagaaagaacacaggtgggagaaaggagaaacagaagcaaaggaagacacagggaatctgaagtagagtatagaagttgtgagacatagtgttcagtagcctcaatatatttcaataacttgggaagcagtcatctgctaaaaatgagagggcagggacaagtcttcctggtggagaataatttgttgtaataaaagcagcttgttagattacatgagggtccagcgtgaatgtgatcagtggtcaaagtcaatgtgattttgtgacttacactgatagcattcagcaaccacaggagtaggtgaggacagtgtggttggtgagattattcaggtctgaggagtggcatgttaggattagtgagagaaaggtcaaaaataaaagtaagtgtgctgtggaggctagagtgctaccatttgctcagaaatagcctcacttgcacagttttaaaaatgcaactcaaaagataattattgacaattaaatagccccatggcttcaacactaatcataacaaaacaaaaatactgcaaggaatgttcattcattccatttttgtggaaagaatacctgtgttagatgctggaactgttttcaaggagctcatttctaaaaaatttactttcttggaccatttatccaaagaagaaatgccgtttcttcaaagatgtgtgtttttcaaatctgcactatcttctgtaagcattctggttaaataattccccaggataggaaagtcactttgatgctggttgtacaagggaaatgccatgaattcccagatgcttttaaaatacaggtgggttataaagacaaaggtgatgcaacttgttgaatgtctcatttttaaattataactttcaaaggagtgaaggacttgccatcccaaaatatgtcaaactggcatattaattattttgaaaacattggagaaattgtagtttcagaaaggggtagctgacctgcatgcagcaagccataaagcttcttctgtggctcatgcctgtaatctcagcacttcgggaggccaaggcaggaagatcgtttaagtttaggcattagagaccagcctaggcaacatgatgagaccccatctctacaaaaaatatggaaattagccaggtgtggtagtacatgcctatagtggcagctacctgggaggctgagatgggaggatcatctgagtctgagaggtccaggctgcagtgatctatgatcacaccactgcactccagcctgagagacagagtgagaccctgtctcaaaaaaaatgaaagaaagaaaggacggggagggggagagagagggagagggagagggagacagagagggagagggagacggagagggagagggagatggagagggagaatattcctttggacgagatcctccctttactagagccaggaaatagctcttatcaaccagaggctgggaacagggggctgcagtggacccaattaaatatattttccaaagtaacccttatcttctactagttttacaccccgcttgtatctcctagtgactcccctaggaatttattgcccgtagacagatcgcctttgtcctatcatttcttcttaagtttattattcttcatccaaaaagtataaaagcatcttgctttggccacttcttcagacttcactctcttgtgaagatccccatgtacatgtaaaactaataaaatgtgtatgcttttctcttgtaaatctgccttgtgtcaatttggtttctagatccagctgaagggcccacatgagagctcaggcgggttggaggtgatctctcattacctacacgttatataaattcagcataggaataatggttgagggtaaattaacattgttaaaaagaatacaccgtaacataaagtactttaacatttataatatgagaccatttattaaagaaaataccattatataataatgaggctaataatttcatatggaaataatactgtattaattcgatgtattcatactaacagtgaacatgatattttaaattttgctgtcacataattatgctgctgctttatgaaatgttatactgtcacctagaaaaacccttatttgagtgtagatctgcgatcttcagcctcatatggcaggttgtaatgtgttactgaggtatttttaagtgaagaggtgggaaaaactcctggctgagtcataaaactgaggattctttctttcctaatctgcctggagcaaagctgtctaggctaacactggcctttagcaaagaactgaaacactttcctagttctacaaggcaaattgggtaatgggatgtggtattgggtaatgggatgtggtgttaagtttggaatgaggagatatcttagggttgtgagtcatggtccgtattatttttaagttgttgcttaaaaataaaaaagcaacaaaaagcaatcaaagggaaagtgagagttagaagaagttgaagaccaaataattttgtactagtcagtaaatagtagtattgtgactacaaatgactatttggtacaggcatcttaactcctcagctctgttagcactgattaaaagtgaaaaagttgattcattgtgtattggaataaataatgtctcaaagtttacgcagtggtggaagtgaaaccaaaatacaaagctccatttgtgactgaagtttgctaacatttcaagaagtaggttgaagtgacagtgggtaataggaaaagcagacatatttctttgccatgagattttatagctgtcattggcagtgtgttttcttaaactgatatcagctaccatttatacacttaacaatttctggtcagattagggcagaaggttgtggtacccacatatataaaatagtataataatgttctattttttttttggaacaaatttgttacatgaaatgtcagatgagtcattttgctcatgtcaggtatttaaaagtaatggaaagatgccaacatggaagcccagtaattcatgcgctggtgtaatggagcaaatgaaatgcaaagctcttgtacaggtccaatttcagcaccaaacgcttacctgtcagtcagcaaaattgtccctgaataaaaatgaaccccatctgagaggcaaagcattttaatgtacatcacattctttgactctattgcgaggtagaagctgcatggaaagaaagagaatgctgttgaaaaagacatttaacagcaacctctgagcatgctgaaaatctcactcgcattactgcccacaaaaggtttttggtttgccctttctctcctgagctattgacaaactcttgagcattgctgccctccccggctctgtgtctcttatctacatggaaaggcagctgatttactccagacagtgagagatttggccactcagggatgtggagaccaagttttagacaggtaactttattgctgcctgggtgcagctgggggatgtatttatggacgtgacaattaaaagtgtgtgttgcacaaatcgaaagtcagacatacccttgtataaatgattattgtggtccaaagtgactgccatttcttttggaaagcctttcatttggaatcagttcccagttttctatatgagcaagcatcttacagaaatgaggtgtcctagttttttttagacccaattcctgtggtttttaaaaagcaaatgggaaagttaagaatttgtgtgcttcagtgcccacgcacccagggattcttgtaccctacctctaggagtcatgatttgttctacctttgaaatgtctgttttccatttctgtgttttaagactctaagtgcttataggaacccaagcagctattgaaaaccagtaatgactagttcttctaaatgctaatgattgagaatgaactagcaatcagggctcaaaaataaaataaaataaaataaagtaaaataaaataaagtgtgctgaattagaaacgataataattaaatcaagccaaggtgccctatacttatgactgcactaatgcttgaaaaattatgagtacagagaaaatttacataaatcctctttaaatgatgtatgtgaaaaaaaagaaagaaggaaaaaccatggtcacaggactgaatttattttaatcccctggttcaagtggtcctagaaataatcatacttgtatcaatctatattgcatgacttttgtaagatgtgaaaatagtgtttttcactaaattgtcacttattattgttcatttagggccactaacatagaaaaatttctcagctacagtgtcaaaagaatagggacaatttgatgttttcttttgatgctgtttgttgatatctagaccactgtagcttgattgcctaacattaaacctataataacagtgcaatcatagcagtatcatcatgaatgttgttacaatagaaacaacatttacacggcttcagaatggtaattatcaaactttttgtcatgaagcgcttatttgctagcattgatctgccccggtcagttgttagctcttctcatctgaggtgtattgattgtataatcagtagatagaggctgtgggcagatgaaattcagtgttgttgggcaaattatcggctgcttgcctgttgacctggaccctgctggttgtaccttagatgctggtgggattattactcatttcagtgaccctactttatgacagagcactctgtattattataaaagataaatgccatcctgcttgctgtggttgtggttgactacacaaatgtcagaatatagctagtctgcaaactaggcagtgcaagtatgtttccgatgagatcaaaaggagaaattttcaaagattaccttttctgaatttgtctctttgtaagaatgtaataacaaaaagcctatgtgtatctagctgatgataataatgaaacctttatgtatatagctgtttatcatgtgctaaggattatgacaaatcacttaatattttgttttaccagcaagaacactgaagccgacattaagctaagcaaatgggctaagatcacatgtcaatgagcagtagagcttggaattaaatctgtttcttctgaatacaagtcaagtttgttatattctactgctctgtcttattaggttatccaggctgaccattaaatatgtgtatactgacagatctaaggtttcatccaactggattaaaaaataaagacctcaatgttacttaaataaattattgcattgggtaatttttgagactatttgagctattaaataattataacattccaaagcccaaggtctaacatgggattacttttatagacaaaatcattttatataaagagcactgtaaattttatagctggtggctgtttttaaaaaatctagatggtttttgccgggcgtggtggctcacgcctgtaatcccagcactttgggaggctgaggcgggtggatcacaaagtcaggagttcgagaccagcctggccaatatggtgaaaccccatctctactaaaagtacacatattagccaggcgtggtgccgcgcgcctgtagtcccagctatttgggaggctgaggcagatgaatcgcttgaaccatggaggcagaggttgcagtgagccaagatcgtgccgctgcactccaggctgggcaacaaagcgagactccgtctcaaaaacaaaaacaaaaactagatggttttaacagaatgttttgtttatatgaaaaaattctcaaacgttatttatgttaccatgtcctattttccttgtactttaggatcattctatccatcgtaggtaagtacaggatggcatcacatcctaatacctaaaccgggcctttctgaaactacatggaagaacagaaagaatgtctttagtctattttgacatttagattgcttcacaaatacatatatgtgaacttgacagtgttcacagtgtcatttttgctctttctctctgaaaagaaaagagcataaaaaggatgtacctcactaacagtgcaatgccataaaaatattaatgttttggtgctgatcattcaaattcccaaatagtaaaatagatgaagcgatacttaaacataattctccatttctaaatgcactcagttgtgcctggtaagctgtctcattctttctgccaacttctgggccattgttttataaaggtcagtggttacctgctcattgtattttaaaggcacactcacagcacatagtccaataagcaagtccagcaataccacattcctctttggtcttaaattctgcagctgttgaatcatgattgggcaatgattttttttcctcctagttaactactttatgttcttacttttaaaagactaagtgactgatctcttacccaaaatgttggaggagataatgggtggagtacatgaaagttacatgcagaggtggcttagagttgagatatttagtagtttccctctctgtgaataccagaaaacacagctgtttgagtactcccttaacattgcttacctaagcaggggaaataactaagaaagtgactcccagtttctagcattgtaagcttttcgagagaagcctaaatttgtgtgtatattcctttcctttatcttttggctgctgaaatacatactatcagcatagtatttcaacaaaaatgatgatcttttttggaaattcgaattgttctgatactccccacaaaaaacccttaaaatacatataatacataatagtcattatttgggtattgatcctattatactgttagctcttcacatctgacctattttagtatttcctgcattgctcactactatgctttgtgtatagaaggagctttattgattaaaatggactggatattcattcaacaagtatctattggatgcctactagctatgaggcatggtgggagccatcagatacagtaatcaatgagcaagacacacacacagtccctgctctcaaagagctcatgatgagaaagatgtaagacaggcattaagtgaccagttacataatttttaatgcaagttttaccttaatattatatgcttaaataaaattcaggatgttagaggattcttcaataagaaatcagatcaagtttatgcttctccaggacagggacctttaaaaatcaacacttaaaactcaattttttgcacttaaaaataaaatgaggctgaggaccatggctcaccctataatcccagcactttgggaggctgagacaagaaggtttcttaagaccaggagtttgagaccagcttaggctggtctcatagggagattctgtctctacaaaaaataaaaaaatagctgggcatggtggcacacgcctgtagtcctagctacttgggagggtgagggggaaggatggcttgagcccagaagttcaaggctgcagtgagctatgtttgagccacagcaccgcatcctgggcaacagatcaagaccctgtctctgaaaagaagaaagaaagaaaaaagaaggaaggaaggagacaaaaaataaaatgcacacattgcaagtgtacatttcaatgaatttagacaagtgtatacaaatatccatatgtgagtgaataggtagagatgagtatatatgtatgtataagcatatacatatataactgtatacatacccacacatcccctcattcaacatacaggatatttacatgacccagaaagcttcctttgtgctctttccttgagtacaactcatcattttccccaggctcctggattgtttttcgagtttcagataaatgaaatcacatagtatgtactctgtgtctgacttcttttgctcagcctgatgtttctgagatccatccatgttcttatgtgtatcactggtgttttccttattattactgattagcattttattttatagatacaccacaatttatttattcatttatccactgactgacaaaaataaaccttaatttattgctcataaggtaagatgaaagaagtggtacatttttatttatgagctgtgaaaatgtactagaggacctgggatattaccttatattcaccacatatgaatagtgttggcccacactgaagtaatttttatccccaaatgagctataaagacatgtcccacctgaaaaaacagtttcattgataatttatggataatataaaatgcttcctaagttgttgagtagaatgctgaactaacaggtaaaacactaaaattaatctgattctgtgtattgtgggctacttacagaatgcaacaattatttttggaattcaaattcaagtcaaaaaatatttatgaatgtctgctatacataaagcatggtattcagttctataaggcaatagaagataagcaagatggagttccttccttggaggtctagtggcctaaagtgggaaattgggtgtctgcatgaaataattaaaaaaaatagtaggccgggtgcggtggctcacacctgtaatcccagcactttgggaggctgaagcgggtggatcacgaggtcaggagatcaagactatcctggctaacgtggtgaaaccctgtctctactaaaaatacaaaaaaattatccgggcgtggtggtgggcgcctgtagtcccagctacttgggaggctgaggcaggagaatgacatgaacccacgaggcggaggttgcagtgagccgagatcgcaccactgcactccagcctgggtgacagagcgagactccgtctgaaaaaaaaaaaaatgtaaaaaggcttgttgattaaaccaaagtagttttagtgcccagctttttaaaaggggagtaaattatacctcctataagccagtcaagttaattttgatacctttaaagattctgcactagatgaaatcattgaacaatcaattagtcaccacataggagagcatgaagcactgggtagtcactgtcttggctttgcaaagagcaaattgtaccagatcgatttaatttccttcatgaagagattgacagtttatacatacatttaggaagcaattcagctgaacttcagaaaggattttgattcagccacacatgacattttagcactaactcaaaggatgtggtgtaggccagaccatattcctgtaggaagtggcctgcttctctggggggttatatttgaaaagtgttatgaagggcttagtgtcaaccatgaatcttgttttataaatacatatccaaatgctggagttattctgaatttctgtgtcatgcataaataattgaaaataaactcatatgttggcaaaggaaaaccttgatatgagtactctggaagattgttatagattaaatgaaatgatcttaaaccataaaagtgacaattgtgtactttatgaagggctgtaagatcaagttcaagtaacatgctatggtgatcctacgctttaccaaagatagatggaagatgggaacagctaggccataaataagacaagagacttaggagtcatagtggaattcaatccatatattgctgatcaattctgtgttattatttataaacaatgcataattttagagtgtgtaaaggggaatatgatttgcaagcatatggagcccaaaggtcgttactctgcaatagtcaattttaatcacaactctcagactgttctaattttacactacagggaagctagagggtccagagaaaaacattctaaatatacaagaagataaataaatgtttctttaaagttcagactagagaagagagaccactcttcaaatcgtacagaggtatgtacagaggtacgatttgcctattctgtttggaaacagaataggcagccttctgcccaaggtggcataggtgttaaaggcttggtttagtttaagggttccaaaatctgatagggtttcaggatcacttggatagaattttttgaaacacagctttattgaagtataattgatttgctatacattgcacgtatctcaagtgtacaatttgataagttttaacatatgtatatatatatatatgttaaaaggattccctatttaatgaaactattaccacaatcaaaataatgaacatatttatcacccccaaaagttttcccctgctcttttgtagtccttcctacccttccctaggcaaatattatctgctttctctcactatagattcattttcattttctagcatttatgtaaatagaagcaaacaaattgtattctttttcatcaggcttctttcactcagcataactattttgagcatgctttcactcagcataattatttatatttaattcttgcatattgtagtgtgtttgagtcttccattccttttttattgctgagtagtattctgttgtgtgcagttatatgcagtatatttatccatttatccattgatggacatttgggttgtttccagctttgggttattatatataaagctgttgtgacatttatgtagaatcttttatttagacatatgctcttatttttctagagtaaatacataggagtagaaatgcttagatcatgtggtaggtatatgtttaacttttaaagaaactgccaaactgttttccagaggggtggttctattttacattgccagcagcagcatgggaaaggtctgtcaacacttggttggtgagtcctttccattttagtcattctagtagatgtattagaatctcattgtggttttaatttaaacttctcaaatgatcatcttttcattgcttatttgtcatctatgtatcttctttggttgagtgtgtattcaggattttttttgcccactgttaaatttgataatttgttttcttgttattgaattttgagaattctttattctgaatacaagtcctttagcagattctgatgagaactgcattgaatcaatagcttaatttgggaagaagtgacttcttaacaatactgagtcttctaatcaatggacatggcagattttgctgttattttaaattttaaacttctttcagcaatattttgcaattttcaaagtacaggttttacatatcttttgtcagatttacccctaagaattgtatattttttaatgctattgtaaattttatttaaaaaatttttagctctccctctccctccccctccccctccccctgtccctctccctctccgtctccctctctctccacggtctccttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttccttttttttttttggtggagacggggttttgctgtgttggccgggctggtctcagctcctgaccgcgagtgatccgccagcctcggcctcccgaggtgctgggattgcagacggagtctcgttcactcagtgctcaatggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggtcccccatcgtctgggatatgaggagcctctctgcctggctgcccagtctggaaagtgaggagcgtctctgcccggccgccatcccatctaggaagcgaggagcgcctcttccccgccgcccatcgtctgagatgtggggagcgcctctgccccgccgccctgtctgggatgtgaggagcacctctgctgggccgcaaccctgtctgggatgtgaggagcgcctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggagggggggggtcagccccccgcccggccagccgccccgtccgggaggggaggggctcctctgcccggccgcgcctactgggaagtgaggagcccctctgcccggccagccgccccgtccgggaggggggggtcaggcccctgcccggccagccgccccgtccggagggaggtgggggggtcagactccctcccggccggccgccccgtccgggaggtgaggggcgcctctgcccggccgcccctaccgggaagtgaggacccctctgcccggccagccgccccgtccaggagggaggtggggggtcagccccccgcccggccagccgcccagtccgggagggaggtggggggtcagccccccgcccggccagccgcccagtccgggagggaggtggggggatcagccccccgcctggccagccgccccgtccgggaggtgaggggcgcctctgcccggctgcccctactgggaagtgaggaccccactgcccggccagccgccccgtccgggagggaggtggggggggtcagccccccgcccggccagccgcccagtccgggagggaggtggggggtcagcccccgacccggccatccgccccgtccgggagggaggtggggggatcagccccccgcctggccagccgccccgtccgggaggtgaggggcgcctctgcccggctgcccattctgggagggaggtgggggggtcagccccccgcccggccggccgccccatccgggaggtgaggggcgcctctgcccggccgcccctactgggaagtgaggagcccctctgcctggcgagccgccccgtctgggagggtggtgggggggtcagccccccgcctggccagccgccctatccaggaggtgaggggcgcctctgcccggccgcccctactgggaagtgaggagcccctctgcctggccagccgccccgtccgggagggtggtgggggggtcagccccccgcctggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttacatggattaaaggcggtgcaagatgtgctttgttaaacagatgcttgaagtcagcatgctcgttaagagtcgtgtcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaagaaaaaaaaaaaagaacgaaaaaaaaaaaattttaatttccaatagtttgttgctggtatatagaaatacaactgttatttgtgtattgaccttgtgtcctgcaacctcactcaacatacttgttagttctagtcagttttctgtacattccatcaaattttccacatggacggtcatgttgtctgctaatattgacattcctttcccatctagatgccttttatttcttttcttcccatactgcattggctagaacctctagtatagtgtttaatagaagcagcaacagagaatatctatgtctatgggggatattggtctgtagtcttctctttgtctttgtctggtttttgtattggagtaatgctttcttcattaagtaagtcagaaaatattcttccttttcagttttctcaaagagtttgagaaagaattggtgttatttctccttcaatatttggtagaattcaccagtaagccagctaggcctagaattttctttgtgggaaagtttttaaactacaaatttctgactttttaatgattgccattctatctggcgtgagatggtatctcattgtggttttgatttgcatttctctgatggccagtgatggtgagcattttttcatgtgttttttggctgcataaatgtcttcctttgagaagtgtctgttcatgtccttcacccactttttgatggggttgtttgtttttttcttgcaaatttgagttcattgtatattctggatattagccctttgtcagatgagtaggttgtgaaaattttctcccattttatgggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggagtcctttccccattgcttatttttctcaggtttgtcaaagatcagatagttgtagatatgtggcgttatttctgagggctgtgtcctgttccattgatctatatctctgttttggtaccagtaccgtgctgttttggttactgtagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggttggcattgaatctataaattaccttgggcagtatgaccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagtaaagacttggaaccaacccaaatgtccaacagtgatagactggattaagaaaatgtggcacatatacaccatggaatactatgcagccataaaaaatgatgagttcatgtcctttgtaggaacatggatgaaattggaaatcatcattctcagtaaagtatcacaagaacaaaaaaccaaacaccgcatattctcactcataggtgggaattgagcaatgagaacacatggacacaggaaggggaacatcacactctggggactgttgtggggtggggggaagggggagggatagcattaggagatacacctaatgctaaatgacgagttaatgggtgcagcacaccagcatggcacatgtatacatatgtaactaacctgaatattgtgcacatgtaccctaaaacttaaagtataataataataataaataaataaataaactacgaattcattttttttatgggtactgcaatattcaggttatttcttcttgaataatctttgatagttggtgtctttcaaagaacttgtgccttccatttcatctaagttgtcaaacttactggcataatgttatttataattttcctttattatctttttaccatctatagaatctatagtgatgccatctttcttatttcttacattggtcatttttgtcttttctatagctgtcttggttatcagattaatggtcctcagtgcttgggttcaagtaacccttattttacttaataatggccccaaagtgcaagaccaacgatgctggcatattgttataattgttctgttttattatgttattattgttaatctcttatactatgcctaatttttaaagtaaactttatcataggtatgtaagtataggaaaaaacatagtatatacagggttcagtcctatctgcgatttcaggcatccactaggaccttggcttgtatcccccaaggataagggaggactactgtactttgtgatcagagaacatattttgcatggcttaaatctttttaagtgtattgttttgtggcctagaatatggtctagcttggtaaagcttcaactggcatttcagaatactgtattcagctctattgggtggtgtgttctataaatgtcaattaagttggttggtaatgttattcaagccttctatgtccttactggtttctgtatacttgttatatcaattataacatgttaaaatctctgactataatgataagtatttataataaatattcttgagttttgttttgtgaagcagatgtgttactgggaaacagcttgatcctttcagatcttgcttttaagatttgttaggtgggaccagcaatatttatgtagggcaaatttttccacaccactgaggcaaaactcttttgtgtactcaactcaatgttcaatgcattaagaagtttttcttgtcagactggcagaaacatgcacaatttccagttctttgtgaacactggatactatttcctttaatcctttctgataggtctttccctggcctcctgtagttttctcagatacatgtgcttatcaatactctgatgaatactcaaagggaggcatttttcagatatgctgggttctaactctttgcagctctgtactctctgatactctgtcctttgaactctagccacattgttttttccagactttcaactctggtactctgcagggctccatttgggttccctgtcccaatgccacagcccggaatctctcttaaacttgagataattgttggactcactcacctcatttgtattctgtctcccagggataactgtccttcctgcctcctgcccactgtcttgaataccatagtttcatttattatatttgatttgtagttgttttaggtgagggagtaaatctagtcactgttgctccaacttgaataaaagcagaagtctccctggggaatttttgaaaaagacaacttcctttttttttttttttttgaggcggaattttgatctttttgcccaggctggagtgcaatggcgtgatctcagctcaccacaacctctgcctcccgggttcaagcgattctcctgcctcagcctcccaagtagctgggactacaggcatgtaccaccacgcctggctaatttggtatttttagtagggatggggtttctctgtgttggtcaggctggtctcgaactccccacctcaggtgatctgcccacctcagcctccaaaagtgctgggattacaggcgtgagccaccatgcctggcaattgctacaaagagaataaaatacctaggaatacaacttacaagggttgtgaaggacctctgcaaggagaactacaaatcactgctcaaggaaatgagaggacacaaacaaatggaaaaacattccatgctcatggataggaagagtcaatattgtgaaaatggccatactgcccgaagtaatttataaattcaatgctatccccatcaagctaccattgactttcttcacagaattggaaaaaactactttaaatttcatatggaaccaaaaaagagcccgtatagccaagacaatcctaagcaaaaagaacaaagctggaagcatcacgctacctgacttcaaactacgctacaaggctgcagtaaccaaaacagcatggtactggtaccaaaacagatatatagaccaatggaacaaaacagaggcctcagaaataacaccacacatctaaaaccatctgatctttgacaaacctgacagaaacaagcaatggggaaaggattccctatttaataaatggtgctgggaaaactggctagccatatgcaggaagctgaaactggatcccttccttacaccttagacaaaaattaactcaagatggattaaagacttaaatgtaagacctaaaaccataaaaaccctagaagaaaacctaggcaatgccattcaggacataggcatgggcaaagactttatgactaaaacaccaaaagcaatggcaacaaaatccaaaattgacaagtgggatctaattaaatgaaagagcttctgcacagcaaaagaaactatcatcagagtgaacaggcaacctacaaaatgggagaaaacttttgcaatctatccatctgacaaaggggtgatatccagaatctacaaagaacttaaatttacaagaaaaaaacaaccccatcaaaaagtgggtgaaggatatgaacggacgcctgtcaaaagaagacgtttatgcagccagcaaacatgaaaaaagctcatcatcactgttcattagagaaatgcaaatcaaaaccgcaatgagataccatctcatgccagttagaatggtgatcattaaaaagtcaggaaacaacagatgctggagaggatgtggagaaataggaacacttttacactgttggtgggagggtaaattagttcaaccattgtggaagacagtgtggcaattcaccaaggatctggtactagaaataccatttgacccagcaatcccgttactgggtatatacccaaaggattataaatgaactcccgaccgcaggtgatctgcccgcctcagcgtccaaagtgctgggattacaggcgtgagccaccatgcctggcaattgctacaaagagaataaaatacctaggaatacaacttataaggacctcttcaaggagagctacaaaccactgctcaaggaaataaaagaggacacaaacaaatggaaaaacattgcatgctcatggataggaagaatcaatattgtgaaaatgaccatactgcccaaagtaatttatagattcagtgctatccccatgaagctaccattgactttcttcacagaattggaaaaagctactttaaagtttaaaaaactactataaagacacatgcacatgtatgtttattgcggcactgttcacaatagcaaagacttggaaccaacctaaatgcccatgaatcatagactggataaatgaaatgtggcacatatacaccatggaatagtatgcagctgtaaaaaaggatgaattcatgtcctttgcagggacatggatgaagctggaaaccatcattctcagcaaactaacacaagaagagaaaaccaaacactgcatgttctcactcgtaagtgggagctgaacaatgagaacacatgaacatggggctgggggggcatcacacactggggcctgatgggaggtgggggactgggggaggagtagcattaggagaaatacctaatgtagatgatgggttgatgggtgcagcaaaccaccatggcacgtatatacctatgtaacaaacctgcatgttctgcacatgtaccccagaacttataatttaaaaaaaaaaaaagaaagaaaaagacgaattcttggctggacacagtggctcacacctgtaatccaagcactttgggaggacgaggtaggtggatcacttcaggtcaggagttcgagaccagcctggccaacatggtgaaaccctgtctctaccaaaaaatacaaaaattagctggcgtggtggtatgtgcctgtagtcccagctacttgggaggctgagatgggagaattgcttaaaccctggaggcggaggttgcaatgaactaaacatgtgccactgcactccaggctgggtaacagagcgagactctgtctcaaaaaaagaaaaaagaaaaaaaagaaaagaaagaaaaagacaaattcttacatccatcacagacctactgaaacccagtctgtggatgaatccagaaatctctaacaagccccccatctgattctgtagtacacacattttagaaccactgatttgatcaaatgtaatctcttaaagtccagtccaattcatcaagcagccaaggcagtggcatctctcaagagacaatgaggtcatgatcagtttctcagtttcaactttgaattgtgcttgcatcatcacagacctacaccagtgaaccgtggaaatctcaccccgagaaaatcccaggcaaaaaactctgtcaggagactactggttataaaaattctaaggtttactcagtcattaaaattatgcatatataatagattcctttctattttcattgccaacagaaaattgaacatttgcttcaaccttcatgaaatcaaaacttagagaaaaacgatctttttataaggaaaatgagttattccatgttactaattagatcttagctgttaaattttggaatgattaaaatccttttcaataattgcaaaatttgctttgataaagtcaccctagaagttgattatgcagtgtagtttcaagttcgtcatgttgtcttcttggggacagctttctgtctgggggtgtcagtagtggcaatcccctaagtgcatgatggttgttgggttgatgtagccacaaaagatttgataaactgtgatatgactgcttttatacaggtccaacttccacatagactagttaactctctatataactaagttccgtccttggcagatggattaatttgtgaataatgaatttcccttagctacctccatacttccattttggtttactaaatatagaatcatttaagaaatctgtccataattatttccagtgaatccacaattaataataacatcagccagtgatataccaacttacacagggagcatgtcacattctgaactctttgtcaatcctaatttacattccagtgaaaatgtggtagatggtgtgtaagtatgcatattataatccctttagctcagaggttcttaacccttgctgtgtcatgagcccctttggtatcttgtgattctgcttatggatcccttctcaaaataatgttacaagtgtgttaaataaaatccaaaaagcaattacattgaaatacagttatcaaaatatgtttaaaatacaattgtggtatagtaacatatatgcttccttattattttttgtttgtttgtttgtttgtctgttttgagatggagtcttgctcttcacctgggctggagtgcagtggtgcgatctcagctcactgcaaccttcacctccctggttcaagcgattctcctgcctcagcctcctgagtagctgggattacaggcatgcaccaccaccctgggctaatttttgtgtttttagtagagacggggtttcaccatgttggtcaggctggtctcgaactcctgaccttttgatccacctgcctcggcctcccaaattgctgggattacaggtgtgagccaccgcacccagcctatgcttccttattaatgccataaaataataagatctagttgtagctctaataatgattataatttttcattaagaatgagctactaaatatcatttccaaacaaacaatgacaaaaattataatgttagatgaaaatattactgttcatagcctacacttgtaatataaggaaatgctaaatttggttagtttagtaaaaataagaatattttttccttgcaagttcatggaccccctgaattctttctatgaatcctaagaacctctgccttccttctgttaatttttaatgaaaatttagattttagtcacaaaaaccaagttatgcaaaaatagattatgaaggaatatgggagaaaagaaatgaagttccagttttctcgtggaattggttgaaaggctttattcaacattaagatatatacactgtgcattttttttactttccattacttcctgctggaattagcattgtcctcttcaatgagtcactaatgaacagcctgacaagtatgacttaatcatacagcacttttagtctatgaaacctacttagaatgttagcacaaagtagaaatacaatgattaaaggagaaacttatatactataatgaaatcttagctcagaagaacctaatttgcagcaagcttaggacctttaaaatcagaagtcctttgggtcttgtcttagcaacttacttgttaaaggctctgggtggggaggtggttgtgaggcgatataagaaaatgaaaagaaggaataaataaagtcatggtttcacaatgtgaagttcaaaaaggctatataccatcacaggtgttcagtacatataccaaacctcatatttacaagttgctaactggaattgcatgattagattgagtaatcacacgtgtcggtaaaaagctgtaattacctaagaaaagcatagcatttttgtctgtgcagggctcacctatttcgtatgtctttaaaactttgaccaattataaatcttttagcaaggtagagagtaaaatcctatattttctgtggatgttgacacatgtaagttcctgatcattatttattaaacaattagctttaacatgtaagatggaatgggaaaaacatttaaacctaatgtgaattgcctaggtatgagaagccttagaactttgttagaaatttctgttttccatttctcaaatactgtgaccataactcatagtttatttataaatagaaagtgacacttcataatacctggcagctttcaaaactagattatatctgtctttgcctgaagggctccagtaacactattgtacaatattttcttctgaccatctggcagttcttaggaaccaacctctgtcaacattttatagctactgcactggttacagctaatcctttcaatgaatgagctggaaaaaatgtagatacatcaatatcgttttcctttagagcccatttaatacatgccctgttattattttgtttgatagggccattatcttctgtgagaatgaaaagtaatttgtcagaagcatttttttaaatttaaagatcaatctatgtaaatttttcttaaataaaagaaaccacagctttttaaaaaaagaacctcaaacataatcattaagagtctcagaaatgggaacttagggcttagattccacaaacatttttagctattattttctaatctgggttctaacatgtttagtctaataaccaagcctggattgggctatttctgagaggattttatgttaacagtggagttgacaccttggcaaggtttaaaaaaaaaaaaaaagtgtatgtttctcttgttgtttgctttaagaaactaggaagcaattcattccaatgtgggaatttttatgaatttttcttcaaaacgatttggtactctatggactttgaataactaatgattttaaagtactttattttgcagtttatgaataaaagttgtggaaactttccaatgttctcattctaacctatctttacttcataaaaacccatgttggttgaataattttcttagaaaggctgttagttatttctgtattctgaaatttacatttatcattgaattgaaatgggaaaagatattgatctttttttcagattcagagtttaaaactctgctcataataacagatgataaaagagattctcctcagcttcaccattccattacataccaccactatcatgagaccaagatttttttttttatttttgatttttgtgacagagtgtcgctctgttgcccagtctggagtccagtggcaccatcatagctcactacaccctcaaactcctgggctcaggtgatcctcccacctcagccttccgagtagctgggactacaggtgcacaccagcacacccagctaatttttgtatttttggtagagagacagggttttgccatgttgctaaggctggtttcaaactcctgggctcaagccatccttcgacctcagcctcccaagcactgggattacagatgtaagccatggtgcctggccaagatcaagtttttgacagaaaccttttctctgtaaatgttttgcactttcatatttaggtacctcaacttgggcaaggttgttcagttaacatatacagatacagacacacacgcatatgtgtctgtgcacacaaactgttcctaggttgttagatgaaattggtttgttattcctatagttttttggtatcaaaattaatgtttaaaatttctttagagagttttatggtgacttttagaaaatgttttccctttcttttctatcagatggagattaaaactactacaattatagtacaatgttgagtagactcgggaatttatgtaagatgtggctaacaattttgataactgtacattagagtgtgtcaagacaatgaggcttctttgatattgtcttttcttcttctaattaccaggtttctgtcatatcctaaatttagggagggaataatattcatctccaaattaagtataacatctagctatattttgatactttttagttgatacatataatataaccaatatcagttaaaaagtaccaaaatatagccagatgttttacttaatatatataaaggtatgccattactcttttagaaaaagtcatatggtggctcacgcctgtaatcccagcactttgggaggccaagatgggcagatcacctgaggtgaggagtttgagaccagcctgaccaacatggagaaaccccatctctactaaaaatacaaaattagccaggcatggtggtacatgcctctaattccagctactcgggaggctgaggcaggagaattgcttgaaccctggaggcggaggttgcggtgagccaagattgcgccattgcactccagcctgggcaacaagagtgaaactctgtctcaaaaaaataatgataattaataaataaataataaataacaaaattttaaaaaatcataaaattggaagaaacctaaagaggtcgctagtataatttattttcttggagatactatgtttctggtaagaggaaagctatagcctctgttctcacatgtagtgacttttgttatcaaataattccatataggtaaataaactctttcttactattctctaaattccattcattattttatttttttcttgctctaagacattgaatacctttgtttttttaagttatttttaaaaccagaagatttaaacttaatattaaacatttcctctcaattctcttaattactttttaatttttcctactaagaaggacagtttggaaaacacaaagctaaaaggaaaagtaatcatgattccatgtctagaggtaatagcttaacatatgtcctttgattgttttttctctatatctgtactttttaagttgtgttttacaaaaatgataccatattgcatatgctatattgtagtctgctttttaaaaatatatttatttatttatttatttgagacagggtctcactctgtcacccaggctggagtgtagtggtgccatctcagttcactgcaacctccacctttcaggctcaagcgatcctcccacctcagcctctctagtagctgggactacaggtgcacacccccacacctggctgatttttgtgttttttgtagagatggggtttcaccatgttgcccagtctcgaactcctgagctctagctcccaaagtgctggtattagaagcatgagccaccatgcctggccctgcttttagaaaatttattagccaattttgataataaacattcctccacctattatttttaatgactacctagtattctatagtgtgaatgcaccataatttactcaacctgttttccaacatttttattaagagaacaacaaaaatgttaaaataattttatagtaaacacacatatatccaccatttagattttacaactaacatcttattatacttgctattagtctgttctcacactgctctaaagaactacctgagactgggtaatttatgaagaaaagagatttaattgactcacagttccacaagcttaacaggaagtatgactgggaggcttcaggaaacttacaatcatggcggaaagtgaaggggaagcaagcacgtcttactacggcagagctggagagagagagaacaagggaggaagtgccacactttaaactatcagatctcatgagaactccctcacaaacatgagaatagcatgaggaaaattcgcatccacgatccagtgacctcccaccaggtccctcccctgacacctggggattacaattcgacatgagatttgggtggggacacagagacaaatcgtatcacctgttttatcacataccagtcaaactagctatctctccattattttttgtgtattgccaagtaagtggtagtcattagtatattcctctcacccaagtatttaagcatcattaaccagagttcagtatgtgcttatgtacccaacctatatatacacacacacacacatatatagatacacacacatatatatatgtgtttatatatatctttgttttttgagacagagacttgctttgtcacccaggctggagtgcagcagcatgatcttggctcactgcagcctctgcctcctggcttcaagcaattctcgtgcctcagcctcctgagtagctgggattacgacatgtgccaccacacctggctaatattttgtatttttttagtagagacagggtttcaccatgttggccaggctggtcttgaactcctggcctcaagtgatccacccaccttggcctcccaaagtgctgagattacaggcatgagccaccaactggacccccaacctatattttaaaggattcttttacatttattaattatacatatttattaatataactggatcagctatatattgccacacaacaaaataccccaaaatttagtggctgaaaacaaacaaatactttatttgcttttgattctgtgggtcagcaacataggctaaggtcagctgagtgatttttctgcttacttcactagagtttttcatgcaataatagtcatctggccattccaccaaggctggatggagaaagatggtctcacttgataaattcctggaattggagttacttaataaaaaggtatacatacacatagtcaaattgccctctttaattatttaaaatgtattcccctgccccagattctatttgcattctttcaattcaaagtcagtaattttttgagatgctggctggattcattttaatgaatatattgagtatctcttggctaggtattgagaaggatacaagagaaagaaatacaagatattgactgttcttcaggaatttataatctagttgtgtagataacaccaacactaataagatggtcaaactgaattataagacctggtacagttgtcaaattgcttacctctttctcctcttctcacaggacaggctatgttaattacttgacatctaataagtattcagtaaataattgtttagtgtttatcactgaatttaagagaagctctgagttaaagtcctctagatgaggggttttgttaaagaggtgggccttgatatggcccttgaattagaggtacaatttagaattagatcaaggaaaggaatacagatttagtaatcattttcttaaaatctgttttattttgtatgtatggctagaaattacttttcttgtttgtttactataaacacaagactatctgctaaatatttccctactgagttcataactaagattgccaaagtgcttgtttcactaccatattttaatttctgaccatcctttatcatacaaggtgtgactagaagggaaacaaccaattttctcaaacaaattcagaaacccttatctgaaaaccccatgtagtagggtaattcagagtcggaagattttcaacatattggaggaaatagttaagggagggttgtgggtataagcaaacctatgaaagccaatctggttttttttttttttttaacatttttaaagtaaaatatcaatttgggcaccctaaatacacatagtaaaatagttacaatgagattctgaaccattaatatacatttactattttttcactgtaaactttcaggatctccatcttccttgatttccactctatgcttagaagttcaggttgccttgttgctgagggtgcttatactaaaggtttttgcttttttcctgaatgtaattgtcagtcctccaggaaattttatgacacagagttgttgacttccattatctgattcccactatggtctcagagtcaaagaaaactgaacaaataggctgtttgtggctcactttcgttaaccaacctgaacaagtatttctttctgcctatttcaacgtgttattttcccttagttccaaatggagtgccatcagtccctgatgaactgagataaaaagttgaggacatgcaattacaaggccctcatatactttttctcaccttctgtctgtcttccaaaaattcatggtaataattctgttctcttctcctttatttccctgctctttttcttaattatttgtgtaatagggagacaaaaactcttgaggatgaagaagccgtaaataaaagtgaatttcacttaaggggaaatcaaggttgagaaattattattatatagtggcacttatccatacagatgagtgttgccctcttcacattttttatcttagctcaactgtgctgctgttgctcaaagtatgtttttgttatggcctttacaaactgtagcacatttttttgaacatacttggtggtggcatgtctttcttgagggtgagttttgttttgtaaacaagttatctacaatcaaaattggtgattttggcagatggaatcacactgcataatatgtctacccatatacacgttcatatacacacaggtatatcatcacacatacataaagtaatgagaataactcagagtttgtatatcattgaaaaagtgtagtttcctaagtgtttggggacaacattttttatttttaagaatcaaaaagaactgaaagagccttggaggtcatttatttcaatacctcaaggaaactaagacacagaacaagaaaatgacttgtcaaagtctcatgggcagtgattgcgaactccttagatttcagtttctttgttgatgatcacatatcttgcttgtcctaattcctttgagagtgagtgctgagggaatacagattagagtcttgcatgtagagattcctaagaaattattatgttggcatagaaggaaaaaaaccactcatacatagagcttctttaaaatattttaaaagctccaaattctattgatagaattataataatctataggcaaaatttcctttcaatcagaaaaatactaaagaaagtaagaattctatatagttcatgaaccatttgaataatttgagcctgcacctaataattcctgagtattgttcaaaatgaactactccaggaacgtcagttaaatgtttttgtgttttgtgagtgtttgtggctatgttttcaagcatgtttcttttacaaaatcagctgtctactactttccccaatctggacttctaaaatagccactaaagtattagccaaaagtgatccccattgctgtcataaactatgtatctgaaatacctattttgtttggaaaagaaaacagctcatgaggaaattaagtgataatatatgatcattcagagaaatggattggctgaaacgattacctctcaaaatgacaaatatctttttccatttaaataacctagtcaatctaacatttagagagtcaaaggtcttttagaccttatgattcccactcaatgttggaagaggctggagtgatggcattcaaacaccagatccacagactggtactagcctatgacaaggagtctgtgacagcattttagcctatcagtagtgaaatgaggaaaaagaagatgatatggtgagcttattagaaaactaaatatatccagctttttattatttaaatatcatttttgaaatggtagtgataatagatattttttgttgtttgtttttatcatgttcttaccttagcaaaggtgaatccccaaacttaaaaagtcatccaattcaatgttctaccctttcagaatataaacaaagtgcctgctatagaatttgagttattttataaaagtagaataaatgacttagaaatttcttaatgtgaccccccccccaccaagattactgtgagagttcagtttatctatagtttatcattaaaagtttactgcagctggttctatgcagtgattccctacccgcccttccattttcatgaccgtcttgaacctttcattgaagctcaggctgcttaggtagagtctgaattgttttgtcagtattagtagctcataatcaacattgtgatttgtcacataacacctctaactgcactattctatggtttcaagaagttattttggtagcagttcctttatgatcagaaggaacattttgctacaataggaaatgcattctgtgcagacaggctgcaaattcccatgacagggcaggctcatctgtcaaagaatattttttattcccatttacctctttgattacattcagaatgccccagtaatgctgatgagatcattctaactcttaagaacattttcctcatgttttctatcatctccaataacattaaaatgtttatcacagtggaaatggtagagaaatctctgtttttctctttaggaagctaatttggggaaggaaggttggtatatgaatgtctaaaaagtattttttaaattatcagtaccagtgtttattatttaactgaacactaaattgctcttgcatgtgtcgcatttgcatatactatggtttctagtagtgaacataaaagcaccagtgatttactcaaaaaaagatattttctatttattttcaattctacctatactatattgaaagactaggaaatactatgaattattgatatgttttttagtgaaatatggtgttttatgtaccataatgaaaaccaaaataggtaaacacttggttacagtgatttaagtgcagaaatgtgtaattgatgcaattaggtgcttcattggctttttaaatgaagtctgtatttctgcatatgtaattataatttgaatatattctgattttttgtcctctacttttttccaagttatagtgttatatatgctcattactttatttttaaaaaactttttattatgaaatgtaaacgattcaaaaaagtaaagaaaatagtatagtgagagcaatatacccattacccaatatacccattagcatgactgatcttattccacttatatctccattcaccacccttctcccaccactagattatgtaaaatcacataccaggtataattttatccttaaatactttcatatgtaaactgtataccaatagatatttaaaatatattttccttttttttttttttttttttgagacggagtcttgctccgtcgcccaggctggagtgcagtggcagcatctcggctcactgcaagctccgcctcccgggttcacgccattctcctgcctcagcctcccaagtagctgggactacaggcacccaccaccgcgcctggctaattttttgtatttttagtagagacggggtttcaccgtgttagccaagatggtctcgatctcctgacctcgtgatcagcccacctcggcctcccaaagtgctgggattacaggcatgagccaccgcacccagcctattttccttttttgtacttttaagttttatttttttaaaattgacaaataataattgtacttatttatggggcacctattgacatttcaatacatgtaatgtatagtaatcagatcaggtattatcgtatccatcatctcaaacatttatcgttttcttgtgttgggaacattcagtatccctttctagctatttgaaactatataatgtattataaaatatattttcttcataccatcaaatattcaaagagttaagttttcctccctcttgattatctctctctctttctctttttgacaatttgtttgaatctggatccaatcagaatccactgtatttggctgatatttctcctgaatccttaaacttaggtttcctcctcctccctcttttattttcttaccagtcatttttgaagaaaacagggtcatttgtcctgtaaaattcccatattctggattttgctgattatattcccttgtgggtattgctaataggtgcctctaagctgttagtttcagtattttaagattattttccagtttttactttgaatgtaaatctcaacatgtcttcatttttctattcaagtaatttaaatctctattcaagtccaatccaaaatctacctttttcttgccataccagtcaatcacttttgcagtattttaaaagaagattgcacatgaaaagattgcttttccacttgttcctagacctcaaagagagattaattgaaagacatatactgtagctcgtgtcctaagaaagttgatctcaccgaagtagagggtagaatggcgattgccagagactggggtggttaatgtggagggagaatgggaagatgttggtcaaagaacacataattacagttaaataggaggaataagttcaagagacatactgtacagtgtggttaccatagttaatggtgatatattgtatttttgaaaaatgcagagtggatgttaagtgctgttatcacaaaaatgataaccatgtgaggtaatccgtttgttaattagctaactattccataggtgtatatacacaattgtctgtcaatttttaaataaaacactttttaacagaaaaaataggagcttaatcaataaaaaatttagtttattaagttatgccacatgtgagtggcatagactgctacaaggaatataaaggccattttaatccctgtgggtaaaagtcttcaaaagtgactcctaatgtggccataaattcttcattactaagtgcttcttgaccattgcaattttataggatttgatttctgaaattacaaactttgttctgatgaactcattctctcctcttcataactgttctaatttagtgtttttctgcttgctatggagggatggaggagaaatggctcatttccagaagggtggattggaatcactcatagggctcttaacgcctcctgctgaattgatgattactgttgcagtgacccactgctactgatggaattacaaaacatctttcagatgtgctggggtggaaaaacagttgaaaaccattgtcaagagtctctgtaagactttcatgacaaagttgctgtataaagttgtaatatacctagttgactttcaaaggcatcttagcctaaggcattgactgtcaagaaaataaaaaggtcacagaacataatgacctctttttccccactaaggaaggaggtttatattatataccttgattattagtgaagaggctacatttctgaatatagaaatgtgttcattgagaagagatttattgagcatctatttaactgcattgtgtaagtctctgaggaaaaaaggaaataaaagtgtaaagtgtctcttggttccatgagagcttatagtctattaatagttgaagagaaaggcatatagggttaaaagagttaaataaaaatgaaagatactattagattaagcattagaatttgggatgataaagtcttaaggaagcagaataaagggaagaataaggaccaaataggatttctgaagaagtctggggtgtctcctatttgggaggtggcacttttatcatgtgaagtggaatggatgaccctctccaaaacctctaagtttcctccatatttgtgattcatactagaatattatcaaaatctaaagtttcgatggacaaaaactgtcagtatgaccaaaataatgtaaccctttcaactaaactgacaagctacatttgcaacatatttgccaaaaataaatgaaatatctcaaagtaaaaataagtatcagcagtaagccccaattgtgtcattgtttaaatgaagttaaaaatatataagagttcttaaactttttgtgttgagtctgtagagaattgatgaaacatatagaactcttctcctgaaaaatacttatatttacatacagaatattgtacatatttcagggattcatggaccctttaaaacggatccatagactcaatttttgagaattttgacatataagaataaaacagaatcaaactttctaatctccctcaagtcatgagaatggaagggcttaaagctatagacatttaacaaattgggcccaagaaacagtgttagtgggcagaataaagagaagtagatagagaagggcttatcagagcaaaagcaggagtggtccagggaggataatagtctcaagatagtatctgagattgggttttcttattcccaatatgttcctgaaggcatattctatggttaggctgagtccatttaaagagtatctactcagggctgggcatggtggctcatgcctgtaatcccagcactttgggaggctgaggtgggtggatcacccgaggtcaggagttggagaccaacctggccaacatggtgaaaccccatctctacttaaaatacaaaaaattagctgggtgtggtggtacacacctgtaatcccagctactcgggagggtgaggcaggagaatcacttgaacctgggaggcagaggtggcagtgagccgagatcgtgccattgcactccagactgggggacaagagcaagactttgtccccaaaagaaaaaaaaaaaaagtatctacccagatacttttaggagaatacagaacaattttgactacaattaatagtgaaaaaatgaagaaattacaaagtaagtcacattattcctagcagttttaatttaagaactcgtgttctggaacacccacaaaagggagtttaaataatattttcttcagccctttaagcatggtgtattaggccatttttgcacttctataaagaaatacctaagagtgggtaatttataaagaaaagaggtttaattggctcatggttgtgcaggctttacaggaagcatggtgccggcatctgcttggcttctagagaggcctcaggaagcttccaatcatggtggaaggtgaaggggagcaggcacatcacatggcaaaagcaggagcaaatgaggttgggggaggtgccacacacttttaaatgaccagctcttgtgtgaactcagagcaagagctcacttatcaccaaagagatggtccacgccatttgtgagggatctgcccccatgattcaaacacctcccaccaggccccacctccagtattgtggatctcaacatgagatttcagtggggaaacatccaaactatatcatctgggtaactttctaataaactatgtatgtgatgtcaaatgtaattaccatatgtaattttaaattttaaaagccttttacttaacttttatgcactggaattgtgttttaaacctaacaggaagccgttatcattagaatgatcaaaacctgataatagtaaacaaaagagaaagttaatttatgggaataatcattcgggcaatagaataaccagcatatattgctgtcttaaaggggagtagctgtcaacatgtgttactaatagttaaaggtttccagaaaattttcagtatctccctgccaatcaataaagatagcatcacactcatcaccatagctttagttgtcagaaatggtgtatttattgactaaatgcagcactttgaaaaggcaaaaaggagagttaactttgaggaagtagtgattacggaatttcagtagcagtaatttcctctcactctgaataatattacagttatggatatttccctattcttaggactaaatacttatttagtagttatataactttggaaatacagcacaatactttattagttcctatcattaaaaggtccatgaatagaaaatggcttacttgcatttggaccagcccaccaaaaaatcaacattggccaaatgcagatgaaaggttgattctggagtttaaatgcagagtttattaagtaacatgtttattaaattataacagggactcaaaagtgatataaaaactcattgaactgataactagtaagactattttaattattgttaagcttacttttcaatccccctcctttccttcctctttttctctctcactcattaacgtcattgacttttaaagcctaagtcaagattttctctagacttgaataggtctttgccagtctacaatttctgttgtctgcatacacatttcttccagatacattgtctggcaatatgggtaatggtgaaaggaaaagatgaatgggtagaagaatataggaatctatggtattctcttaaatttacatgagatttcaatgagtcttttggggagcagtaaaagatttctgtatttgacattattttggtaacatggaaatgtcactgacagaaaattttaactcttatgtttgttttttatttatgtaattagcatttgcctgtctactatatgcagcagtcagctggtatacagcagaacaaggataccagttgttaaaatactgaaatatttccttactggtagagaaatggcactttcttgaatgccataccccacctctcaggctctggaagtcctagatcctcctccagaaacctccagatctccctgtgacccagaaaataaaaggaaaatgaatagcacagcagcaggacttcaggaccctcatctagtgccagggcaacatcattctgattggtcaggactgtatgctgtgccagttgttaaaatatttaatatttaatattacctttggctatatgcaaagcactgtgtttaactcatcaggaaataaaaaggtgaataagtcacatcccctgctctcaaggagctcacagatgaatcagtagtaataattataccaacggctgacatttactgagcacttactagcagcattgttctaagtacttctcatatatcatctcattaaccctcatgatatccttaggagtttattttctcttttacagaggagaaatcttagacatagggagattaagtccatatcagccagtctgactccttaaagagtattggaggaagcacgtggagttctaatttgtcactagtcatgtgatccccttggttttcacgtccgtctctatggaatgaagaggttcaattacatgatgtctaacagtcttaaaaacctgttattccataacagtgataagacaaatattaattaaaggcagaaatcataagcataactcaaggcagaatatgaaaagccctataaaatagataaatacaaatgtagaaggggctatacataatttgtttccagaaaacctataatgcttttctttctcccatttctccttttcaattaaaataattcttagaaaaaagatcacacatagtttcttttgaaaggttgtatttggactagatattgaaagtgaaaaacagaagagagggcattttgggcaaagaggatagcatgaaccagtaagtgtttcacaggggaagagagagatgggtttatggaaacttgagtgtcttccctgtgccagggactgtgttaagtgtaaggaacacaaaactgactgaaatacagttcctgtctggtgagaatgacggagaagtaaaccaacagtaatgatactgtgactggggaacagttgcattgcattcttcatatttgtcgaaggcacatatttattgaatgtgcctgttttccaggcacatggaagatgctggagatacaccagagagcaaaacggaccaaaatctctgccttcatgaaggctatactcttatgagcaagataagcagaacataaataaataaaatatagagtataacagatggtgataagtgcattggagaaaaacaaggcaaggaaggggatgaaatctgctggagttgagagaaatgagttgcaattttaaatacagaggtcaagaaaagcctcattgaggagacatttgaataaaatgctgaaagccacaaagaggtagcaagtcctgtgactctagagtgaaagatgttccaagcagaaagctgtgtcccctccagagtcttgtctcagtatgcttcacacacaccagcaatttgcttctttttcttttgcatcatcagtctgctactactgtcccgtgcaccacccagtctgctactactgacccttattcactctaaccagctctttggtctccttgcttttttttttttttttttttttttgagacagggtcttgctctgttgcccaggctagagtgcagtggtgacatcatagctcacctgggctcaagcaatcctgccatctctgccacctgagtagttgggactacaggtgcaccccacacccggctaatttttaaaaattattttagagatagggtcttgctatgttgcccaggctggtggcaaacttctggcctcaagtgatcccccgacctcagcctcccaaagcattgggattacaggttgaattactatgccctgcctggtttccttgctattccattaacatgccagatgactttcacatcagggggtttgcatttggctggtatatagagaatgaattagaaagatgtaagtccaaagtcagagaaaccatttggggccggggaagagcaataatcaaggttaaagatgattagcaactgaattacggctatggccaggggaatcaagaaaagtagacagattgagagagatttagaaggaaaaaaattactagaacttggtgactgcttggatatggtaaccaaaggagaatggagacgcaagataattcccaggtttctgccttgggtagctggcaggatgatgatgcagttcactgaggagggtacagttttggaggcatttaggtgagatgatggatgtggtttggggaatattacatttgaggggcattgggcatgatttgagttggtataccatacagattaatttcttgtcaatatttttaaagtattgtaatgtgtttttttaaccacaccctataatttaagtaacaataggatctccagaatgagaataatagggggacccatagagagatggcctctcaaaggcagtagccttttagtgggctctgaaagatgagagatgccaactgtgcagttagggaagactccaggcagaggcacagcagacatgcaggcattcatcccatgtcaccaaaacatccagtatgttttcagcaaatgctgaaaactgaattacagcctattctctgtcccttgctctccctctagtttccctagatcagggtggaaactctccatccagccaaccgtgcacttcaaaaacccagaggtcagcctggacacctcttctcccccgacctccagtcataagtcctgtggattgtccttgaaatctgactgtcactctgctcccttctgtcctagctgccatcttctgtctcttgaactgtgcagcagccccctgccggtgccctgctttcattcttgtgctcttccaacccaatctccatattcagctgagtgatctttgaaaaacacaagtttgctcctgtcattccctgttgcaatgtatttttacaaacacatcctaagatagttagtcacgtaccaacttttagacctttaaaaattgcatttatctgccaagcaattgttccccatggaagaagagctctagtgactactttgttcctttgttgtctctaattttaatattccaaaacccacatttttttttacaattgtcatttgatttagatgacttaaaagctttttattacaagccatatatatactaatagaacaacctttaacaatatatttttttgattcaccagaaaaggtgatcatttcttgatcacaagcagtaaggtttcttgtcctcagctcaacctcattataactatatatttgaacaaactaagatatcctctgaactgagtcacctcatcccagggttcaactgacatggggaattaccttattttagtcagaaagccttaattagattaggttggcctttctgaactttatgtgttgctacatacaggagttaaaaaccttgatctacacatatcacacaaatcaggagaaaacgaaagcagaaatgagctcatgtttctatatgcagctgctttgatgaagacatttcaaatagaaaccagaaaaccaaaagcacaaaactgaggagataatagccaatgaaggggagaagtgattaattcagatcaggaaaaaaagctgcagagttcaaagagactatgatgaaattattaggggctgttggagatgtaatccatatctccttgtcacatgtgtcctacgtgatagtgccgtgaatgtcatgggataaaattagtgccttacaaaataaacatgtttaaactttgtgaaaaatacccacacaagagactgatatacatacattcagaggtggacacatttgtctctagagggaaattcatctgctatgtggtgagagcagctgataatcaggaaactcaaagtcacattctagcagaaacttttattaatattgacccataactgtggctctgcaggagtttttaatctcattgtatttatgtagtgtcttttgtaatatgataacacatttcaaaattattattgttgaattgccaacaaaatgcatcctaaacacacactccttaggtaagggaagagaccccatgtatgctgtcctctgctattggaaacaagttaaaaaagagttatccagtaatctttttcttaaaaacagtcacaacatcttgatgatactgattcaattgtaaattattttggaataattcaaactataaaagctctaatcttcaagatgggaggcttgaatgtgggaatgtaagcacagatgtttatctaattttatccaatagtttatactgcacgatgggctcactgagccatatttcctcactttgaagttacctggagttctacctggtcacaggcttgcctgatttatgtgagtgaggaaggaaaaccacttaaatgaagagtgtggctttaaagaatatagtgcattttctctgagtgagcattcgtgacttctgcaggaaggtagatgatattggacaacagattactttgttttgattgaagattgaattaatattacaataccaatgctttgtctgttcgcaggcaacgaataaatgagtgtgtgatactgaaatgaaaaaaataggatatagatggcttatgtaagagccaaatatagcagaagcatacaactatcaaactttattcagacatcaagaaagcatcatatctgagctattcttttcatctccttcctgtttctttgtatacacttctagtagttaaactgattttaatggatgaattttcatttaaaagtaaaaaatgatgttctctgcttcaagcagcaggtgtgtttttaatctttaataggtcaccttcccaagtgcaagcaggcaagctgttattgatcaaagaggttttgttgggtagctctcagattattgagtgacaaactttattgaatttgacttaacagaagtcagaagacagctgaagcataagagcttgcactgccatcagagtcattttacgacagccagggagcaaagctcagagatggatactgagctttttgctggcccttggagattaactgaacagccttcctaccaattcccaagcctgtcagcagaaccaattagattttcaaccagtagacaagaagggtggcacttggggacctttttgctttaggtcgaaggcttttcagactgcgatgagatgacattgatgatgacacgttgagcattggttggttttaagacaagttaaattagcagtcttgaaatgattccaactgtctcctgacttctcactgttgccatattcagtggatcctgtcaggagcaagttgatgacttaatagtctttcttgagtggatttgagcactttggctgtgtgtttatgtgtagttgtcatgcttaaaatattcatatgaaggtttgaaatatttatttgaaggcgccttctgcagagttcagcagtaaggctctcagtgcttctacctactttttattttttattttttgcttctctaagcagttattttgtacaactaccttttattctatttcatgtataattgatgacaatgtttcatgtaattattgataacttcatttatgataaacttaaaaagcctttctgacatcatgcatttctcccagactactgtaaattcagatctactcataaatagtttggaaatcactggggattaggaagggcactattgtttttattctgtgacctttggtccaagaagactgaggcagattttcatggaagggatataaacagaaggatggaaacatagatgtagtactaatacacgtaagattgtcttaaacgatggaaacaggatatctttgagaagcttcatttttgaccttgaaaaagttctacaggatacttatttgaggtattgaaaacaccattactcaagtctgcatttgaacttaaagattactgaatagtcttaacatctactaatatcagaaaattgttatgagtgtacttctgtgttatatagataattgagattttaaattctcaaatttaaagtttttggtatttagtagggttacctggcaaataacttaaatataataatttgtaattcattgcacctactcttgtacatttttataagtgagaataattttagctgattatgtgtgtatatatatatatatatgcatctgcaaacacatatgtgtgtgtatatataaataattcatgttttgtaacaaagttctacattttctacagttacatgctggtgctatcacttggcaattgccgaccctccaaaaggcatgaaaatgaaaatattttacagtataaattctttcaggctactagagagtactttttgctaagctagacttgaaattttatagctagctccttggcaacctacagtggttacgtcctttttgaagagcttgatttataaacagggcattcttggtgtatgcacttaacattggatttagaattctgaccctatggtttcatacctatacaatgctgtggatagcaatgatgatatgtaggaaataaatatttcaacattagactcatgttttcaaagtggattcttctagatgctttttaagatagccacatttggccagaaccccatgtaatcatcacccagtcccagtaagtgacaacccatgcccagtcttgcccgctgaaaatcccattcagtacttcttttatattattttgaagcaaacccaagataatcatataattttttccataaatatttcagtgtctatctctaaaagataaccacaataccattaacacatctaaaaagacttagcaataatttcttaatataattaagatagaattagtattcagatgtcatttattgttattcagaattaccagtgattaagattgtgatagattttttctaaacacacctatttttcttcccaaatctgttatcctattgtcctttgatactttttttttttaaactccttttcgtcttgcccagccaggaccgtactgttggacatttcaaccacactcttatcactacctttaattctttcaccccttgaccctcttttatgcttactcatcctatcattaaccctacataaagctaaaattggttttctctgtgcctgggctgtcaaaagctattgaagaaaaatgcataactgttgatggcaccattacacatttatgattttcagcctcaggtggcccctttgtaccacctggtggtcattttacccattccccattgaaacaggaactatttcaaatccatacctctttaattcctcaacttggcctctagccaatttcatcaggcatcatagatgacttgaacatctattctgtgagaaaggacaatagttgtgagttatttcacacttcttccttactctatatttatttatctttaattcctaccctctgtttcaaaacaaacagattctttcttccaaaaaagttaatgtttaataccatggattctagtgccagattgcctgtttagaattcaggctccaccccttcttagctatgtgtcattgggcaagttattcaactcctttgtgcttcagttttctcatctgtaaaattatagttattacagttcttgtctttaggattgctaagaaaataaagtgacaatacatgtaaaattcttagaacagagcctggagcaggccgggtgcggtggctcacgcctataatcccagcactttgggaggccgaggcgggcggatcacgaggtcaggagacagagaccatcctggctaaaacggtgaaaccccgtctctactaaaaatacaaaaaattagctgggcgtggtgatgggcgcttgtagtcccagctatttgggaggctgaggcaggagaatggcgccaacccggaggcggagcttgcagtgagacgagatcgcaccactgcactccagcctgggcgacagagcgagactccatctcaaaaaaaaaaaaaaaaaaagcataagaaagcacaacccatgtaacagttgttgttacagttatatttccaaaactctactcatgttcctgactcagggtctttccaaggctctacctgtgttcctgattgtgaaaagtaagatacaagaaagggatgggggaggctgctttacattggatggcctggcaggcttctctgaggaagcgacatttgaactgagatctaaaggatgagaatagaccagtcaaggggaaagctgggagaacatattctaggcagaggaaacaaatacaaaggagctgaaagaaggaatgtgtttagtatgtttgaggaaatgaaagaaaactaattatggctgaagtgtagcaggaagggtgagaatggttcaagatgaagttggggaaataagctgggtccagatcatatatggccttgtagggcagagtaacgtgtgtggattatattcttagttcagtggaaagctattgggggttttaaccaaaggaatagcatgatctaattggtatcttgtgaagattattctttttgctccatggagaatagatttttaggacaagagtaaaatggggaaaagttgataaaagactattgcattattctaagttagagatgatagtcatttggattgtggtggtggcaatagtaatggattgaaatacatgaattcaagatgtaatttggaggtaaaaggtgatggattagatgtgagggatgttgaaggaaagataagaatcaagtataacttctaaattattggcttgaacaataaggcagatagtggtttaatttacgtaaatcattctctaggagagtcaacaatctccaggcacccaaaggtagtggtaaggaataatacaaggtcaactacaaagttactcattttggtttcaaaaatggccttggcttctcgttcctcataaattggtaaatcttgaggaaaacttccacttatttatgtctggtgtctttttagcttttaaaaaatcaactccatagaggtaaaatttgcatataatcaatgcacccattttattttttatttactttttcttttaaaaaacatttattttagattctggggagtatatgtgcaggtttgttacaaagacatattgcatgatgctgaggtttgaagtacacttgaacccatcacccagaaagtgagcatagtacctaatacgcagtttttcaacccctgtcatcttccttccctccttcctcttatattccccaatgtctgttcccatctttgaatctgtgtgtacttaatgtttggctcccacttataagtgagaacatgcagtatttggttgtctgttcctgcattaatttgcttaggataatggcctccagccgcatcctaattgctgcaaaggatatgatttattttttatggttgcatagtattccgtggtatatatgtaacatattttctttatccagtccactgttgatgggctggtttgattccatgtctttgccactgtgaatagtgctgtgatgaacatagaagtacatgtgtcttattggtagaatgattatattcctttgagtatatatccagtaatgggattgctgggtcaaatggtagttcaattttcagttcttttcagaaatctccaaacttctgtccatgatggttgaactgatatgcattcccaccaacagtgcataagcattcccttttctctgcagccctcaccaacatctgttatttcttgactttttaacaaaagctgttctgaccagtgtgagatggtatgtcggtgatttgcatttctctgatgatttgtggtgatgagcattttttcatgtgtttattggccatttgtatgtcttcttttgagaagtgtctgttcatgtcctttgcctacttcttaatgggattatttgttttttgcttgttgaattaagctccttatagattctagatattaggcctttgttggtatagtttacagatatttttctccattccgtaggctgtctgtttactctgttgatggtgtttctcttgctgtgcagaagctctttagtttacttaggtcccatttgctgatttttggttttggtgcaattgcttttgaggacttagccataaattatttgccaaggctgatacagaggagggtatttcctagcttttcttctgagatttttataggttgaggtcttctgtttaagtctttaatccatcttgagttaatttttttatatggtgatagctagggggccagtttcattcttcagcatatgattagcctgttaccccagcaccatttattgaatagggagtcttttcctccttgcttgtttttgtcaactttgttgaaaatcagatggttgtagatgtgtggctttatctctgtgttctttattctgttccattagtcttaagtgtgcattttaatgagttttaatgaatgtatataccagtgtaaacaccactccaatcaagttattgtttctgctgtattactctgaaaattcccacatgtcccttttcaggcaatcccctactccaccaccaggaagctacagatccatgtattgtcactatagtttagactgttgtagaattatatataaatggaattatacagtatgtaatattttatggatgccttttttccctcaaatcattattttttgagattcattcatgttgtttgttttctattagtagtttagtctttttgaattttggagtagtattccactgtatgaatttactaccacagatttgttcatccattccacccaactgttgataaaacaaaaattggcaagtgggacctaagtaaactaaagagctaagtaaacaccatcagcagagtaagcagcctacagaatgggagaaaaatgaatactgttgataaaaagttgggttgtttccagctggaagctattgtgaatcaagctgttagggacatttgtgcacaagattttttgtgaatataaattttcattattcttgggtaaatatctaggaatggaatggctgggttttttttcttttttctatttcaaattttatttgtcttttttattattatactttaagttttagggtacatgtgcacaatgtgcaggtttgttacatatgtatacatgtgccatgttggtgtgctgcacctattaactcgtcatttagcattaggtatatctcctaatgctgtccctcccctgtgcccccaccccacaacagtccccagtgtgtgatgttccccttcctgtgtccatgtgttctcattgttcagttcctacctatgagtgagaacatgcggtgtttggttttttgtccttgcagtagtttgctgagaatgatggtttccagcttcatccatgttcctacaaaggacatgaactcatcattttatggctgcatggtattccatggtgtatatgtgccacattttcttaatccagtctatcattgttggacatttgggttggttccaagtctttgctattgtgaatagtgccgcaataaatatacctgtgcatgtgtctttatagcagcatgatttatagtcctttgggtatatacccaataatgggatggctgggtcaaatagtatttctagttctagatccctgaggaatcaccacactgacttccacaatggttgaactagtttacagtcccaccaacagtgtaaaagtgttcctatttctccacatcctctccagcacctgttgtttcctgactttctaatgattgccggaatggctgggttttatggtatgtatggtatatgtttaactttgtaagaaactgccagactgttctctaaagtgattgtaccattttacatcccccagcagtgtatgagagtttcagttgcttcacatccttactaacgcttggtatgattagtctttttaaatttagccattccaatggctatgtaatagtatcttattgtgatttcaatttgcattcccctaatgattgctgatgttgaatttttttcatgtgtttattgaccatttgtatatattttttgggacatgttcaaatcttttgtacagtttttagttgaattggatacctttttattaaattgcaataattctgtatataacctatacaaatacatttaataaatacatatatttaacaaatcagttgttaaatgtaagtattgcagattttttcccagtctttggcttgcctttttattttattaatactgtctttttaagagcagaagattttagtttttataaaatctaagttatcttttttttcttttatggctagtgcattttgtgttctaaaaagttttgctcacacaaacatcatgaagatttttctcctatgttttaatttggatattttaaagctttagcatttatgtttaggaatgtgatatatttgaatattatttttaatacagtgtgaggtaagggtcgaggttcattttttttccgtaccgatatccagttgttctagcattacttggtgaaaagatcatcttttctcccattgaattacttttacatattgttgaaaattaattgatgtaaatgtccagatctcttactggactgtcttttctattcccttaatctgtatgtctaccattatgccaataccatactgttttgattactgtagatttacaagtccttaaatcaggtactgtaagtcatctaattttgttctactttttccacattggttttggatattttaggtcctttgtatttcatataaatgttagaatcaggttggcaatctctaaaaaatcaaaagaagaaggctgttgtgattttaattgggattgcattgaattcatagatgaatttaaagagaagataattcacatcttaataatattgagtcttttgatccataataatgatatctcactccatttatttaggtcttctttaatttctgttagtagtgttttgtagttttcagtgaacagatcttgtacacccactccgatgtgcataattattcctattattttgttttctttttaaatgctattgttaatggtattgtatttttatttcattttccaattgtttagtgctagcatatagaaatacaattgatttttatactgacctttaatgctgtgacattgctaaattcacttattaattctgatagctttttaaaggattttatagaatattttatgtataacagtgatttagtccatttgggctattatgtcaaaataccataaactgggtagcttataaaaaacagaaatttatttctcagttttggaagctgggaagtcctcaaggcaccagcagattaggtgtctgatgagggcccattccttctcgactgtatcctcacacggtagaaggggctagctagctctttggggtcttctttataagtgcactaattccattcatgagagcttcaccctcatgacttaatcacctcctaaaggccatacctcctaaactcatcattttgggggttaggatttcaacatatgaattttggggggacacaacattcagaacattgcacgagaccatgtcctgtatgaataaagacaattttacttcaccctttctagtctgtatgtcttgatttccttttcttgctctagtgcactggctgggagatccagtgcagcactgaatagaagtgtttacagtggatatccttgcctcgtttctgatcttaggatagggatttagtgtttcaccattaattaagaagttaagtatagatttttttggtgaatgtcctttatgagagaatgtccttctatttctagtttgttgagaaattttttcataaatgtatgttaaattttgtgaaattattttcctgcctcttttgagatgattgtatagcttttctcctttactttgttaatgtggtaaattacatgattttctaatgttaattcaaccttacagaatagggattagatactgttttatcataaggtattatcctttatagatattactggatttgatttgctattttgtttaggattatatgattttattaagggtggtgtcatctatgttcatactagttacagtctttttaaataagttttattatagtttctttttgtctggttttggtatcagggtattgctggactcgtaaaatacactggcaaatgttcttccttcttatgttttctgaaaaaatttacagaaaattgctagtaattcttcccttaatgcttgatagaattaatcagtgaatccatctgaacctggagtgtgtttgggaaaaaaagtttcgttcacagattcaattaaatagacataggcctcttcagattttttacttcttcttgtgtcaattttgacaacttatatctttcaaggaatttgtctatttcatgtaattttccaaacttattagcataaacttatttataatggtcccattttatccttttttttttttttttttttttttttttttgagatggagtctcactctgtcacctaggctggagtgcagtggtgcaatctcagactctgcctcccggattcaagcgattctcattcctcagcctcccgagtagctgggactacatatgcgtgccaccacacctggctaatttttgtatttttagtagagacagaatttcaccatgttggccaggctggtctctaactcctgacctcaggtgatccacccaccttctcggcctcccagagtgctgggattataggcatgagccaccatgcctagcccctttttattcttttaatgtctataggaactgtagcaatcaatgttccctatttcagtcccaacagtgcaagtagctgggactacagacacattccaccgtgcatggctaatttttaaatttttttgtagagatggcatctcactatgtcacccaggctagtctcaaactcttgagctcgagcagtcctcccaccttggggtcccaaagtgctgagattacaggcatgagccactgtgcccatcattaatttgtatttcatctctctttttcttcttgagcagtctagcttctagcttaaggtttatcaattttattaatttcttcagagaactggctttttgtttcattgtttttctctattgtttgtctgttttctatatcttttctttctccttttatcttttcagttccttatttctaattacttggggtttaatatagacttttctagcttccaaaagctaattatttggggcttaacgtaaatttttctagcttctgaaagtgaaagcttaggtcattgatttcaaacctttttttctaagttttttttttttttagatacaaggtctcactatgttgtccaggctggtcttgagctcctaggttcaagtgatccacctgcctcagtcaaatcttttttcttatgtaagcattcaaagctgcaaattgaccctgtaagccctactcttccaacaaattttgatatgctatattttaatttggttcaacatatttttaatgtttcttatgatttattctttgacctatacattttttaaacagtatattgtttaattgccaaatatttgagagttttcaagacatcttttttgttattgattttcaacttaattttagtttggtcagagaatagagtctggataatttcaatctttaagttattgaagaattgttatatagcccatcaaatggtttatctgggtaaatgtttcatgtacacttgaaaaaacatatattctgcccttgtttgaggtcctgttttgtaaatatcagttaaaacaagttggttaatagtgttattgtcatattctacatccttactcattttatgtctacttgctctgccaattactgagagaagagtagtgaaatctcctatataatatatacgtatgtgtctatatttctgtttatttctatcagcttctgcttcatgtattttgaagctcatatttgttgcgtacatatttatgattgttatgttgtctttttgatgatttgactcctacgtctttatgaaatgtctttctttatcctcagtaatatttgttctttgaagtccgctgtgtctgatatcaatacagctacactaacctcatgattagtgtgcacatggcatatctcttactgttcatttatgttttacctacctatctcactgtgtatgcatttctttctttctttcttttttttttttttttttttgagacagggtctcactctgtcacccagattgtagtgcagtggcctaatcttggctcactgcaatctccacctccacaatggctcaagcaatcctcccaccttgacctcccaggtagcggggactacaggtgcacaccaccatgcctggctaattaacagagagccaaatcatgagtgaactcccattcacaattgcttcaaagagaataaaatacctaggaatccaccttacaatggacatgaaggacctcttcaaggagaactacaaaccactgctcaatgaaataaaagaggacacaaacaaatggaagaacattctatgctcacgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacattgccaagtcaatcctaagccaaaagaacaaagccagaggcatcacactacctgacttcaaactatactacaaggctacagtaaccaaaacagcatggtactggtaccaaaacagagatatagatcaatggaacagaacagagccctcagaaataacaccacatatctacaactatctgatctttgacaaacctgagaaaaataagcaatgcggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacacaggcacggggaaggacttcatgtctaaaacaccaaaagcaatggcaacaaaagccaaaattgacaaatgggatctcattaaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacaaggaaaaaacaaacaaccccatcaaaaagtgggcgaaggacatgaacagacacttctcaaaagaagacatttatgcagccaaaaaacacatgaaaaaatgctcaccatcactggctatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccatttgggaagtcagtgtggcgattcctcagggatctagaactagaaatactatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcatgtatacaccatggaatactatgcagccataaaaaatgatgagttcatgtcctttgtaggaacatggataaagttggaaatcatcattctcagtaaactatcgcaagaacaaaaaaccaaacaccatatattctcactcataggtgggaactgaacagtgagaccacatggacacaggaaggggaacatcacactctggggactgttgttgggtgggggtaagggggagggatagcattgagagatatacctaatgctagatgacgagttagtgggtgcagcgcaccagcaagtcacatgtatacatatgtaactaacctgcacgttgtgcacatgtaccctaaaacttaaagtataataataataatagtaataataataaaaaagaaaggaaatacaaatcaaagagtttaaataagaaaaaaaaacaattttttattttttttgtacagatgatgtctcactttattgcccatgttggtcttgatctcctggactcaagcaatccttctgcctcagcctcccaaagtgtgattagtagcatgagccactgctcccagctgtgtatgcatttcttgcggacagttgtatagttgggtcttggattttgagcccatctgacaagtttttctttttaattgtactgtttaattgaactgaatttaattattgatatggttatgtttaagtttactatcttgctatttgttttctgtttgtcttttttgttcattattctttttacctctttcctgtcttcttttgtattattttttattatttcagttttctctactcttggtttagtggctatacctctttgtttagaatttaggtgttccctaaggtttaaactatataactttaatttatattcaccttcacataatattatactatttcacatataatgttagaagctttaagaatatacttccacttccccaccctctcctttatgctgttatcgtacattttacttctacagatgtcataaacctcacaatacactggcattattttttctttaaatggttaattttccttgaaagcaacttaaaaaaagaaaaatgtttgtatttacccatgtacttaccattttcagcactcttcactgatttttatatatacctgagtttctatgtagtattaataccattttcctttcacttgaagaccttctttaattatttctcactgtgcaagtctgctagtaatatcatcttttgtttgtcaggaaaatttttattttttcctttatcattgtagtaacttttcaatgaacatagaatactgagttgatgtcattttttaaacacttttctctggataaattattttttattttttgaggcgttagtttatttttcaaaataaatttcatcgtatgtatttgaggtttacaacatgatgttatagatacacatagatagtaaagttgtgacaacagtgaaacagattaacatgtctataatttcacatagtcactttttttgtgtgacaagagcaactaaaatcctacatatctaacaaaaatccctaatacagtacagtgatggttaatacggagtatcaacttggttggattgaaagatgcaaagtattgatcctgggtgcatctgtaagggtgttgccaaaggagattaccatttgagtcagtgggctgggaaaggcagactccctttaatctgggccggcaccatctaatcagctcccagtgtggctagaatataaggcaggcagaaaaacatacaaagactagactggcctagcctcccagcctacatctttctcctatgctgaatgcttcctgccctcgaacatcagactccaagttctttagttttgggtctcaggctggctctccttgctcctcatcttgcagatggcctattgtggaaccttgtgatcatgtgagttaatacttaataaactcccctttctatatatatatctatcctattagttctttccctctagagaaccctgactaacacaagtacaattttattaactgcgtaaagaatttactttgatttttttctttaatacttgaaaattttcattccattgtcccctggcttctattatttctgacgagaagtcaaaagtacacccatttttgttattttgaatgtactgtctttggggagtggtgattataaaaaagagaactttatcactggtttttagtaatttgattatgatgtgccttaatgttattttctttgtgtttactctgctttgggtttgctggccttatgtatctttggttttatgattttcatcaagttttgggcttattcctttgaatatatttctgtgccatttctttccccattcctgtggggcatcaattatgtatatgttaggcagatgttattcaatatgtcactgaggctctgttgtttttcgttttttacccctttctctttctctttcagtttggttagtttctatcactcttaccaatgtttacatctgcactgactaatctgatgttaagcctatccgacaaaattttaatttcaggtattatatattttttactctaagagttcatttgttttctttctttttggtttctatttctcttttcattatgtttctattttcctttaatctttgaatatgtttgtattatccttttatatacttgttgttttgctaaatccatcatctttgtcacttctgagtccacttctatggttaaattttcttgagtttcttttatcatactttttttcttctttaaacatctagtaagtttttgaggatgcaggatactgtgaacattacattgttgagggtctgaatttattttttgttttggtagtcagttaagctacttgtggatcagtttgattctttcaacacttatttttggttttggtttttggggtttttttaagcttttggaggacatgtctagtgtgacctttactttatgctagtttaaccctactattaaagccttaccttttggtgttttcactgaatgcctctgttatttaataatatctctctactatggctagaagtaactggaacatcttacagactattgtttttttgcctagcctgatggagtctcacactgcaacacacagcttagtgctcaggcaaagattcaaggaagactctgcatcggtttctgaaactctacttatgcatagctccctcttctctggtattgtgccctgaaaattccagccacctcagcctcccctaatttcatctctacctcctcaacttaatgagtcatccactttctgcttgtagtgatcttaagtctcacttcacttgtttcccttttctcagagatcgcagtcctttgctgcctgttgtccaatagctgaaaacaatggttcgatatattttgtccagttttccaattgtttataattggaggtcaactctagtaccagctttcagtcatcactagaagcagaagcattttaatgccttttaaatataatagtatattgtttagaaatttacttatacatcataccacagtgatttattgagtacctacgatgtgctaggtaccatgccaggatttggggatacaaaggaataactctttctatcttcaaggaagctcacagtctgttagagaggacaaacatgtaatataaatagttagaaaggtgtttgggagctcaaatgaggtcataagtaactatatggtgtggggtagaagtatttatgaagcaactagtctggttttataggtattctccaggttgagggctagccaaaaaaaaaaaagcattctagtcagacagagcaataaatggaaaggtagagagttataaaatagcacagtgtgtttataaagctagtttcattaattaatcattcatttaataaatgtgtctgtagggctgggtgcagtggctcatgcctgtaatcgcagtgctttgggaggccaaggtggaggatcgcttgagcctgggagtttgaggttacaatgaactatacttgcaccattgcattccagtttggatgacagagtgggacactgtttcaaaaacaataaataaaagaagaaatattagatgctatgcaaggtgttaagtgttgagcatccaaagggtgagtatgatgttcatgacttctgccttcatagagcatacagtctactgtttagtgtgaatggagcataaggtgtctagataaggatagtatttatggacaaggtagcaggaatggccaatagaaggcagattgtaagctaccttaattggtaccctaaggggctagttattgttatgaaagctactggcctccaaagttttctgactatatatccagcctataaaaatttcacatatttaccccaacatatgtatacatttattaataaactctataatgtatattattgtactgatatatacactgtaaaatacaccaaaaaatataaatgagataatttaaatataaatagacaagctagtattctcttcctgcattccatgctccatcttgcatatcttgggttcacgcaccttactttgtaaactagcaggaaatgggaagcattcaagcctcttttgcagcaaaaagatttgatcagaattctgattcataaagattctgaatatgacttttattttagttgtgctgaataatgtttttaaaagcataggagaagctgggctcatatgattccttccagttccagggttttgtagctgggggtgctccttagaagaggttagcaatctaacctagtgttgttgattagttgtgttattaagatacaatacacaagactaacgaagtgacttaaaatagactatccaatatggagttggtattccctgcagtgaaactgactttgttacttgcaagtcaccactttataaataaatgagtcacagcaaacaatccaactggtttcctatatagatatttcagtgggctacgtgtcagttttcatacataggccatgcttttttatattagaaaaacacaaaaccaaagaagttgatttgtataaggcagtgcttcttaaatggaagtaataaatctgacaggaatatttttttcctaaataaactttggcaaattactttttgattcatccatattatacctggaagtggagaaataaaggtggggcacactatccaaaaagctggactaagggagcagaactgggcagttttagaggtcccagaaatcagtggtacaggatagcagagacataaggcagatgagatgccaggttgtttagaaggctagtaactgggaagacagaattaggatgagttattccaaatcaggaagacacaattaccagagttaggacccagatgtgcaagagtttggagaatgcatgtaaagaaccagtcccgaggaaaacctcaatgactgaagaggcggcttgcttcagctcagcaggtctctgtgcaaacactaaggcggttaccagtgtaacttaggtgcagctgagaacctgactggaatgggacacaaaaaggctgaaagaaagatggtttgcaagaagtcagtgtgccccaaattcatcttcctaatgaaacatttatattacttatttctgaacttccaacggttcttttatggttttaaaaatattctctcatagaataaagggaagtgttcttcctaaattatatgagaatgtattagctgtgtctttatgtatacatttcctatgcagtttaagagcaacaatacataaactcattttaccaattggaaaactatgacaagaaaacttaggtaggagacggttcggtttgtttttgtcggtttccccccaactttgattttgttccctgtctaaatactgtaattgctttgtagcaaatgcacctttctcttgccccactttacctcacctctctcaaacaactgaggtaacatcacatcacaagccaagaacattctcattctgagttcacttggcagtagatagaacagtactccaacttgacaagcattatagcaggtaagaggggaaaaaaaatgggttactgatttgacatactgctgttgaaaactgtcctaaggctagtgggtgttcgctaaaaccaaaatgggccatggctagaggcacctgtagaatagttaatgacagtcatttagctttcattcatttttcagttcaaattattttagaatactttgttagttcagaacatgtttgcttaagtcatttcagtagtaatgcttttctacaggaggcaattaggtattcttcattttacagctcttgaataatagctaagaaaactgcaattgcacaagcaaagtgcagataaacaccagattatcatattaaagttcttattagtctgtcagaagaattttttgcactgaatgctttttagtttttttattatccattttttaaagtcagacttttccccaatgttagtttagttttaaataaattaatcagtctacatttttactaggaaactaatctttacttcacgtccctgccaccattaacttcagcctaaaatagcaaatttcccttcaaaattttaaaaatatgtataattttaattttttttttctgggctacccaatggcttctctactacaagctgtattagaaaaggtgaacctctccctatgtcaggtgtgattgctttgttaagaagcctattagtaatcctaaacccagtatgacagtggtcttttaaaataatagtaagtttcccatgtgtttgcagagtttcctaggtatttgaaaagccaccagccaggcacggtggctcacgcctgtaatcccaacactttgggaggttgaggcgggcagatcacaaggtcaaatgattgagaccatcctggccaacatggtgaaaccccatctccactacaaatacaaaaattagctgggcatggtggcacgtgcctgtagtcccggctacttgggaggctgaggcaggagaatcgcttgaactcgggaggcagaggttgcagtgagccgagatcatgccagcctgggcgaccgagcgagactccatctcaaaccaaaaaaaaaaaaagagaaaaagaaaaagaaaaaagaaaagccaccaaattaaagtgttcttaaatttacatgaatatttatgttttgcctatgaaactatatatactttcttttcaactatggtttcatcttctggaagggagaaactgtatctttggcaactatttctcttgtttctttcaacattcaggggagtgttaagaaagttagactatcagttaatatttctcagtttctatttgaaatagggtgtttttttcccaagatctgaagagaatacacagagattccccctcgtaaaatctaaaagcaaccttccctttactgcaggcattattgcaggttaaaaacaaaaggaaagaaactgaagttaccttagagtgtcataaaaaattaccaagaagtctaaaatcctgccatctgctttacgtgaaaactcttctagtgagaacccaaggcaaaaactgtgtgtttcttctgtaatacttcctcagagtatctattgtctttcaaatggggccaaggcttctcaagggaaaggaaatactctaaaataaaattgtagggtgcaacataatttgtgatttgttttcttttatgagtaaaattacatggtattttggccacctgtttataactgtgtaggtcctcccatgaggaatattgttgggtccagaagaaaaatagacaagtaggaggcatgcaccgttctttcagataccatctgattaattgcctctgacattccctgacctttgtctgctccagcacgtgttgtcagtgacagaggccttggactgccagttttgctatctttgctggcagaggggcagaaccgacacttttgtagccactggcaagactaagccttcaagtggggaaaaagattatttctgggttgtctgaactgccaagttagctccccaaatggtttgtgccacagcaggtttgatcttttcattgcatcctgagttacatcgatttcctttggctttttgacatggagaaaacaagacataagaaaatgaaccaagaccagttctttagtatttaagaactattccagtcaaaacgaaatagtctgggtatattgacaaagctagcttggaatattaacaaagttaattcaggtcaggatatctgacagaaataactagtcagtgggcaaggaattaatttattgtgttcatctgaacttccaatgagcttatatcaaggtaatgaatatgaccagattatggtttgcctgttgcacaaacagcaaatgccatctttcagatttcctggggggttatattcagttcttatggacagcttagcatagcagttaagagcacagatgctggagtcagactgcatgggattcaatcgcaactctgccactttctagtaaatttgggcaaattaatctatgcgcttcagtttccttatctttaaaatggggataattatggtacctacttcataaggttgtaatgagttataatcagtgacttgctaggtatgaaagcactttagcttagtgcctgatattgggaaagcactatacaagtgtagcagtagcagtgggtggtttatatatgacatacatgtcattggaacaactttcagcaccagctcctatcttttgtggttggatgctggatattttgaggacatttggggagtatgtcaaggctggtttcttttattctgttcaacctatttttcagggtgccttatttaataaaagttgatttgttgctttggaaatacaagctaattttatgaattatataaggacatcagggtaacttaaaagcacataatgcatttgtaaatatttgggattggtttatgttttggattgtcagaacagctacccttgaccccatcttggttgacccagtgaatgcatgtgaatttatagcagtcttgggtttttgcctggcaggaagcatctatcaagtacccagcaaatacccatttccctcctgcttgaaaactgagcttttcttgtggaacacttatccttgcacttaatatctggtttctgaatattcacattaaacaacagataatttgagttattttactattgatgtgtcatcaaataggaagatgactatcaataatatgacttttggtaaaatggaatagaaggagtactttaaatagaggcatcattagaaaaatgaacactggttcttaatacttaaaaaacactggttttaacaatacaatacaaagaaatatcacctatgattttgttccccttttatgtagagttttattttgaaaggtcgcattttgagtatttgagagactgagctcctctgcctggataatctccaggtgcaaaacataggaatgtctgtgaatacacactgggttgcacataatttaaccgcatgggctttggaattatgctgcctgtcctcatatcctggctttgccactctctggctgtatggtttgtccaagttacctaacctctgtagtcctcagtttcctcatacataacagtgttgtgagaatgaaatgaattaacaatataaatgaagcacaccacacactgcccaattggtagtaaaaattagttgctgctactgctacttactattactattattggtgctttgctattattagtactactaataataatgtcgttattcaaccaagtttctttccctaacaaacaaaatcaccaaaaagtactgtgtggagagcatgccctctgtaatgttgctattgaaaagattagagatattctcaagcttctttaatatctcaatgttaatccaccagccatgaattttcccaaagccttttcgaacatctaagcatgtccagctagtgctgcctcttgaaatcatgagttccatgatcttcctgggctatatagaaactgacatagagtgaccaaggccacttggttccagcgtcatgaagtggtgcctccctcctttttatgttacagacttggtgaacatatcacttttgatctctttcaaacacacagagtgattttttataaatccctgttgccccccttttatctcacacattatcttctaagcctaaagaatctttcaagtaatggtatagatatataaatatcttcttaaatggcagcttttcccccagtaaaatgacattcaagagtaaggcagtggttgtttctctatcatgatttctaatttttctagattctagcatagatgacctacggttgcctattctttttctaatgtacatctttttaagctcctttcaaagaattatagagaaagacggtcttatgcacccatttagtctgcccctgacttgggcaaacatcccttctatgtattaggaacagcagttttcccagctgaggtgataacagtcctagtcttgcaaaaacccaaccccagacctaaggcagtagactcaaacacatgcatgtgacaatcattttttgttgctgttatagagccaagttccattgttcagaatttttatgatattttatatatatatatatataattttgagacagggtctcactctgtcacccaggctggagtgcagtggtataaacttggctcactgtaacctccatctcttggcctcaagcaatcctcccacctcagccttctgagtagctgggactacaggtgcatgtcaccaaaccaaaataacttttgtattttttgtagagatggagttttgccttgttgcccaggctggtcttgaactccaaggctcaagtgatctgcccggcttagcctcccaaagtgctgggattataggcgtgagccaccacacccagctctgatgtatttttatctgatcctcaacatgaaccaggactttagaagagaaatgccatccttgcgccaatattaactatcacatttcccagcatctactgagctgtcttcacccatcttgccacctgacatcctgaaatttgggtgaaagtcttctctggcttactattctgaaaggcttgtattgtttccagacctcttaccttatttgtttgtattttatcatacagacatagtaaaatggtaatgaatatgctattttatattttttctgcctcctatataaaaataattagtggaaactatttgtaaaggaagatacatttacctttgttggctaaaagttatcttgattgccagtctgaatagtgccatggatggtataggcaggcctggggcatagatgggaacaaacctaaaagataagcaaagaatgggtggagagaagataagggtgcagagaaaacagaggctcatctggtagaaagaaataaagtgccctctgaaagtgtctcaagtgcttcctagtggcactggtgccataaggcagctgtgttgagtctaagccaagtatcttcctgatctccactgcttcctgcggctgaacggggcacaggtctttcatacacatttattgtaatttagggagtgaacatggtccaggtatttgaaaagaagactggttgtcaggaagcattccttctgcttctctgcattgtgtgtctgtgattatgtgtgtgactttatgagaagtatctgaccttctctctacacaattcctcctgcttgtgagataaggtgtgccctggctggggtgttggcaagcctggtgaacatgtctaaactactctgggggagagaattgtgagagtggggagggggtgcccttgggtccagccttcccagagcataaaaagaagtgacaccctgggacccagccactctgaggctcagggagggcttggtaaatgacttcatccacggtatgaaatggttaatttttctttgtctgaataaagatagaacatacaattacccatggatgattctcaggtaaaggctcatattgagtgtccgctgtgtttatggcatggttgtaagcctaatggataattaagaacacctaatcctcactctaaaggcaaagacagtaaaataggggaggggtaggcagactgacaggaaacacatacatagaaccctataaatcagtattattttatcagtcagtgacatgtctctttagcattcattatactttttaaaaaactcccaattaaattattgtctatgagtatattgaaagctcttctattttatttgtaaaagtttggctacttaatattccttcagaaacattaatgaaaataagattttccaattagtcaagtaaattcaggagcactgtgtaaggcatggagagggtaagagttgagggaactcaaattaatttattgaaacattaaagaaactgtatggaactactaacaaataacatgaaaagatacataattctttgcaagtataatgaatggactatattgaagttatccaaatgaatggaatattgtgataggttggaaaagtgagagaggtctagatggaggaaaaagagcttgaacagttcttaaaagacaggtaggagctagatcggtaaagatgagatgagttttctagctaaaggaaataactaacctataaaattgtttttaaaattttaatagtaaaagccatactcattcttacttattacttgctgggaaagaataaaatatttccaaaggaatttgggtgtttgaaaaaattgtagaaatattctgtatttttctcagaaaaaaattaaatattgtatttaaaagtgaccattagcctttctggtgtgactcagaaatgtttctgtatttaaatatcattgcaactttagttatatcttttccctgtgagcctggaaagacaagatgctggtatcatacctgagatcaattaacatttttatagtgtgtcgatatgattgatattaatacattataataaaacagactaattagagttagcgacaaactgttgagatggtggtattgatgaaatatctctgtccattgcaggagagttgcagcaatccactcatatagtgattacaccttgtgacaaaagacagtatcttcatatttcttcattttaagtcaaagcgtaaatgtaggcagagatgtttttaactaacatgactatgatcatctatgtgccattatctaattgctcacagaaatcaaattgtacaagtgccgaggaatctgaatccagtcttgagctgtcagtggagaatgtcagtcatttcagtaaattgcccccttagggtcatcctgtataattctttaattttaggcccaaaaaactatgaaaggaattttgtgtaaaatgtaccaaaagaactgtcccatttaaaacattttatgccatgcttggaaatgaaaatggacccttcaagaagtaagtctataagttgttttatcaacttatagatgttactcagatggaatggtaacaacttggcttgtgtgttctctaaaaaattatcacgttttcaagttatgcatttaacctgtattgacatatggaagttttgatgtagtttcctttctcaatcaactccaaagagtcaaaagtgattatcaaagctgaaaaggcttttgtattttcttcaaatgttaaagccatgtatgtgaacaacaaggctgatgaatttgctgttttatttcgttgacatcttaattcaaaatgtaaactgaagtttcttttcatttctttgcactgttaatattattctgtttttggttaggttgggtaaaaactgttcactggtgtcattttttataattagacttttatagcttggggtttttggtaagcaaataaatattttaaatgtaattggtgcaattactgtatgtgcactgaacaactttatattgagcttcatgtcatgtcacatttttatgctagtggtttcttatgatttttttaattgtatgtggtattcttctgaaatatataattaccaactcaccctgagttggagaagcaagagttctgtcgttctctcaaacagacttgtattgaaagatataaaaaagcttgctttattctaacattatttccccatcgataaaagtggttcatgtctatgttatttttacatcttgtacaatcccagcatcacattgttctagtaggagtacaaacagataacccaagcttagtccagatttgatttgggagaaactagaaggctgggaaaggtagatggaaggttgtgatgagtaggaggccaggggtaaaagcagaaggaaacaagaataatgtaaccattagctaaacatgaaattttacccctgctcctgccttcgtggcatcacataacatggagagttttaagatggcatatttgttctagcttcatcttttctcagaatgccaaccagcagcacattcaggccacatacaaaccacagcggagaggctagggcaaggattagtgtgagggtgagcccaaggagaaggggaaagtagtagcacagccctgggctctaggaagttttggagaggttttagaatggcaggatgaaaagtagtatcaaacaaaaccaaaaggtccttattaaaatcaattagcaaaaagaatctagaccgggcacaatggctcacacctataatcccagcactttgggaggccgaggcaggcagatcacttgaggtcaggagttcaaaaccagcctggccaacatggtgaaaccccgtctctactaaaaatacaaaaattagccagtcatggtggcaggtgcctgtaatccaagctactcaggaggctgaggcaggagaatcgcttaaacctgggaggcggaggctgcagtgagctgagattatgccactgcgctccagcctgggcaacagagcaagactccatctcaaaaggaatctaagaggagtcaaaatctaagtctaagataatcattcccaaatactctcttccaaagggtaggaagactgacagtgtcctactgaagggccagaaaaagaaattatctttgctcagtgttgaactattctgttataaagcattgtaaacattatagcaacacttatgaccattataaccctacatgtgttcccattgcatgtttaataatttctctactttaaaaaaattgagaactagatcgagaagacaactgattgtagaacagtcagagagcttcgtgctggtgaacattaatagagctataatagtctgccaaaattatgatgaaatcactggaggcatcaaggcaaaaaaacaaatcaaggggaagctattaacagtttagcatttctagtttgtgtgagaatatggattccagctagcagaagaatacttcaactcagattggctgttaggcattgctagaaatcttgtttgtttttgttttttgttttttttttcaaaaacaatattgaattctatactggttctgaaggtcaccttaataggagggctagtttacctgtctcataacgttacagaaaaatatgagcctaagggaaagagaaagttcaacaaacttcttacaattccatccagtgattctgaagctgaattagtactgactgcaataaaacctagtagattatttcaaatcttcactgcctagatgtgcgaagtcctgtcagaatctcctcaccaaatctgtgcactttatactaaggtgaacatttgcccagcctgttctttaagctagcctagaaaatcttcccacaagaaactttctaccctttttccccaaaaccatgaatctcaataatcttacattgattataatttggaaacactttattcaaattgcttcaaagaaaaccaccaccaggcccccaagtttccttagtgagaagccaaagactttagagacactagattctccaggaaggtatattagtgctttttaaagagctgcatgttgtctctggttagtaaacgatggttcatgtcttagatgaaagaaggatgagagccaatgggtctgtgctcttctccagttggaaggtgaaagtgatatgaaaaggctattagggaaagtatatttttctgcttacttttcttatcaatggtatattttaaaagtattccttggccgggcgcggtggctcacgcctgtaattccagcactttgggaggccgaggcgggcagaacacgaggtcaggagatcaagaccatcctggctaacatggtgaaactatgttactaagttcctctagctacatagctagctagagtctccccagtggcagcaattgtcaacattcctgtggtcaactacaataactccattgacattcaattcaaattttaattctactgttctcacttttagtttctttgttgtaccttcctttttgttggtcagttttcctttttcagttaccccttttcgtaaagtgtcacgttggtttatcactgggagacagggaaaagcaaaactacattctttgctgtctgtgcatggactgaataatgaagtgcagtgaacaatcaccaacagacttaaaagaagtgatgtgattggtcactgatcatgatgcgcatgtgttatttacatagcaatttgtagagaccaagcagtgaagtttgtacttcatgcagttactcatagttaacattctgtggtaactgaaacttgaactgtgttgctcgggggacaactgtgataactgaaatttgtgaatattgaaactatgggccgggcacagtggctcacacctgtaatcctagcacttcgggaggctgaggcgggtggatcacgaggtcaggagatcaagaccatcctggctaacacggtgaaaccccgtctctactaaaaaaatacaaaaaaattagccaggcgtggtagtgggcgcctgtagtcccagctactcaggaggctgaggcaggagaatggtgtgaacccaggaggtggagcttgcagtgagccgagatcccaccactacactccagcctgggcgacagagtgagactccgtctcaaaaaaaaaaaaaaaaaaaaaaaagaaactatgaacagcaatgattgcctgtataaggatgttcactacaccattatctgtattaggaaaaagtggagattaaaaacccgaatgaagaaacagttaagtaaaagttagcacatctacactaggcaattgttaaaaagaatgaggtcaatcttatatgtattgacagggaagggtgtccaatgacatgtcatgaaaaaaaagcttgttgtagaacattatgtatagtataatgccatgtatataaaaaagaaatatttatgtatatttgtttatttttatatttaggtttgatagaaaaagctctggaaggcccacctaattgtcagcaacaattactcctgcagagtagaaattgaggactggagtttggtggtgggcagactttcaaattgtattctcacactttttaataattttttccccaataaatgcatgattatttattaaattttcaaaaaaagtacaaaaatttaaaatctcatatgaggaaccatttaagatattttgcctgtcatggagaacatgatggcattcttcaaacatttgaagggccgtcattggaagaaagattacatttgttctgaaagatattgaacagctgatatgggaccaatggatgcaataaaatcatttcttaaactataagaaatgtaaaatccttttaaagaccatacacagggctttcagtcagaatgcctgagtcttaactccttcaccatcacttactaaccttgggtgtatttcttaacctttctaggtctcagcttttgtatctgtgaaatgagtaatcagactaatgctacctttgagagcagtgatatcttcaaggtgaagttagcgttgcttcataacccttctataatctccaccagctttctcccctagactaccccaaataaatatacaatctaagtaaaaacaaaaacatgagccagctaggtgaacacagcttccagacaagtactatagtcatccacttctaaccaaattactactataaaccctttctttataaaaagtcatctagagctgccactgcctcagaaggtgttgaagggattaaatgagatatttaatataacacttctagcgtgatgcctagcacatagtaaatactaatgaaacaaaaatcacacatacacatatcccactaaatcatgatataagtgagatgacattttaactgggggtatattgaacaggtttttcccttcagtgagggggggaaaatggtttgataattaaaagcctagcacactcttgttgctcttggatcctgtttcctttcagttttcctgcccttgaggttcagtgacttttctcattcttttgttaattcggccaccatttattgagtacctactgagttccaggttcagtcctaggtgctggccgtactaagatgaaaaaacagggactctgtgctcagacggctctagtcagaaagagaaggaagttggataattgcaatatgatgtgatctggattaaaaataaaggtctgtaaatgacattaatggagcaagcagaaaaacatactgaggtcagtctgagggagccagagaaagcatcctaaagggagaaacgtctgaactggagcttgaagggaagacaggcatctgctgggtagaaatcctcttcataggatgtatgcagatgctgcttgatgtgggttgtgaaattttccatgactgttcataaagctgaaatgacagtaaattttggcttctctttttcccaacatttggctgtagtgatggaaaaccgaacaagtaattattcaaatatgttagagatgtgatagaacaaactcacccattcctgctctcctgtccttaccctgtggctttcattcttagtatcaagcgggtcactgtacctttagccaaggccttctccctgtgaagctttgtaattttatcaggaaggaaagtctttcccctaaatcttccacttatgtctcattagacagaatggtgtcacgcagccaccataagttgtgagggaggctgaaaattaatctagcaaactacagtgcctgccagagcaagaaatacaacttctccataattcctatctggtttggtcttatttttatagttgtagccatttgttttagttctctggggtttctttaacaaagtaccacacactaagttacctaaaacaacaaaattattctttcacagttctggaggctagaagtccaaagtcaaggtgtagagccatgctccatctgaaacccctaggggagtccgtcactgcctccttgtagcttctgctgtcaatctttggcgtccctgggcttgcagctgcatcactccagtctccacctttgtcgtcacctggtgctctccctgggtgtctctctgtcttcacgtggccggtcatattggacgaggggcccactgtactccagtgtcacctcatcttaacctaactaacaatatctgcagtgaccctgtttccaaataaggtcatattttgaggtattgtgggttaggtggagggaaggagatcaatccataatatcattgctttgtgcttagtatataaataagaaatgctctatttccaagtgacgtttctttatacctaggattagtaatgaacttttaaaagccttatttttattcctagtttgagaaacaattactttaactacaaaattgtggcaatatgaaagattacttgataaaccattttcaaataactggttacaaatttagaagaaagtttaaaaatccagactatactgtatgccaaaaaaatgtacacatgtgttaaagagttaaatattttatagaattgcaggaactggtcttttgaatatttgtgtggttataagaatcagtaaagattataaaagattcataagtcctaactgtataaagttgtaaaacttattgcacaagaaaaaaaaaaaacagtgggaaatgacagactggaaacattacaacgaataattcagacaatagacatgaacaattcatacaactattaagaccccaatagctagctggtcaaaggatgtggccaatctaaaaacaccaggtttgttaagcaagcatatgggaaaatgttcagtaatagtttaaaagtgcagtttaaagtgaagtgtgactgataaattactctattgctgatggtgatataaattgatataatccttctgaagagcatttggcaaatacatccagagctataaaatgttcattcaattgatgtttctgggaacttaccctaactaaataggctaaagaagaaaaaagctgtgtttatgaagctgttaattgcagaaccatttgtaataaagtgaaaacttgggagcaatctagttacctgaaagtagaatagtcaactgacttacgcatcctttttttggaatatgcagacatcaaaagttcttgtaatgacctgtggcaacatgaagaaatacctgtgttttaaagttgcatgttttttagccagacgccgtggcatatgcctgtaatcccagcactttgctaggccgaggcgggtggatcacctgaggtcaggagtttaagaccagcctggccaacgtggtgaaaccctgtctctactaaagatacaaaaaaaggcactctagcctgggtgacagagtaaaactttgtcttaaataaataagtaaagttgcatgtttttagaaagtggcatctatgattgcagttatggtaaatttaaaagtatgcatgtggaaaaagtcagcaacagtgagatagtgaagtgtgtagaaggtattagggagcctggagttgtgttaaggtgaatgattacgaatccttttcccaactttcgtataatttaaaaaatatttaaatgtattcaacttacaatgagtttaaaatcctcctgtactttttgcatgttaatgaaaccattagaaggaaagaagaatttaatgagctttctgggaaaaaaaataattttgctcacagtagtattgtaaatcacaccagatgtttttctgtcatagaaaagtctgtactatagtgggattattctaatgtgaaaaagtgacatttgaagaaagctttttaatacagtatatgtgcattatatgattaatggtgatgtttttgactggtgaagtaattattttaatcctgtctcatcattcactgtagttttgttttgtggctgagattttaaagctatgtttataaataaaataactctacccacaggctggagagaaatagttttactttcaccatgacaaatgatctcttctgactttctagttatgacttaatagtgtggatttaatggcaggtgatcaatgtagttgatactattttagcaatcccttttacttgtgttcttataaagaggacttgcccctcgcttctcagagtcagagtttatgagaactgtaaaaacatgatcattagccctgttccttgttcctggtggggcacccctagcatgtttcctaggcttgctgaactgctcagcgtccgcaagggaacacaggtgctgactctctttgggggtgtgagaagtaaccagggatgacaacccctctggggtctccacaggtaaagcttgattatgcctctatggttgactaggctttgaattcactggtctgaatttactacctgaatattaaggttgggtggtagtgcatctcaccaccactgcctccccctctccaaagtaacaagcgcatgcacacacgtgcgtacagacacacactcttggacactggtttaacgtgaaacaatcaacatatcctttaagagaaaaggcggggtctagtgggaggagtgtgggagtgggagtgatgatggaaaggagttaatccgtatctccgaaataaagactagacaatgaggagccctgcaaagcagtgctggacaattgacatccactgactccctagtgaaatgcagcctgccctcagttattcagagaccgagcatctaaagtgtggattatccaggccatatgcttctcctcctttgccatctggctggttgcctgcttcccttcttattcacatggaaaatagtcaaaatacctcagtccatttctgccaaaccttttctattacctctatcaaccctccctttaagcttattctgtgcacatcctggtcaaatctggtcacttggcatattctgattcctcccaggacacattggctagtttctaacgtacagtcttgtgcttgttgatcctggcttcataagagtctttttttattatttctcacttcactagctcgtgagctcctttaaagcaagggacatctcctctgcttttaatatcctcttcaactggcccagagagctcctcttcacaaggcaggtgtgggacaagtgttgttggctaagtactattcattgtcatttcaaccagataagtaataagaaagtcacaacacagaggagaagtaagctgaagtgccatttgctgtaaaaatcaaccaaaagagaatcgcagacttttagaattggaaggaacattagatatagttttatctcattgatagagaaacatgggcccttaggagtgaagtaacttgtccttggtcacccagagcatttgtagcagagctaggactagacttcacctctttagagcccatttctcttatactccagtcatccaaggattataaaggaatggagttatgcagaaggtatgcagagaaggagtggcttaggttaggttcccaggaggaggagtctacattagtgacaggtgaccaaccaagattaatgaaaaattttatcccccttttaagtaaattaatcttttgggattgtagatataatagcaataatttggagttatttttattcattttaatgactgatctaaaacaagaattgaaaagatctcatcgagtgcctagaacaaaactgacacatagtagacatcaattaatatttgttgagtgaaagaatgaaaccaaaactgtcacattttagcctaaagactaggagtatttttcagttccagtataatcaaacccatttatgaaaattgttagagtctttctttgaattaaaattttcttagtttgccgtgtattttaattgactctggacaaataattcagccatgagttacaatgaacttataaatacctgtttttggatgctgtaaattaccagagaaagctagtgccctgtcacttaccaatgaaatgtccattgaacattttatgatcttagcctaaacatttcaaataggattcctgtaaatttccaaggtaaatctcaaacatcagataacatttccaaatccagttgtgggggaatgtaattctatgtaatttacatagaatttaggtttagaattatataattcatgaacctttacatgaaggcaaaattgaattctattgttttctttaagttttttacattactcaaataatacatattcatggtagagaaaaattagaaaatataggtaatcatgaagaagaaaaaaactactcttaatcctagaagccaaagattaactgttaacaattagttgtatgccctttagacctttttacacatattcatggggtcatatgctacaaaccatttttcgtttttgtttttttgtgaaacagagtctcactgtgtcacccaggctggagtacaatggcatgatcttggctcactgcaacctccacctcctgggttcaagcagttcttgtgtcttggcctcccgagtagctgggactacagacgtgtgtcaccatgcctggcgaattttttgtattttttggtagagacagggtttcgccatgttggccagattggtctcaaactcccggcctcgagtgatccacctgcttcggcctcccaaagtgctgggattacaggcgtgagccactgcgcccggcctacacgccattttaaaacaacttttttcatgtcttaggaatatttctcagtgtcaataaatatttctaggaaccattcttaatggttgcagagtatcctgttatgtacatgtaccataatttgtctaactaaccccttgcatttggatatttaggttattttccatttttttgccattataaatgatgctgtgatgaactttcttatttatatatcttgactcacgtgttcagtgatattcttagaatgcattctgaagagtacaattgctgaatttaaaatatatccagttttaagagtggaaaataggaatttttaggtgtcagagatcactttcatgtagactttgaaatgctggcttttagagacttagtacttaattttggctcttcatggcaataataaacacatttttattatgtattaatacaattgtatttgataaatgataagctcccaaatgcattgttttagatggttttcaaacatttaaatgctttaaatgctggtattcttctagtaataataatgatacattatgcctatcagtttcctcattcttttcaaagcctggatgctttatttggctagttgacatgaggcagtttcttgctggaggcaaaatgtcattggaccatgaactaatctcccttccccctccccattttacccacttctaggctgattatataaacaataatgtgttgtctttttaattaagtgaaagtgactcattacaggtgcttttcaaccatctgaacttatctcctaaataggccttgcattatctatacgcaaatgagaatatgattatccaggcaaggccactctagaaaagcatttaaagcaaggagcagagagtcttctccagttttgcacgcgataggatgtaagagcagagctatccaattagaaaaggagacaggggaggcggggaatgaggccatgcttaccgagcttgttcaacttgatgacattatggttttcatgataaagtctgcaataacctttatctttttgcattcaatttaatggccttggaatctggagaagccagtaggacctcatttaccatgtagcaaacatcagcctcttctggtacaatattttgtgctaactaaaagagacatgaaattaaaaataggtcagaaggctttccgttccagttttgttgatttaagtggggcagtggggagggtaggcaaaacattagtttcttttaagtgatattatggagaaaataatctattaatgagtgaaaagagattatagcactatgagaaaagtaaagattatgttttgtgaaaagagctctttctgaagcatcagagaagcataattcccaaaatgatttcaagttatctacaagtagttttggcttgaagaaagtaagggaatgttatttattggaaatattttaattgtctttatgtaaggctgtgatggaagaggtgaatgtgtgttttaccaaatcatttcttcattcataagacagtacatttaaatcctgtgagaaacttttctcaaaaggaatttttttcttttttttttaaaaaaatgaacaaaaataatgctgcttctgaaagtatgtttagaaggccctggcttctcaataagagtggataaggaatgtaaactcaggtacattacagcttttctcaaaaagaatttaattataagagtgtggataataaatgtaaattctgggccatggctacatgactgtaatgaaacacattatagaaatacaaatagctgttgacattctaggtgagttatttctcccttctccattccactatgacagtcgctctgtttcactgagcacgctgaaacccattgtgccctctaattatgatgctaaaggcctctggaaaaggtcccccccaccccaccttttttttattggtcactaacaaatccctcattattattcccaaattaagaaaaaaaccttatggcaagagtcaaagtgggcagagatgaccttctgacagaaaaaaagttcctattttaaatgaggtagcacacttaaacttatattcgaacaatgtgatccctctcaaatacactggataaatatttttctgacactgcaagcaggaagataagcatctccttatacaccagggccacaagtgctctcaagaagcacctactatcagaaagaaccacaaaactaaaatgattgatttttgacagggacattctgaatccagactgggtcacattaatgtgtttaacaggttgtttcagatatccttcagatatctgaggatacaggcagttgctaatttgttctaatgtgctggtcagagtgcagccccacctgaaatccagtttgtatgagagccatatgaaggccatcccgtggagaggtcaggacctctcagagttgaattttagaagattcagataacttcttcaatttgaggttcctggtacattaaagaactaaagaaatgccagaagagtgttgcacaagttaattgattttcagtggttacatataacatatcaatgtctaacctgactcatttggagagggctttaaaagtcttagcattgaggatccccatgaatattgtgaacctgaagttcagaatgactcttccaccctccctatgaaaggattggcagatcagaaatttggttacatgtgccatcaagatatttctggccaaggtcatgccttccatgctttatggtatgtaagtttggaattaaactaagtcttcaagttcatgaatagatggacatagaacttttttcggaacaattcatgtccctgactacaagtgttcctggggccacgtctgaaagcagcttatcacttcactaatacagcaaaagcaaggcattctgttgttcaaaatacatctttgccaggtacatgcttactactttgtagatttttaggaccaaaaaaagcttattttggtaaccgaataactgacaatgatggattctcaaacatttctgctaaccaaagaaggaaaatgagattgtacccctttagagctggagtccaaaatagtatggcatacttaacgtttatctaacatcttaggtgttcatttcaaaattcatataaatgtctcattttcctccatactctgtttttatataaaataatggtatctctctcctcaaattatttttcacacagatttactctcctgaattttccagaaatgtagatacttttaaatcaaaggaaggctgtattttgttttgttcagaacttttctattccagaaaatcatgtcaattgacagcaaagccacttgtggtcattgagcctcctgtgtaaagcaccgacgtcattctgtagttgtcatcactgtattcagggtgattctacacgtaggagtgagcatttgacagcttccatgtcttctagtgcggctgagaatttacatattaagatacacattatttattatcaattactttcctgtttcaatgtccatttagagcactaaaaatatctttgtaggtagttgatattacttatgaattttatttcaggagagcaaaggaaaatacaagatagttgtatgaaaagggggcaccgggtgtgctagagtggctcaccaccgccctacacagtgggctaattggctggagagtagagctgactctgcacagttgcatgctgaccctctgaagaatttttttacaaaagcgtgacgtcgcgtgaagaccttgacagaattagcaaagcggttgagatgcatactttggagtcagacagactccagttcacatcttggcttttatacttacagctgtataaccgtagacaatctatctaccctctggccgactccatttcctcaattataagataggataacttgtgaaatgctttccacaagattactattgcatttattctcctcaccactcttaatgaagagagtcttgtaacagataactctaattgtcttcagagttcaggtccccaagaaagattatgccttctaaaagctagtctgtttccttccagtgggagccatttcattcatgctgctctactctttacttggactgctagcaaacatggagctaagtactcatgcttaatttctgtggctttcctcaaatagggtttcaatactatagtttgccctcactccattccctcctccaattcccccttactgctaaattttggtctttcatcccatgttgttagctgttggtcctagtgatcctgtggtttttattataaaaccacttttgtgtgtgtgtgtagtttttttttttttttttttttttggtaaaatgattatcttaaatcatttagaaaaagtaggtgaggctaggcacagtggctcacacctgtaaccccaacagtttcaaggccaaggcaggaggatttcttgagcccaggagttcaagatcagcttaggcaacatagtgagaccttatctctacaaaataaaaaataaaaaaattagccaggtttggtggctacatgcctgtaggcccagctacttgggaggctgaagtggaaggacagcttgagcccaggaggttgaggctgcagtgagctgtgattataacactgcactccagcttgggcaacagaacaagacccagtttcaagaaagaaaaagtggcggagggcggagttcagtgggtcatgcctataatcccagccctttgggaggctgaggtgggaggatcctctgagctcaggagttctagaccagcctgggcaacatagggaaaccccatctctacaaaaaaaaaaaaaagaaaaattagatggaaattaaataagtaaaataagaacgaaataataaagttccattctctttatggtactttatagtatttatttctgtaggtggcaaagttacttttttcccttaatttatactgtctattcatggtagtattagatctttactgtatcacttacttggggaaatatgacaataacactaagatgatattttacctaaaatactcatctatagagttatttcagcataaactatttatttctattttcttagcaaaaatctgaagaatagcacacattgctgtctctcatcatattattatagaacagtaattctcaagatttttggtccctggacacctctttgcacttttaaaaattattgaagacccaaagaacttttgtttatatgagttatatctatcaatatttattgtattagaaattaaaactgagaaattttaaaaatatttacaaactcattcaaaataacattaaactcattatgtcttaacataaataacatatttttatgaaaagtaattatattttccaaaacaacaataatgggtaaaacattcttatagaagagtgtcattatttttacaaacctctttaatgtctgtcttagtggaagacagctggactgtcttatctgcttctgcatttagtcttttgccataacgtatgttatgtggcctcatgtgagaatgagagtgaaaagggcaaatatgtatcattactattattatcgttaaaatagcttggaccttatagatctcctggaagtgtcaaggggatgctccagggtctggactacactttgagaactgctgctgtatagaagataggcaatgcatattgcaacataagaaatggaaataatattttgctcacattttaatttttagtggtttcaaagagccactaagttttaaaaaatatgcctcttaatccttcctccaaagtctacagaaacattaagggtcaaactatggttgacaagaaagtttagattttttccttgaagatctggccaatatatttttttgtttgtttgttttgagacagggtctcacgctgatgcctaggctggagtacagtggcacaatcatggctcactgcagcctcagctcaggtgatcctctcacctcagcttcctgagtagctgggactatgggcacacactaccatgcctggcaaatgttttgtgtattttgtagagacagggtctcactatgttgcccaggctggtcttgaactcctgggttcaagtgatcctcccatcttggcctcccacacctggccaccacacctggccaggccagtgtattttgaaaggtactagcaatatatggcatcaatgttatgtttttgggaatagtttttttttaaatatatgtattgaacagggatgatccttttacttgtggtatataagaaaacttagcttttttacccttccaatctatagtggtaaagttgctttattaaaccattatttttatttgtgtgtgttgcttgttgtatcatctttataccattcaataatgagagtagaacaaatcgatttctcttattcctgctgtgagatggttcataatgaaaggtagatggcttgcctaatttacagagtggcattaggttcagaatgagttagtacagaagaataacacattttattttgctctattttatttttctttatttaggtaataacaacaatggttgtgagcagcctttttttttttttttttttttttgagacggagtctcgctcagctgcccaggctggagtgcagtggcatgatctcagctcagtgctaccactgtttcctgggttcaagcgattctcccatctcagcctccttagcagctgggattacaggcactcgtcattatgcccagctaatttctgtgtttttagtagagaaagggtttcaccatgttggccaggctggtcttgaactcctgacctcaggtgagcagactttaagccttggtattgctataagactaaggatggcagctgcactttcagtgtgatagaatctccgttacagtgtgattttgctagtttcattaattacttgtgttttgtttctctttccatgaaagaacaatcttaaactatcaagcacttccccaggagaaaatggatcacttgcccaacagtggcattagagttaggtttaggatattttgaagtggcagaggtattaagtagtcttagtagacacaacccaactaaatttctttgggtttcagacaggtggtggtaaaatagacaaggtcaagaagtgtcaactactatctctagtgactacatgagtccttgctgggccctgtgaatctcctttatatcacatcagacttttcatggaagattagattatgccttcacctaaaaaatagcttgcccatatgagtctatatctatcactgtatgcaaccctcatgatttgggacagctgtaattattgggaaaggttttttcccaacttaatcagagactaacagatactgttgtccacactatagtacctcaagtgtttgaagacagttcccatgttttactcttggatctgcatgagccttctcatctccagcctcagctctgttctttatatgaaaatgttgccagtccctttcctacccttgttctctctcctgttgtcctgttccagttttcattgtccgtcttaaaagtatgatgcctagaatgacaatcagtgcttctgatattgaacgactataagaggagagtggggccaactgctttcttactgccattgtctgctaatgaagctgaagatctggcttctttggcagttgtatcacaggaacttgtactgtgtttactgtcaatggaaattgtgtcttagtcacatcaaactattaagctatattttcctcatcctgcatttgggcaattgtacgtgcacattcaaaactgaatccattgaagtttcacaagaaagtgttcttttttgttttctgtttttgtcagtggaaataacattttatttaatttttttagatatgggggtctcactttgtcacccaagatggagtgcagtggtgccatcatatctcactgctcaggtaatcctctcacctcagcatcctgagtagcatatgcatcaccatgccaggttaaattttaatttttttgtagagatgggattttgccatattgcccaggctggtcttgaactcctgggctcaagcgactttcctacctcagcctcccaaagtgctgggattagagatgtgtgctattgttcctggcctaactttttattttgctgtaattttaaatttacaggaaggtttcaagaatagttcaaaagattcctatatgtcatttgctttatcattctctaaatgaataaatatagattagatacacatataaataattacatataagttttttctggacaatttgagagtaaattgcagattatcatgcctctttaaatatttcagtttatttttaccaagaataagaatattttcttaaacagccatggtataattataaaatcaggaaatttaacattggtataataccattatctaatccatgatccacactcaagtctcaccaattatcccactaaggtcctttatagtgtttttggaagtgggagggtttccaggtccagaatccaatctaggatcatgcatttcattcatatacctgctaatttctccacctgagaagagatgttcttatccttcaaaaattggatagtagctgtgtggattacccactcctttgtccatagcttctacatcattgattcgcaaacattccactaccatcttcaagcaaaaccaaaacaaataaatcagtctgttcatctttgagcttccccttctgtgaaatcttgtttagtatcttaactatggacatttcaatgtggacatcagagagtaataacttttaaaaggttcattattctccactcaagtccattttcagaagctttgcattcagtgagcctttcttctccttcctgcagatgtggcatggctgttagattgtccttttgccctgaggctcccatgtcagttatgccccaatgcctattctcatggggttttaattgcctataacattttattgttcaccctcttcagtctcctaaactctatttatttctcaaggtaccatcttgttcgtgaatctttccattcatttatataacaaatggtcaccttctatgtggtaacattgttcttaggtgctgggagtacagcagtgagcaaaccacaaatagtcttgccttttaacacttacattcttgtgggggaagataaataagataaataaaatttatggtaagtgagatggtaataagtctaaggagaaaaaaaaataaaggagataaggagtgatgggggaggtacagtttaagttgggtggccagggaaggttgctaagtcattactgcagcaaagcctctgaactctgctttttctgaattcttcagtctgtaagtagttaatctcaattaaacagttgggttatagttgtttcatgataatctgtttattaaaagcagcagagtggaaagcacttggtttctgaaattagacataagtttgaatatacatttagttgccaagtaaacttggataaaatatgtagcctctctaagactatacttttatgatctataaaatgaggctaatgatgccttataggtttgttaagaggactaaatgaaatagcaaagatgtagcatctaacattgcttggaacaaacgttagaaatttaacaaatgttaaatttaacaaatgttagaaatcctattgtctcctctatgtggaatcctattgtctcctcttggtgtcacccacaggagctaagctcagtgctgggtatagaatagatgtgtaatagacatgttcggtaatcagtgtcctattattggctcagcttttatttcattaatttagtcacatgacatttactagcactttctgtatataaggtgctatgaatattaatacaaccctaaggtgtttataatttaagaggaaataaaacaaatacataaattaagctagaatgtaaagataaaagtaaagacaaatacaataagagaggcaggcacaaattgatattggtattcacatgagattgcctcctcagtggagagaaagttttaagaagaggtgacattggaactgtgtcctaaatttctgaaagggttttaaaggagatttcaaaaaaaaagcagacagaaaatgagcagaaactagtggatggaaaatagccttcagaatgcaagaaactggcaggtggttcagtgtgggtcacagtgattctcagctctggctgtagagtagatactggaagggccctataaaagatactgctattcattgctaccccccaggaattctgatatagttggtctagtatgggacttaaacattgtcaattttaaaaaaagaagaagttctcaaagaggtttttttgtttgtttgttttttgtttttgagactgagtcttgctttgttgcccaggctggagtgcagtggtgcgatctcggctcactgcaacctctgcctcccgggttcaagcaattctcctgcctcagcctcctgagtagctgggattacaggcacccgccatcatgcccggctaatttttgtatttttggtagagacggggtttcaccatgttggccatgttggtcttgaacccctgacctcaggtgatcctcccgcctctgcctcccaaagtgctgggattacaggtgtgagccaccgtgcccggcctcagagaggttttaacgtgcagccatgggctgagacctcaggccagagtatactataggggaaaggtttaagatcaaccaagaaccttatattgaggccatattgtagaggccttgtttcagattaaggagtttgattttaatttaggaaatcattgcccttgaaccaggcaatgatagctggaccacttctgaacttcctggatggttgatcagatttttaaggcatttgtccctcaatgctcctgtcttcattgtattactgtgatttgggtacatttcttatatgccctataagcataccaaaggtgaaaagggggttgtactcatctttccgtcttcttcagtacctaatattgtcttacatttatattccctgtaagtgtttgttgaatgagtgaatgaattagtcaaggatcagagctgcaattcgatttggggtccatacatcaaatcagtagactgctgcaatatgagcacctgggtaagaacactggcagcagggatggagagaagacacccataatacctgctgcagaagaagtggttctattttgtcctttaaaggtggccaaatcactcacccgtcaaactgactcagagttaaagcggactaggaaaaacacggagataatgaaagaaataggcaagccatgtgaatttaggagaagatagattttaaatcgtttgcattgaaacttcagagatacatccagattgagctgtttctcaggcagatggaaatgtaggtttgatctttggaaagaggttaagagatttacatttataacttaagcatagataaggaaaaaatgaaatgtgagggaaaaaattgttcgacctgaataggcagatggaaagtagtggttctgagcaaaatttcagacagtttcatcaagtcattgattttctaaaaaatacatactgttataatttggggctttctgttctttacctgaaacataactaaattctgctttttctttatcaacattttcccactgcactatctattcacagcttgatgaaaaagtccaggacccccccgagccctttggcccccagaatgcgataagcagcctaagcccagcctggtgtccttaacttctcctcctgcaaatagggtgaacagacagacaccaagatctaagttcaggaaggagaagccaccacgttctccagtccaactttattagtaataaaactgaacttgtattttgatctccttttggctcctggaatctttttttttttttttttgagacagagtctggctctgtcacccaagctggaatgcagtggcacagtctcggctcactgagcctccgcctcctgggttcaagggattctcctgcctcagcctccaagtagctgggagtacaggcgcgagccgccatgcccggctaatttttgtatttttagtaaagatgggatttctccacgttggccaggatggtcttgatctcctgacctcgtgatctgcccgcctcggcctcccaaagtgctgggattacaggtgtgagctaccacgcccagctatgttcttaatttgttaagaatccatacaggaggagaagtaaccaatttgcctacccccaaaccttctgcacttataaaccttaaatctttgtacagcagtctggtcatatattgaatctaaagatatagccatactcatctagggatttgataaaatgttctgaaatggacattttagctgcagggaggcaaaacccgagagacctttgtatcagcttgtgttcttggaaagagagcctccaattcagaccacccatcgctgggagctttaggatccaacagttccctgagggccttagcttctagctaaagtctcctgactaaatggattgatttcctatcttcccataagggactatgttgactcattccatccaccccgtgtttacctctatcaccagcagatgatatccccatccggctctcccctgaggaccctgcttcccttgctgccctctcagcagctgaagaggtttctttcatccttcctactgtggctccaccttgccaccttcacacatttctcctgtctcaagaactgtagaccctttaaagcacaagttgctattatccgctaatgtttaagacactccctcttatttgctgaagattttagaacttggctcactatcttcctctttgtcattattctcaaagtcttcaacatccacatagatagatcatctatctgtagtttgttattcctccccgttatctccatagttctttccctgcacaccctcttagctacctacccccgcagtcataccccagaccttgtcatcaccaataaccacaccacctctgaaatctccaggtcaagcatcccattctctgatccccaacttctttttctacagctcaggtactgtgatagctccactccaacagtgtttcattttggacctccactccaacaccgtttacgtttttcattgctcatcactccctcctccctgcctgcctcaggttctcatttatcttcttccctatttaggttccatgcccatgactaggtatttcatcctcgacactcagcctctatgccccttcctctctcacttcaacagtccagctctaattaaactctgagcctgtccctgagcagctgactgtggcaatcaaccatgctgagtggctttggtttgaataatgaccacagatctcaaatcagcatttgagaaatcctgctacatttccctggtaaatttgttcttcaaacccctccaatatctcctctcctattattctcagctgatgacctggctgatcttgcattgaggaaacagaagcaactacaccagaactacttcatttcccatcactagagccacctgtccacctgtgtctgtgtcgtgtctcctccttttcctttggtaacagtgaatgaatggaccacccttgctcctcactaaggctaggcattcttcttatgcttcagaccccagctctcctcgccagcttaagtattttgctcctaaaattattccgtttccttcattaccacattcctctctctgctgatcgactcctatcaccataaaatcatgtggcagtatcactcgtcttcagaaaaggaaagacaagacccctcttgactccacagtgccctctagctatcttgtttctctgctctttttcatagcaaagtaccttgagttgtctatagtgttctattgcctcacctccagttcacccttatttttctttactttttttgaaatacacatacaagacagcatatataattcgtagaatattaccaatgtttttaacactttgtgcatcctttcccaatagtgtgcccttacctccactgcttaagtaaccactctctcaaatttttgccatcatttacttgcttttcttttttcttttttcttttttttttgagacagagtctcactctgatgcccaggctggagtacagtggtgcagtcttggctcactacaacctctgcctcccaggttgaagcaattcttatgcctcagcctcccaagtagctgggactacaggtgcctgccacaacgcctggctaatttttttgtattttagtagaggcagggtttcaccatgttggccaggctggtcttgaactccagagctcaggcaatccacccacttcagcctcccacagtgctagaattacaggcgtgagccactgcacctgacccccacttgttttttgtttgtttttgtttttaataattttacaatatacatatgtatccctaaataatacatttttgttttgcatgttttggacttatgtatatggaatcttattatatattcttctgtgaattgcttatgttgctcacctttagatttttaaaaaattcatatggtgtataattcatttttactgcaatataatattctactgtatgatattagtttatttttccagtgtattgttgatggacacttgggtcacttcaggattttttgccattacagacaaagctactatggacatcctcgtacttggctcctagcacatgtgtgcaaaaatttctgtagggcatatactgaggagtggaattagtgggttgcctttacttgatgttacctaattatcctctgaagtgttgtatcaatttatactaatataagcactggatgaaagttcccattccaccatatgtttgtcaaaacttggtgctatctgacttttaaaaattttgctagtctgttcgttaagtaatggcatctcattatggttttttttttctttctttttcttcagacagggtctcgctctgtcacctaggctggagtgcagtggcacaatcccggctcactgcagcctcagcctcctgggcttaggtgatcctcccacctcagccttccaagtagctgggactacaggtgtgtgccaccacatctggctaatttttgtattttttgtagagacgaagtttcaccatgttgcccaggctggtctcgaactcctgggctcaagtgatctgctcacctcagcctcccaaagtgccaggattacaggtgtgagtccctgtgcctggctcattatggttttaatctgtatttccctatttactaatcagctacttttcaatgattataggctttcatgttttctctcttgtgaaatgcctatttgtatttttggcccatttttctactgggttaattgtctttcccttattgatttgtaagaatgtcttatatattctgaatactaatccttgatcagttatgtgttacaattatcttctcccagtttttagcttgtctgtttactgttgttatggtgccttaatgaacagaaatttcttgaactataagaaattgcttatatgtgatgattttcacttacacaaactattccatgtggttcctggagagctcattaaaacacagactgggctgggtgtggtggctccacctataatctcaatacttttggaggctgaggcaggaggatcacttgacaccaggagttcaagaccagcctggtcaacatagggagaccccatctctaaaaaaatcactggagtgcagtgattgcaccactgcactccagactgggcagcagagcgagatcttctctctaaaaataacaataaaaattagttgggcatgctggtgcatacctatggtcctagccactcaggaggctgaggtgggaggatcagttgagccccagtgttaaaggctgcagagagctatgatcatgctacgataatgccactgcactgcagcctgggtgtcagtgagaccctgtctctaaaaaataaataaataaataataaaaatttaaaaacacagattgctggaccccacctccagagtttctgattcggtaggtctgggatggagccttaaaatttgcatttctagaaagtccctaggttatgctgctgatccaggaaccacactttaagaaacgctgcctcagccaggtctgtcttctgaacatctttcgccaatcctctctccatggttccttagagattacactctattgcctaaaatataatccacctcttctgctcttgacctatcaatttttgggccctgggtcaccttaattgactttttaccaggccttctcaatcctgggtacagatagctagttgcctaaggaatgcttgcaatattaataaatgctgcctttttgttcaaagttaacaggtagcttttagaatggcctagtattattgattagctgactttgtagtctcctttaggagtataagtgtgctgaagttattctgatacaacgttaagtcatgaatcaaactcattgtccttccatgctccagtacctagtctccttccccaaaatcctacccccttttttccttcaaaattgcacttcagatctgcatcctttcctgtcatcagttagtcccctaaatccccagtcctatttgtgatacccatgtatttttctgggacatgaataacaacctcaaacatcttaataataaagcctcagatgggtaacaggaatacactgcaaaaattaaattacaatatttaagccttccttgtaatttatttagagccaggtttcccagcagtgacactgttggccttctgggcagatgactgtttgttgtctgggcctgcccggtgcactgagggtgttcaacagcagcagtggcctccactcaccatgccagtggctctccaccctcaccccgtgtggccaccccaaatgtcctttgagggcaaaaacctcctctggttgagaaccactgatttagagacatctcatgccttatttgaattttcagggatttttttggtgtgaagtattgtcagctggtttgggccttttaaaatttcaactccccaagcccttttaatcttctccatttcttttttatcatatatttctctttgtttctggctaaaagagggcattgtattttcatgattttttgaaaaccgattctcaaccacatttctccaagacaaagggcagttcccaccaaacacacagaagcagaccctaggacacacttcagattcttttcctgcccttcctgcaagtattactctcaccataggatggtggtagttactgtgattaatatacttttaactgtaatgcgattatagaaaatcatgccaaaattgctagagctaaaacttgacctgccccgacaggatgatgaaaactcaataccattctccctgaccctccccatccgcctcactccccaaatagtcttgcttcttaatgagtaagagtagtttaagctgcaattatttcctcttacactgactgtccttttcaccctgattactctttggatgtataatggggagatagccgcatgcagactagcaaggaggtctggtgaatggcagcaatacatacttactcgggaagagtgcattccactctcagaacaacctgcccaaactgaatgcggctcacaagtggagtgggcagagctttttacaatttcaatttgaaatgccacttttctagttttcgtggctaaaatagtaaataattttgtgggtttttttttcagctgctcttcatttgacatttgctgagcccctcttgaatttacttttgcagaacaagaccatttgtaccccaactatttgtaccattaggccactgctcctttttagttgcatttagggaccttctccaattcagtctctttctacatgagcagagcacctattcattcaaagggaacaccatgacacagccagagactatgccccgggagtataaagagctttgtgtctgcttcccagtttcagaaactcatagttgcttatttaccagatatcaaccaagctctgggtaccaggcacttttgtacatttctagttttgtcttagctgagataaataccaactaccctgaagtactgtaagatgtacaagtaccttattaatcatccaaaaaaaaagcctaagcaataacagtgttttatattagtttgagggttagatgaattctatttttagctatatttttctaggtagcagttctaataaacagacatttcataactactaatcaaaataagtcaatgccttggttatctgtaattttctcttacaacaactttagacactggaatagcactgaaatagggagtaatgatcttaattgtgtatttcttggtaaatgacagaattcctccatatatatgattttgtttgatttttttaattggcactacgggcaaaggaagaaactttggggcaatgagtggttttaaaaacataggctgggcgacgtggctcatgcctgtaatcccagcattttgggaggctgagatgggaggattgctggaggccaggagtttgcaatcaccctggtcaatacaaggagaccccatctctacaaaaatttcaaaaagtcagcagggtatggtggcatgtacctgtgggtccagctacttgggaggctgaggtgggaggatcatttgagcttcagaggtcaaggctgcagtaagccatgattgcacgccactgcactccagcctgggggacagaatgagaccctgtttaaaaaaaaaaaaaaagagagagagaaagagaaagaaagagagagaggaaggaaggaaggaaggaaggaaggaaggaaggaaggaaggaaggaaggagggaaggaagaaatctatacacccaaaaacctaaacatcatccctgatgagtgtgaccagcttgcttatcaaaaggcaaagaggggttctcatttggtggcggtagctatctaaaccaaggcacttgctgcaaaacctagaaacatgggaaaatgacaaataaaggagccaagcaaaataagcgttaaggaaagggggaagaagaaaatatgaagactgcaggacaaagaagggagatgactggaaagagaagtgaagatttcaacactgatgtgagaaagtgacagcataagttacaaagaatttgggaaagattaaatacttcttcagggtgggaacaaacagccgagcataatggaacagtcttttaggacacccagccctcagagctccagacacctcacttcataccagtttagcccagtaactgctcttcatagcaaatctccttcttgctgaagaaaagtttgaatcatgtttgctattttcatgcaccaaaaccttcaaaattacctaaagaaaaaaagaagtttgcttaatttcccctgtaatgaaagtctgtgtggaatcacttattgtctgacaggtctcactaaatttgacgttcctgtcctggatttatcaggatacctcattacttcatcatgctatatgtaagagtcaactagaatatagtcaactcattattgtttgaatgatgtaagaaggaaaggttgataatccaaaagggtatgcaaacccctgtgatttatacttggttatttgcatttgtattttgatattataaacttgcccctttgtattgtaacaatctgttaacccatctgtctcctccactagactatcagcatcttgactgcagggaccatcttagtatccaaaagctagagcacagtctctggcacatagctggggttcgaaaaatgttaaataaatgaagaaaaacatgtatctgatctgagaaatcactgcaaacaaagtaatgcctccacacaatgaaaacactcagtaacacctggaaagcttaactgcttgtctctcagactgctgcgaagcccccaacctcaaccaaagtgccctactgtaaatcttttcccagaataacggaagtggttaagtgttcaggtgtcaaaatgctaccctgctgggctgcaggccacatacaaagttatattacattgagtttgaaatgctaacaaagcaagtaattaagctgagtaagtgctaacttgcttgcaagcaagatttgaagctgataaaccaaaatgctgataattaagagttgattatacagctttgttgtttctctaccctgctaatagcctcacattcttggcatgtaatgatttcttccccacaaggaaaaaaaaaacacacaaactatcaatcttctcctcctgtctcccaccctgaaaaaggtgtgactccctcctttcttaagctaaatcctctccctgtggtcttgatccttctctctattgcatcttttacctctcactctccacgaatttcttcttttctgtttgcaaacatgctcgggatttaccaaccttaagggggggaaaaaaaaaaaggcaagccagcaaatgatagtaggagaatcttcccttactctacattcccttaattctctcccatctttctcctctgtatcccctaacctcttggaaaaggaatctgtgttccttgcctcctcaacttgatggctgattgctttttattcccttaaacacttctcctggtttcagcactctaatgaggctctttcaaaagctataaataattcttaattgtcagattccggaatctttattttcttcatctctgcaatctttcacatggttgacctgcccctttggtagaactattaaaggggcttttatgacttccatgacattcttaccttctggttttcttcttccttctcttattactctcctcaccctccctgttctccttctttcttttccttcttcctttctggtaagagaggaaaagaaactaatatttattgacatacaagacaaattatttgtcagatgttgtgccaagttttcaaacgtcttttattgtcacatcaaccctaggatatagatattcttatctccattttaaaaattatttatttttaattgtggtaaaatacacataatgtaaaatttaccatttgcatcattttaagtgtacagttcagtggtattaattatattcacatcattgtgcaaacattaccaccatcaatttccagagctcttttcattttcccaaactgaaactctgtcaccattaaacaatagctctccattctcccctcccccagcccttggcaaccatcattctactttctttctttgtgaatttgaccactctgggtaccgcaaataagtaaaattgtacagtatttttctttttgtggctagcttgttttacttagcatgatgtcccccaaggttcatccatgttgtaacatgtgccagaatttctttcgtttttaaggccaaataatattccattgcatatacataccatattttgtttatccacccaactttcaatcatccgcatataaatggtgaaactgtggctcagactagtgcagtaaactcattgaggttgcacagcttttccctctggggaagcattcttctaaattctatccttagtcttatttcctctttccctctctcgctctctctctcttccctctctttgctgatctactcccatatttttaattttaatctccatccatgtgggtgtttcttaaatgtatatcccaaatttatccttggtactgaatctagttccatatttccagtagatccaaccagaatattcccatattgctttcaattcactatgtataaaacccaaatgcgttatcatctgatcctcaaaacaggcttgactttctcacactcctattgttgttaatggcaccacaaatttcccagtcatctggaccctaaacctctgagtcatccttaagcctctttctccacatctcccaaattccgtaaatcctaaagtcagtcttgtcagttgggtctccctaatcatcttcatgcccattccagccttgctgtgcctgcagaaggggtcctacagtctggtgggtctaagagcttgggttgggcttaagtcccagcccagccactcactggcatggagaggacggaaggtgtttggctagtcacctgacctcactgagcctcagcttcctcatctgagagagagaacctaatgagcaaggtatgttgatccttaaatgaaatagtatttatgaatagttcagcacaatgcccagcatttagtagatgctaagtaaatggttattttttcttcttttttaaaaaattctgtcttcctgcttctaattcactagccttcttccctcataaggattttttttctctctctcagaattctctgcaggaaacaaaccactgtattttagcattatgttttattttacagtgcccttgattctttatacctgtctgaggacagtgactgtgctgaccctttacatttgtgtttcaacaatcctgaaggggattttcatctcctgaactgctttatcaatattgttttataaacaattgtgacctacaaaatttattgagcccaacctcattttttaaaggactgctataaagtcagtggaatagcattttcatgattaagagcagtcggagggattaatggagaggcagcatgagcttattcctaactttgagtgtgccaggagttttaacagggataagaggagtcaccaaacatctcttccctgtcccttgtattattttgcaagaacataggcaaacttgtgcatatttcagcagaagggatatctgggtagaagattgcattcagtttgtggagtaagggcatgcaagcaattaaatcccaacttcctcatcagcagtctgtactcaggagagctgtccagagtagccaggccacatccagccacattggagataggaattccatgtatatggcaaaaccctatctctactaaaaatacaaaaattagctgggcatggtggcgggcacctgtaatcccagctactcaggaggctgaggcaggagaatcacttgaaccagggaggtggatgttgcagtgagccgagatggcaccactgcactccagactgggcaacagaattgagactccgtctaaaaaaaaaaaaagcgtatttacttttagaaggttgtgttattttttacaattctcttataacaatgcacctccttattgcccgcacctggtgtactccattccaatctccttgctcttggggtgtgtgtgtgtgtgtaaaatgtctggcataaaacacaagtgtgtgtgagagtcaatgtgtatgtgtatttcacagctggactcatgcataacacccagttaatggtgtcactaaggagtacaattagaggatgtataaagaagagagaactgacaaacttttctgtactatgaaaattttacaatgggaaataactctttacaatacagttttttcaataagaaaaaaaaaaggaattccatgtatgaatcctaaactaactgtgttccttacctagctgggttgctgcgtttccgaaaacccattagcaacaaaaacaccaacaaaaccccaaacaatctttatgagtagcttggaaaaaaattttttaaatgcgtgaaaaaagtagacttgtgatggtgcacttcagattaattctttccattaacattttgaaatgttaagtaaataggtagtgaaatggggatggtgctagttcttcatcttgtgttagacatccaggtctagccatgtctgtacttctctaaatgtgactgtgtattcactgagattgctgctgagcctacctgagatcatgaggctgcttactcatcagtgaacagcatgaccacccttggtacacactccagcttcaagctaatggttcaggcatatctaaaatggccaatctctccaaacacttgggctgaattcattactcctgcctcattcctgaagtgcataatcaaattctaaagaccaattgcttgatattcatattttttttcctacagcaggttttactcagcaaaaaacggacaatactactcaatggataacttagtagttcagaagccatgttatgttttgtgcttgtatttttatctcatgagtaagactgtaattgtgaatgtttgtatattgtcttctgagtgttcttttctcctgatagccttccttctcatcttttctcagtctgtctcttatgagtcctgaaagtgggagcccctggtattccatgtacctgttttgtgaaaatggcagactctgctactcacttttctttattcataattatctatcttggcccaaatcctatttttctcccattctaattgagaaatttggttctcttctctctacattgagttgaaaatccccaggaacccaatagcagactggttgttaagttgatttggtcccaaaagaaccttaacaaaatcctctttctactcttatgaatcgaattcccaaaactcttttgaataaaccatcctggtttcctctaagctgatggttagagttgggtcatggagttcagggtggaagtattaactcagaaagtcaaactccagtgttttggggcctgtgggtgaatcaatgcttgaggaatattgtgaccatttatttgcctattctcttttgtccctgcccaaaacctcaatatagtgatattaaattttataaatgtggctcaaaacttgacaactattatatttgatattggactgcagccatcctctcagggatctctgccctcatttttttccactctgattacttgcctccgagtgaagggttcaagaataaatgcattaccaaaatgaagggaaacagtctttgaacttctgagtggagaactgtaaagtgaccaagaatttgattactagtcaggcttctagatggtttattaatgaagcagtgcattctccacgaggggaaagaaatgccattaatgttatacccttggcacggaagttcctatttaaggaaaagtaaatgcatagcctgcgccatgtcagaaaactaattttaacgttaacaatgagttgagtattcttatagttatgagaaaatattccagccttcattgccttccacaaataagttgctggaagtaaacgaggtgtgctatttcagtaccaatttagcaatacctctgctctattatcagcaacatgcacagttggttcatggcagaatgcaagccactcttgtctgtgaataagcatcaggctgactgtgcaggatgataattgctctgcctgcacttcctttggcacctactgatctccgctaagtggttagtaaaacatatttttgaaggaatgtcaagcacttctaaaaatttgaaggacttcatctttgattgttctttttcttatgtttaagtttgaagaaagttcacaccaagccattccacggctgccattactcctagcaaatgtctgaaatagcagggtgccagtgtgtctgtgcttggcatcttttaatcagcggtgttttctttttcatgatactgtgacactggctggatgtgttgggatatcaagtgacggacttcaaatagatggcaaattcactaaagtgaaaatgattgtggtagttccctcatttcctcctgcagtgtatgcaaaactgacttttaaagtgtttagtggataatagatcatgtaaggtcagtgctagccatggcagccatggctattattttcccttttcatgggagtgtgctcagcaaaatgagattgtcacactctttttttgagaggacagcgacagacagttaaaagcctcttcatgtaaggatgttatttcataaggacaccagcactggattatccccttcactttaaacttctgccagcttgtacaaagagataaaacaaaatagccctggtcccaggggtggggaagtgccggccagctcagcctgggtccacaggctttcattttgattcgtcacatgtgaggaaaattcacttaggctgagaggtaaatttaataccagttatgcccatgctgttcatatcacaaccattttcacatgatgccacttaattccctaagaagcagaaaggtaaatcggtggctggccagcaaaggtgtcacaatgcattaagaccaggactcgctgcaggggataatggttctgattgctgttgactcatgtctccaccaactgcctcatgtaaaataagtgacatttaaaagacatcaagatgtgagaagaggtaagggagagagaaagaaagagagaggagggtaaaaagtatgcgccactaaacttgccacccgaatgtgcagtttcttttccaccctaagtggtaggaaatgataactcgacatgccatgggtgacctgcgctaagcctttaacttcttgtcttgtgtttttagagaaaaatctgtaaaattgcttctgggaactgctccaacatgttatcatttatttccaatttaattttttttaaactcttattcttttgccctcacatatcagtctattcatctctttaaaagctttaggctgaatcaagttaggcagtggtagacaacaagaggcaggctactttctgaaggcccatttatgtctatttttataaagagaatcaaattccagtttacagtaagcatatgcttcagttgacatctgtttctaagacttggacgctttgtttgcataacagtcaccaataaatggccttgttttaagtctgctcactgagttgtatgtgggttgttcagctggggattttagtcgcagctgatcccctaccgctcatagctgataggaagggggaaaagccgagaagcccagtcctatttattaatgcagattttaacattctcaatgaaccacttatccagtgtgattcggcaaccaaatccttatttgctcaggcagaggagggggtgttcttaaagtgctgaattaaagctcttaccagctttttttttttttttggagggggaggggaatggggaagaagaagcaagagcaaggtcctttctttagccagtctctgataatttggagtacaatgagatcgaatctttaaacaggacatcataaaccaagcttatgtttaatgtatttgttgtaaactaagatgatcagatgtttgcagagccctaaatgttggccctttgtgcaaagtcttgatgattttatttaataccacttaaatatcagtttagagtttgatagaacagggttatgtttccttcattcatctggtttttgtttcattttaaagcatatctgattctgcatacgtgggaaacggacacaatattaaaatatttcaagatatacatgtgactgtctttagaatcgttactgctaattaaagaagttactacttgtgttaagcagcttcaaatacaaagctaatcctcggtctcgataagtctgcccttttttctctgcccctgaaaggcatgccagcagttaaaaatattaaaagtccaaagatggggtcgatgtgccttagagtgtaaacctgattaatagagggcttccctttaattcccttttttacatagaagagatctaactgtaatgtatttgaaaatatgtgttcactgacaaatacactgaactttttcccctgaattattgtataatattcagtaatcgtttatgaaatgtgtaacatttttcaaggggatttacatatcaacttttcctagtggaatcaacaacagtagcatgaaatgtatctactccatttactcttatccagtgctcctactttctttttccctttaatttttatatatggtaaaaatttcattgaagagagattttagatgacaggactgtaattttaaacccaatagaagaggtgtaagcaatttgagcttagctgaagcataatcttaggttgtcaagaagaaacccattctccctatgctaatcaatcagtgtatcaaccaaccaatcatctcttcagcttagcatatatcctaaggtttgatatatctattaactgcccatcatgcagctggtctctggatgatgagattccccctatcttggcatttggcggcagacgaccgagctatcacagcctcagataaataccaaagtggagatttcaatcctgttcctgagtgcagagacaatcgagaaacgttgaaaatattcttagaagagaatacgcagaaaattacatttctcaacactgttgtatgtgaaaattgtatatattacatgattctccctccctagacacaacaatgtaaaataaaattactcttttattatgattggaatgctggtaatcaaaagaattgttggaatctgctacaaactcttaattgcaagacaaattacatgtagacatctgaataagtaagactaatgaccgtgtagatgataaatttcctgaaaacaaacagaagcccaattatataaagcaaggcacacaatcattataattctggagaagggggtcactatttctaaagattttatattgcttcctggcctctattcagagattctgatattaggtaagctgcagctgaatgtatctgtagcctcttccaccagccagtgtattggagcatggaaaggaggcagggtttctataaaactgtttattgagaaatagaaaccaaaaaaaaaatgatttaattgctaagcatctgtgaatatgttgaaattgggatgagtatgattcatttcttcaaacactgatatccacctggaaggtaaaatctctccacaagatgcaaactcaaatcatgtctttcccacactatagttaaagtctcatactctgaaaagagaaccatagtgaggtattaggggactgaggttctagcccaaactcggtcattaactagctagcctctgtgtgctaagcaagcccctggatcctttagaccttacttcataaattgcaatgtctctaaagcacctatgaaaaacagtaacgaggcagggcgcggtggctcacgcctataatcccagcactttgggaggccgaggcgggcggatcgcaaggtcaggagatcaagaccatcctggctaacacagtgaaaccccctctctactaaaaaaatacaaaaaaattaggcgggcgtggtggcggacgcctgtagtcccagctactcgggaggctgaggcaggagaagggcgtgaacccaggaggcagagcttgcagtgagccgagatcgcgccactgcacaccagcctgggcgacagagcgagactctgtctcaaaaaaaaaaaaaaaaaaaaagaaaaagaaaaaagaaaaagaaaagaaaaatagtaatgaattactctcctgataagtaaacacgatttcatattcttccaaaaggttattgtttttcatgtcactaatggtatgaatgtagacttccaccatagtatttgctcagccaaaatctcttcaatgctgttgggcagcataaacaaatgagaaacatattctagcctaaatacaacgttctgggtttgaagccattgtttcaatcatttgttgagggtggggccaaggaggagaaatgatggagttcacaataacatgaactctttactgctggagagagaaggaaatctgttttctgtcctgagaagtccagcatgagttcatagagaccgtgatgacttctccgttctcaacaactcagcctgtgcactttgatctcaacttaagaacactcgtgtgtcctggtgtgaaagggctgataacaatataacagctctagaatttttgtatttttcctaacagaaggataattgtggtgtcaagttcagagcaagagttcggtttaaatagtgtattttgaaaacctttctcgaggagttgtgattctaagagaaaacaattttctatatggcttaaggttacgaattttatcatagcaaagagaaggggacaaaaaaaaaaacctagacagaatcattttctctctctcaagtcacttaaagcgtccattctaggactcattccaggctcctatgattagagacctgcatgtttgtagatatccccagataagccccagatatgagcacccatgacatggtctctgctgaacaaagcaaaaggattgatttagagaaagatggcctattgaatgtggattcttccatgttgctggcctggaaactggtaagcatgcacctttcaggcccagggcagtcctcctccccagaggatctatcctgtctattggtgataattgtcctgccaggtctacagattgtggatatagataagaaagtcagtgaaagtggattgagtgcaattagaaacttacccacacaagaactgacctgtgattgcatttgtaggtagaatcaggtctggagtagagagacagcatttaaagctcagcaaatagatcttgcaaaagaagagggattcattttttattgctgagttctaggtttagaacaattcgttgctattctccatgaatacagcataacttcatgtgcatcgtgtaaacatgcccccgagaagaaaacaatgaggtccctgtcctcaagcagtttatgttcaaagacaacataaagaaagagatcaaattattttaatgaaaccttgaaggtgggatcagcaaattttctttatcaaagtatgattgatttttgctttttaaaagaaaggtttgctcttatgttatgaattctctcaaatagaaaaagtgggcactaaaacagacgtgaggatgaaagtgaaaagaaggagagagaatgagatggacagagggaaaactgagggaatcaagggagggagaaagcaatgggcaaagtgaagggagggagttctttcagcttagaatacactggggctggagagtgagtatgcacccaaacatcaggcaccaaggtttgaccaccagttatagctagagagaatctccccaaaggtgtcctttccaacttgctcttggagagaccaccattaaccagtacaaagcttatgaatctctgcaggattctagaagcattatgctcagccattaaaacagtgcagcagacaagggaagaaagcaggcacagagaggagagggaacatagtgaatcctttataaacactctaaatggggggaaataatgacctctgacttctttgtggttctcaactcatgctgccacaagattggttataaggtccatatcacactgtgatatgaaagtattaattgaataggagcaatcagcatttctatgtgaataatgacttagaaataatattctgcccatttcaacaatggaacaggaaaccaaggcttcacctggctacacagttcttttgatgaggtcagatttttttttttaactctgaggtatatatattttgtgtcctcttttaacacttcaatctgatacgcatttctttggagtaacttaagaagatggaataaaattaagggaaggcaatatatgatagatgatagtattgtcctttaagttcaaattatgactttctgacagacaccttcatcagctctcatctgaatagtgactcttctattaaaagcaaagccttggccaggcccagtggctcacgcctgtaatcccagcactttgggaggctgaggtgggcggatcatgaggtcaggagatcgagaccatcctggctaacacgatgaaacaccgtatctactaaaaatacaaaaaattagccgggcatggtggcgggcgcctgtagtcccagctactcgggaggctgagtcaggagaatggcgtgaacctgggaggcaaagcttgcagtgagctgagatcatgccactgcactccagcctgggcaacagagcgagactctgcctcaaaaaaaaaaaaaaacaaaacaaaaaacaaacaaacaaaaaaacaaaccctcgtttagttcatagtaatgaaccaatgtcagtttcttaatttcgagaagtataagatgttaacaatgggagaaactgagcgaatgctaggaactctctactatctttgcaacttttctgtaaacctaaaattattccagaataaaaagcttatttaaagaaaaaaaatgcaaccatgtatatgggctttgccatgaacacgtttgaataagaaagccctcagtgctacatttatgggagcattttcttaatctttctggaaatgaacgctcattggagtttgatatcctgagaagctgatgactaaccctatgctcatgtataccaccagacaggtcactagctgatcaggctgaaatgctcacttatccagtgttgagtcagaaagagaggagaatttaaaattagctgacttcttggactggcacctagcactaaaataaaataatcccttagcatgtttactagccaaaacatactgtatcacattgtaagttgctttaaagtttgtattttctattaagcttgctgcatggtgatcatgtaaaagtgtctaatggttactgtaaaattagaggctgtccaaacgaaacttaaaatcctgaaactttctctccaatgtatgataattcttggctacactagtaaacagtttgacatgtgtttaaacataattcaatttttttatcagatcgtcttttcttaaaggtatgtctaatgaagtgtgtgactgtataatagaggagacagtatttgatttttaatttttatgttaaatggtttccactgttgtatgcccatttgagtttttacaataaaagacaaatataaaaatgtgtatctatatcactgtgcttaccatattgttttactgatgtttttgtgttcatcttttcccttaatgagtgaactccttgagaggaggggctgtggtcttagtatctcgcccagtgcaacatatagtaaggattcagtaaatatttgtttggatgaataaatgaatgaaatcacattcaaatgcattatttctcctttgaagggaaccaaatagctgccagtcaatttgctcccttcactgcccttgttttagggtggcctcacagtttggactggtttttatcattgctatcattcagccacatatactaacctttcaaatctgcaaaaagtatttaaaagaaagagaaattgttcatgtttcaaaacctattataatgcatcttcaaatatgtcagacacatctttgttaaaattaaaccagggattggttttgagcgaatagccctatatccttacagatgctgtggatggatgcatctaagctgcttattatattgatgggttttgctgctctgcagcaaatgaaagcaggcagctgcttcctccatcaaagcaaaaagcagcctgagtttttattaaccgagtgttcatttcttctattgccaaaattcttacacaaaacaaaagagcagttttagcacattattgcttaactagacatgaacaactgacagcaagtgataagcctgtctgcttttcacaactggtaatcatttttggaatagatgttttaatatagttgaatataaattttgtaatttacatctacaatggtacgtaaatttatagatccagtttgttgcaggagaatgaaggctataatcacaaaaggcttttcccagtgttgtttaatttttaatgactatttgaaaactggggaaggaaaatgaaatcaaattcatttccttaacaaaaaaaaaaggtgttaaagacaatcatacaagttggttggagacatttgtagatggccccaacagagcaagaccgctgtgtttacagccaggacgtgcttagcactacatttccacattagttgcagtgagctgcccaagttagtgcagcagcagaaatttttggagagcagactgtcacatttccttcatatcaatgaataatgatgagtggagatacaggaaggacagagtcctggccattttgcacagctgagattgtcagccagctctcatacatatatatgtgtatatatacacatacatatatatacatatatatatattttagcaatctgaatgtcatatatttaatttcagatggcatggcaaagtgaggtttgtttaaagtaggtttagactaaaccccaatgagatgttgccctacttaccatgtaaatttgctgagtagtgttttaccttttggaacttgctaatggcaattcctgctgttagaaggggaggcagttctcctccttcccccttccccacacagaaatgattctttcctcaagacctaagagaggaaacttggaataaatgcagtgtgatatgctgggacgtgcacctaaacaacattgctaaaataagttatgctgcctaacagcctgataccaggactgtttaatgaatgtgttctgttcttgcatctggaacatgcacctcctaaatactatttactctccaggaaaccttgcataaatgtgtagagcatgcattccacatggaacacatggctttcaatttgtttggaatttagccatagtgtttacctgcaaatgagataaagctggactccgaggcaggaaaatgctttagaaatcaaattcatgaatcacaggtaactccagggaagaagctcacttttgctattttggtatgccctgtaacaagtatgtgtctgtgttcgggatgtggctgaacacctaagacagggaacaataacaattattcctaatactttatttcctccactccattggcacattgctgctcttacgtgccttttcaagacatgacccagcactattttttatttatttatttatttatttatttatttatttatttatttattttgagacagggagagtctcgctctgttgcccaggctggagtgcagtggcatgatcttggctcactgcaacctccgcctccccggttcaagtgattctcctgcctcagcctccctgtaacacggcacagttttaaaagggaaaagggtgatctcatcagaatgatggcctgttcatcccaccctgaggacactcaagcacagcagggccttgggggaaggcattacttcccccacgtaaaggaataaaactgacaatgaaagtgttcctttttcttcttctcttttttgtttttccactgtgggaaggacatgtggtgtttctggggaaatccatgtcatgttttccctcctgctaggaactctgtggtctgattttctgggtccacctgtcctagacatgcttcttctcactttctgacatcctctctgaccaatggagatggagcattttctcacataggcccagatagctcacatcaggagatgttcttctacctgtgctttgagacctcaggagaatctcttctgcccttaggtagttttgttacactgaggagaaggaaattcttctgaggaaaaaaatacagcagagagctgtgctcaatattggagagggaaaatcatacttgaagatgttttctgttattaatatgcttgattaactaaataagcattcacatctagtttatataggtgtagggcagttattttctgaagctctgagatttaattaacaaaggtagttctaattccattgaaatagacatgtaatgaagatttaacttctaggaccatttcgaaacccatctaaaatatttcttggtagaggtttaaatttgagattatagtgaaaataaaatattttaaccaatctaatttctttaaaatgtcacaggctagagcccactggtaattttatagttttcatttggaagtgtacacatataatgatctctagtcattggatttagagttggaggaggcctcagaaatcaattcaactcttccatttttattcttgaagtgagagcccaaatatgatttgtccaaagtccccaaattagttattgacagagctatgagaactagcaactagttctcttgattctaggaccagccatcagggttggggcacagaatgcagtgatgagagactgggctctagagttagagtatgtgggcctaaaccctggctgtgccgcttcagcttactattctgtttatgctgtatttcactgtgccttttagctggtcataaggataatgcatatcttataggggttgttttaaggattaaatgtgatcatccatgtaaagtacacagcccagtgtttgccaggtagtaagtgttcaacaagtgatgctgccactgccaataataatagctgggtgtggtggctcacgcctgtaataccagcactttgggaggctgaggtgggtggattacctgaggtcaggagttcgagaccagactgactaacatggcgaaaccccgtctctactaaaaatataaaaatcagctgggtgtggtggtgtgtgcctgtaatcccagctgttcaggaggctggggcacgagaatcacttgaacccagaaggcagaggttgcagcgagccgagatcgccccactgcactccagcctgggcaacaaagtgagactccatctcaaaaaaaaaataacaacaataataataatactagcaaacactaactgagcacttactagctcctattctgattaatccccagtctatagtatggagtaggtagtattattactttcagataaggaatcggggaaggagaagttaaatgacttgctgaggtcacaaagatattaagtgtgagaggtgccttccaagttcatgtcttcacgctctaagccactgcggtgatggctatgaccgccgtgcatttctttttctcagcagtgcttccgtatcctctggtcctgtctccatttctcatctgtcactcagctgctttctcagcatctgctggaaaactgactatcagccctacgaccagggcctcggggaacgttgcctgaaggctgtcttcccctccctgcttcagtgtcaggacatggctgggaccttgtccatcttttctttacctcctaatcgtcacgttaatagtctgagttaaaatggacattttaaattttaatgcatttttaatcaaatcacacccataataaacaggccatcctatagtcctagaagaatttattgttgaaatacttgagtaattttttatgccccttcatttctcctgcttccacatgctccttatctgcccttctctcagctcaggtcagttggcaatcagattggacccttgtttttgtaatctagtgagaggcagcagatcccagaggttaagaataacaggtctataatcagattgcctgggctcaaattccagctctgtgacccagtatctgcatgactggggagaaggtttccaaacctccctgtgccttgatttcctcctctgcctcatagtccctgggcagcatcaacgttccataaattatagagtgtcacagggcaggcctccacctgcccacctgcccaccattctggaatattcagacattctctcctactcagatgttctttgtgacctggctccacaaatatagggaggcctgcacttaatcatatattgtacagagtgagtctgctaatgggtcaaagcgggaggacaagtatagaacatgtattgtccatatacatgtaatgattgttttggatccattttcaaagctcccgtaacaagggcacatttatccaaagttcagtttgttttgattttgtgggttatcaatgaggaataataatatccctgaaagtaccataaaaatgtaattcaggttgataaaattccctgaatagaaacttgtcacaacagtaatagcagcagcatcatttctgtttttaatagtaaaaaaaaaaaattactctatgttaggcacacttctgaatgtcttacatgcattatctcatttaatccccacagcaccccatgagaaggtacttttattgcttgtacttaacaaatgagagaagtgaggcattacccaacaatctggccaaagtagccacctgtcccactcccataattattctctatttcgttaacatgttttatttccttcacagcactattcactgtctgaaatgatcttacttgtgtctattttccctatgaaagttatttaggcaaaggccttgttttaatcactgctgtatcctcagcttctagaacaggcctggctgccttgataattgtatgttgcatgaataaatgaggcttaaaaagtttaaataccttgcccaagatcacagaaccataagagccagtattcaagctgcactgtaactcaggaagatgagagctggctttctgctgtagctttttatagttgaagaccccccagacataatctaacccaaggctatcattttgcagatgaggttactgaagctcagaaaggataaattactttctaatatcttacagtttgttagtggcagagccagaatcagaccccagatccctaggtagtgtttttttgcaccatgaattcagcctcctcatttcatataaaattgaaggaaaatcctatatgcgtctgctgtacatcatccgcccacttattcatgccataaacctaagtcatacttgacacttccctctccgttaccacccccttcatctaattaactagtaagtcttgtcagtgtaccttctaaatatatctcaaatctttccacttttcttcatctctgctaaccatcacccaagccaccaccagctctcatctggatattagtagtagcctcctgcctagtttctccctgcctcctcttgccccgtttcatctaatttcttagagtagccagaattatcttctaaacagtattataaatctggtcataccacgatgctgcctaaaacgtatcatttattctcaggtgtgacttaaaattcttaacatggcctctgggcctgaggggtctggcccctcaccacccctcctccagtcttatcttgtattactctcttcctttctcatttattctagagttccactgaccttatttccattcctacaacattaagccctcttgttaagactttgtttcatggagctccccttctgtggaccacttcttccactttgtcctcctcttccttctttattgtgttcttccccctctgggtctcaaactagactgaagccccagtgaccatgctatctccatccctgttgatccacaggacccgaaacattgtagatgcccaataaatatttgaggagcattctgtagtcctcttgtggatttctgcactgggttgacacatcagtgacaaagcagaaatgtgagttggattaaaagaaaaggagacagagtacaaagactgaaatgagcccaggaagcttccatactcattccaacatgagcagcttttctttttagtaacatctacccgtgcatttattcttccagaaggtttgatggcttagctaagtgtgtgttggcctctccacttgagtctcagatttgagagaggcctttttttactgactcctgtgtgataggcttgatcacttcccttgagggagctagagaaaggtgctgcttcgatggacatcagctgatcacagaaaagctgtatgtctgctgtgagagctagatgtgttgtcatcatggagcaagtacaagcagttggtggggaggagggagccagcagtgctgcttgttggatgctgtcgatcaaagccttaggactgtcctccaggacgaactatgagaagtgaaaagctcgcaaatggaactgatctagaaggccccaagcttagctggatcctcaggttactgaattttaggatttgctcagtcttcaggttaatcatagttgtgctgtttgtttccagattaactatgaaacttgacatttaaaataattctaggccaggtgcggtggctcatgcctgtaatcccagcactttgggaggctgaggcaggaggatcacttgagcccaggagttcgagaccagcctgagtaacatggtgaaaccctatctctaccaaaaatagaaaaattagctgggtgtggtggtgcacacctgtagtcccacctacttgggagagaatcacctaagcctaggaagtcaaggctgcagtgagccatgacggtgccactgcactccagcctggctgacagagtgagatcctgtctccaaaaataaaataaaataattcgaaactagctacttcactaacaataacaacaacaaagtggttgcttatattaagtagatcacattgccagttttccacctcactcttgctacacagacagctgttttagtgttggctggctataggctttctaaagtctgacaaattcaacaggcccagttctgacagaagcaactgcagggaaccaagcctttgttcaaaagaaatgtgataaaacaaaatgaccatagatatgcaagtatagtgtagtactcttccttttccagacagaactcttgtttagccaatgcttttatggaggcccaaaggatgaaggaggcctttcctcctatgaaataaactcatttgatttatacagaaagcactaaagaataggaaatgatatgcttcttaataacgtttataacgtgtttagagaatactttacctagaataaactattaatttaaagtttggggatgcttttttagattaacactttagctactataaatgccactttgggcattctgcagcacttcattgagtgacgtcaataatgtagcagaagtgctataattttcagataagcattataatctatttttttaaacttttattttaagttcagaggtacatgtgcaggtttgttttacagataaattgcatgtcacggaggtctggtgtacagattatttcatcacccagttaataaccatagtactataatattattaagggaacataagaaccttgggatctcatcattagtgttcttgtcttgtacgtccttctcctaaaaattattctcaccacctttccaatgaatttctctctagtctatgaagtccccctactcactattcttccagaatgagtgaatgaaaccccaccattctgagcttaaagcattgatgctaaaatgtactctggaagagataagaatatgtcttggattccagaactgtcctacaaaactatattcaaaagaccatgcatttctaggtttcaggtaaacttggagactgaacaatgcactcctttaagaaacctcactaaacctctacatagggatgttttttaaggcataaacccacgtgaatgacacattggccattttaaggggcagcatgcaatagcaataaaattttggaagctggaaggcaaatgcattgacttagcagatatgagaaagccagcagttggcaaagctgagaatcaacccaatttaaacttctggagccttgaaggctcggaaatcggtggcatcagatgtagctggttctccgtatccatggattctgcatctgaggattcagccaacctctgatccaaaatattcaaaaaaaaaaaaagactaaaaataacacaaaaatttttattttattttattttttgagacagggtctcactctgtcacccaggctggagtggagtggcgtgatctcggctcactgcaacctccaactcccaggttcaggcgattttcctgcctcagcctcccgaataactggaattataggcgtacaccaccatgcctggctaatttttgtatttttagtagaaacggggtttcactatgttggccagggttgtcttgaactcctgaccttaagtgatctgcccgcctcagcctcccaaagtgctgggattacaggcgtgagccactgtgcccggccaaaaatgtttaaaaacattatagcaaatatttacatagcacttatattggatatgcatgcaaatactacatcatgttatataagggactttaatatctgcaaattttggtatggagtggaggagtcctagaactaatcccccacaaatattgaggggcagttgtacttctaaaagaaggagttgaaggggatgaaactaaggagaattgattgaaagttgtttaagaagtagttatatccccatttcaggtgactgggcaactcttctccctctactccaacaaaaaactggaggtttattctttggagagggttaaactggggattttgggcttgggagacaccaggtacagttgaaagcagagaatacgaaaagccaggtggagtgactaagtgaacatatgcagactgaatgatgagccccacaccctcaccccactcacctacactcagccttctttacttccagaattaccagatacctgagggaagcttttaatgtgacagataacaaaaccaagaaacagaaaaaaacaacttgaaaaaaacagactttataaagatgagaaaacttaaaagaaactataattaatactttcaaataattaagacattgcattcatgaaacaggaataggatgcttataaaagaaacattcagagaatgaccatcaataacaatagcatatattaaaagaacaataaaaaggttagaagataaagttgaggacatttccaagaaagtagaaaacaataagagatgcaaagcaagaaagaaaagattttttaaaataaaaggatgagttcaggagattcaacatccaaataataacagttgcagaagaagagaacagagaaatatggagtaaggaaataatcgatgatactttgtaagaaactttccaagaactgaagaacatggagtttctggattgaaattacccactgaatcatgcaagttcttaaacatttacctctcctaccccctttttcaagaaactactggaggacgtgttacactaaaatgagggaataaaccaagaaagaggaagacaatgggtagaggaaacaagagatggaacccaggagaaaggcaaaaggagcctgggatgatagtgaagattaggctgtcagctgtgtaccaagcatagagggcattcagtccagactaaggcaggttagaagataccaggagagatttcctcataaggttgatagaacacccattgtgaatgaatgtattgagaggagaaattgacaactgaagtttgaggttgcctaaaaatcttagcaaatgaggggggaaaagacctttataaactccagagaaaacaaaaatgtgtgcatgaaagaaaaaacaatcatagtttactacatagctgttttatttcctagtcataataaaatcaactggggagtgatcttaccaaaattttaacattataactattattgtaatattaaaatataatattaagcagatggcgtggggtggataaggggcacacatatgtgatgtgggaagaggaatagagataaaagcaaaaaatgctaattttgcacagtgaggggtcagtagattttgcttgaaactgaaaaatcaagaagcaacaatacaaacttattatgtagaaatataaacacaattaccagaagagttagctaaaagagttgaaagtaatagtttctggggaagcagaaatactggggaaaggggcttggtgctactgtttgtcttagccattctaatagatcccaatggctctttaaactatgtgtctctataactaatttgaaaagaaaatctttttgaaaggcaattttattcccacaaataagaatgagaaaactttaaaaagtagcagctttattgagatataattcacataccatacaattcatccagtggtagttagtgtattcacacacttgtgcaactgtcaccacaattttagaatattttgtcacctccaaaagaaaccttatactcattggcagtcatgctccatttacacctaaccattgttgccctgggcagttaccatgccacactccatctttatgaatatacctattctggatatttcatataaataaaaacatacaacatgtggtcctttgtaactggtttctttcactcagtacaggcataccttggagatattgagggtttggttccagaccactgcaattaagtgaatatcacaataaagtaagtcacacaaattctttgctttcctggtgcatataaaagtttgcactatactgtagcttaagtgtgcaatagcattatgtctaaaaagatgcacataccttactaaaaatactttattgctaaaaaatactaatgattatctgagctttctgtgagttgtcatctttttgctggcagagggtcttgccttgatgatggctgctaactgatggttagcagggtgatggttgctgaaagttagggtggctgtggcaatttcttaaaataagacaatgcagtttgccacattggttgactcttcctttcaggaaagatttcgctgtagcatgcgatgctatttgacagcattttacccacagtagaacttctttcgaaattggagtcaatcctctcaaaccctgccactgctttatcaactcagtttatgtaatattctaaatcctttgttgtaatttcgacagtgttcacagcatcttcaccaggaattgattccatcttaagaaactaccttctttacccgtgcgtaagaaggaactcctcatcctttcaggtttgatcatgagattgcagcaattcagtcacgtcttcaggctccatttctcattctagttctcttgctatttccacctctcaaaatcatccacgaatgttgaaatcaattcttccaactcctgttaacactgatattttgacctcctcccatgactcacaaatgttcttaatggcatctagaatagtgagtcctttccagaagattttcaactgactttgctcagatgcatcagaagaatcactgtatttggcagctatatccttatgaaatgtatttctgaaataataagatttgaaagtcaaaatgactccttgatccatggactacagaatggatgctgtgttagcaggcatggaaacaacattaatctccttgcatatctccatcagtgccctttggtgaccaggtgcattgtcaatgagcagtatataatattttgaagggaagtgcttttttcggagcagtaggtcttagcagtgagcttaaaatattcagtaaaccatgctataaacagatgtactatcatccaggctttactgttccatttatagagcataagcagagtagattttgcataattccttttctcttattttttttttaagagacagggtttcactatgttgtccagggtggagtgcagtggctattcacatattcaatcctagcccactacagcctccagctcctgggcttactcaagcaatcctccttcctcgccctcctgagtagcccgataggcacctgccactgagccaggctagacttagcataattcttaaaggcgctatgatttttagaatggtgcagagcattggcatcaacttagtcaccagccgcactagcccctaacaagagactcagcctgtcctttggatctttgaagccaggcagtgaattctctctagctaccaaagtcctagatggcatctgcttccaatggaaggcttccaatgtttgtctgcattgaaaatctgttggttagtgtagtcatcttcatcagtgatcttagctacatcttctggataacttgctacagcttctacatcagcacttactgctttgccttgcacttttgtgttacagaaatggcttctttatttaaacatcttgaactaacctccactagcttcaaacttttcttctgcagattcctcaccttcagccttcatagaattgaagagttagggccttgctctggattgggctttggcttaagagaacgttgtggctggtttgatctatccagaccactaaaactttctccatatcagcaataaggctgttttgtcttcttatcattcgtgtgttcactggagtaacacttttaagttccttcaagaacttttcttttacattcacaacttgtctgtttagtgcaagaggcctagctttcagcctatctcagctttcaacatgccttctccataagtggaatcatttctagcttttgatttaaagtgagagacatgcaactattcctttcacttgaacacttagagaccatttgttaagtttattaattagcctaataatagggaggcctggggagagggagagagatgggggaatgccgactggtggagaagtcagaacacacacaagatttattgattaagtttgctagctatcttatatggacgcaattcatgccgccccaaaacaattaccatagtaacatcaaaggtcattgatcacagatcaccatatcagatataataataatgaaaaattttgaaatattgtgagaatgaccaaaatctgtcacagagacactagttgagcacatgctgttggaaaaatggcaccaatggacttgctcggtgcagggttgccacaaaccttcaatttgtaaaactgtagatatgcagcatctacaaagcacaataaagaaagctgcaataaaatggagtattgcctgtataacgttttcaagtcccatctatgttgtagcatgtatcagttcttcttttattgtcaaataataatccattgtatggacgtaccacattttatttatccgttagtcagttgatggacattggggttgtttccacttttgggctactaagaacaatgctgctatgagcattcgtgtacaagtttttgttggacatattttgatttatcttgggtagcagtggaattgctgggtcatattataatctacatttaaccttttaaggaactgctacacaattttccaaagtggctacatgattttacattcccaccagcagtgcatcagggttccaatttctccacatcctcaccagcccaacattcgttataacctgactatttgattgtagccatcctagtgggtgtgaagtggtatctcatttaggttttgattttcactgagataacttttaaaaacttagattagcaaaaattagttatgttgaaaaaatcctatctgggcaaggctttgaggaaacaaacactctgattaggagtgtaacttggtgcacattttatggaggtcagtttgatatatttaaatgcaaaatatatgtaacctctgaccagatatcccatttcctagtatttgacctaaggagaaaaccataggttgggaaaagatgggttgtcatattgtactactgttgatgttaatggcaaaaaccacaattacttttgcatcaacacaataatctcatcatatcaacaactttgaaactaacttaaatgtctgtcaagaggaaactggttaaatgaattctgattcacacatagaatgtctaagcaatcattataaataatgatgcaggtaaagtacatttttattttctagtaaagctatctaccacatattgaatgagggaaaatcaggttattgaatatcttcatgaaaagatcccattggtgtaaaatatctgtttgcctagaaagatcttttgagatgacgtccaaaatgttaacagtgattatatcctagtggtcacattttacgtgatttttttttttactttgttctttgtatgtaattttgttaaaaatcagcctctataattttttgagacaattataaaactattacaaagtactgcattttagaagtcgcatttttgtacttaatcaaggcttaaattttagttagatactctttgtctatcatttttttaaaacctcaagctaaaggcataaagaaattcattatagtggtgattatgttcacttggtgtagagcattgtcttatgctcttccttcagagacttttatttatactttggtcttaatagagttatttttatgtggagatatgaccggtattaggatttgcagtaacaggtcaaaatggttttccatttttctggttattgggatacgaattttggattcacatattctctcttccactcttccatccctctttgctggagaataacattaacaatgctttctttttctttgatcttattatgtgttaggaaccattctaaacataggcatgtattttactcatctctcaggccagtcctgtgaggttgacaatactgcaatgatattttacaaatgaggagcatgagggataggcaggttaagtaacctgtccaaggtcactccacaggggaatggcagagctggcactggagcccaataagtctggttccaaaatatctgtgatcttaactgccacattccactgcctctcttactttcctcctaaatatgactccaaacacttcttgctggttttccttgtttctccctcaagctgtcattcctaccagaaatgccagagaggctgaggtagtgtgtacacctgactgggcttccctgcaacaaatgctctatggagacacctctttgctgtttatatatttaccccctgaatctcttaggagtttacttaacatttctttaacaccctcttctctgaaatgtttggatttcttagtcctcaaagttggaggttcatctaggggaaaaaaattaagccttttgtagatgtttcaaccttgcattaagaccatcagcagagtgcttggtgttgagtcagagaacatttgccacccgttcccaggactgcatggtgctctcagccttaggaagtgcaagatgcctggtgctctgactgatctttgagtttgattaattgggggaaaacataatttttataaggttatagtttattctaattataagggtagtatatgcttattgtaaaaattttggaaaatacaaaaaagcataaagaaaaaaattaaaaacacttataatcctaccatcctgtgataacaactagaaactacaatttccaagcatgtttgtcttctctttaagcaattcatatccattcatgaagactaagtatttgaaatcagtgatttatggatgacaattttagaaaatgtccatccatgcaatttagcaggtagaattattgttaaatttaaagatgtaccaaagttggtgaaattaaaatttcttaatcttacacagcagtttgattttatttaactgaagaaagacataattgtggccaggcacagtagctcacacttgtaatcccagcactttgggaggccgaggcaggcagatcacgaggtcaggagttcgagaccagcttgaccaacatggtgaaacccagtctctactgaaaatacaaaaattagctgggcgtggtggtgtgcacctgtaatctcagctactcaggaggctgaggcaggagaatcacttgaatccaggaggcagactttacagtgagctgagatctcgccactgcactccagcctggcgacagagcaagactctaaaaaaaaaaaaaaaaaaaaaaagacagaattgtgcatgtttaaaaatattagcatggaatcaaacaaaaaagtgtagtgacgtcagtggttttgtttgctcctgtgtgtgatcgtcccatttatttttgcctaatatgggctgcatatataagcaagtcttcaactgatactaattaattttatgtgcacaagatgaagatctatgtgaagtaccatcaaaatttaacttgatatttgtgattttggttgttactgttttggctatcttgtgatcaaaatttagtataatttatttaggatatttttctattatccttgggaaagagttataaatctcaccactataaaaataacaacaataaaagacacccgtgacatgacatattataagtaataacaatgttgtttgattgaagttgaaatagcttgtactgaacattatttttaaaagccgtttcttaaaagaatgacttctataatcaaaaggtttatcctcttgtgttttctaggcatctggccatctgaagaggttttggcttactactgcctcaagcacaataatatattcaggtacagagctgcacttaagatattttttagcccatcacggatattgaatcaacatattaaaaattgccatgattatattcttcaaattaaattgttagaaaaaaatataagaaaagaaaaacaggaagaaaaggaaaacagaaagaggggaaaaagttcacagtgaacacatgttgcttctcaagtgaaatctgaattgccttgggtactaatattgcacagcaaggtttttgctatatgtcaaaggcttttgatttccactcaaggcattttatttcactttgatttgggggaaacaaaagtgaagctccaatcaatccttactgattgtgaaggtcaaaaaaaaaaaaaaaaaaaccaataaagacattctttaaacttctgctggggaagtcactacagaatgtctgatagataaatacctcacagctattatttaatgatgccatcccacccctggttttaaaggtagttttatatatctaacaatatgtatttgtgaactataaattaccattacggattcatgctacggaaataagtgttttcaactgttagtgtgcattacagatcgaacccatggatggaatttaggaaaaaaaaaaaaaactttatttgaaaattctaaagatgtttggtagacccagaaaatataggtttttcattttaattctcattttataaaagtcattcaatatatacttcctgaatagctcattatgatagcagataagccgctagtgatcatagcgtgtgttttaaccgtatgtacttacaagattgggtcaataatatgtatttttttaagctctatgggtccatatttaccaaccagtctacaattgctttaaacaaccaaacactcattaagtgtgttttgaaatattaatgtccttgcttggcttcttctcctccctttccccctcttcccacctctccctctcttttaattttgctttttttctcctcttgaggtaataaacttcccaaactgggaagaggaaacaatcctaagagtctaagcatataaataagaacagggcaattttgaatgtgggctgcagagctgccctggaagtctggcatttgttcatctcgctgtgcttaagcttgactggagctccaatcagcgagcagtgggccagggcgagaatgtcacacgttaagggctgatatttaggcacaaaggggaaggtaagtgcagagtgccaccctagactgtcagctttaactctgagccgctttacttttgagctgtgaagtcagagcccagtcattactttagcctgggtttgctggcttaaccatattatgtccctgcattgtttattcactgtgttgtgttggggtcaattgtgatttaagtgttaattgctaaatgctctttgtgtaattgttctttatggggactgttcagctttccaaaatgtttcagtttgtttaagaatttttttttaaaattcaggattgcatctatttattttgtgtgtgttgtttgtatgtaactataatataggtatatacacactcatatatattcttcatttacttgtctaactgtttttgaaggaatgaatgtggattaacagtgttatcctttcctaacacttctctttcgctactctagctagtttagttctaaaagacagcgccattgacaagggaaaaaaagggaaccttctcagatttttcagctcagcggtggtaatgttgcagtgaacactaatgagggaacccccactgatttgcctgctttgtgacttttctatttcataattatttttaaaacgcaaaacgacatgaggtagcctagtcatgtctctacaacttcctggtagcgccgttcttactgcagatggcaatttgttcttgtaacatatatctctctctgaccattttcatctaatttgtatgggttctaccatttcttttctctctttcagggcccttgctgtgtgtgagctagggggtggcatgacatgcttggctgggctcatggtaggtcttttctccattccaatcccattcagagggaggaacaaaaggaaaaatgttccagggcctccaactgctgggtcagagaaccgtcaacagcatcagctgcggtcaagctgccgggtcttgagagaccttctagattgacttactttcggatcatattgattttatggttgcctcgatgagcagaaacattttacctcagtgtagtcaatattgcttgttgtgacattccaggcctcgcacagtctttctttgccatagcgaaagcattttttttttttttttcagattatagtcccatttgctaagatacaggaatagcccggcgaatcacagttggagcaccatgatatagctgctaatgttttgcctgcattattacaccaacaaacatgatccagagcgctcagtaattagattcttttgaattagattggccattcaggaacgtcgttccccattctctgggttctgagtcatgtattcaggagatattatgtagcagcacagtgcattagacaagtttttatgtctctacaaataaaagcatattgttacactgattggcatttgacaaacctgtcgctcttatacaatgtgtcgaggttacagcccaatgtgcgagcatgtcaaagctcacaaaaaaattaccctcacaaagccatctgcctgcaatgcaaagttatatgaagggcatcaggcagtcagacagaagcaagctgaaaggcagagtgacagccttgtatgatggctctactagataaacagaagcccacaaatgaaagcctctcagaataccatcatccgctgtcacaatgcaattaccgaacagaatgatagcaagatagaggctcccgcaaatggaatgataaaagtattgactgatttgattgaatgattaaaataatgcagacataaaatgaaaaaagattgaagattgttacagagaaataggtgaggaagcatgatactgaaggcttgtcactcctgtcttcacttccacacagacaagcatatttgctcattgtttgctgtgctcccttttttttttcaggttgctatttctgcagatgtcaaagaagttctgttaactgatgggaatgaaaaggccatcagaagtatccttattcagatagaaaacgggtttgttgtgctcattcctttttcctggctgagtaacaattgatataaagaaagacagcatggggtattaaaagagagtttcccccctacatacatgataagtaattaagaaaaagtagaaatatatgaattccttgcatacaactccgtaggtttttttctttccatagatttttatagacatctctcatgaaaggagcctatttttgtggacctcccgaggcaataagaaaatttgtttcataataattttcaagcattcttgttcttttatttccattggaatttgccagtgtaaaacaaattatttggtatttattgtatttggatattgctggcaaatattaacttccagcttcatgtttgttattacatttatacacttgatattgtatgtactgtataatattgtgcctggtctaattgctgagggtacctatatcccccactggaacagctgtcagttcttcattatttccttttatttaggattttatttaggattatacaagctatctctatttttctgctatgctattgcagttcaaactccattagattatgctttactaatatgtacacagagttcatgaaaattgaactgtactttaactaagaaagcaagcataaatgtagctactttagcagtcgagctgatttgttcaggggcagttaacagctgttagaaactgagaggaaaagtggcagatatgtttgctttggatttttttttttttttttttttttttggtgtgccttacatttacattatgagggagacaatctacttatttgaattttaagctcctaaactgccaaagcagttttgatttctgtggcatcttacatacaatctatttctgattttctttttcgacttctgccatatgattttttcaaaatatgcagcagcttcatcaagctgctcaaacaggagaaaggaggaacgagaagcacagtagctaatattgttcagtaacacttgtatgctctacagagccccacccagctaattgcctgacagacttaaaaaaaattcaggaaggaaaaacagccaatcacaatcttggcctttcacacaagggaaggagatcacaaaaggtgcttcctttttttaaatgcaggattttaatcacgttcttgagactgtctcaagtttttcaaaatattcctgaagatgagcagatgttttttcattcactctgctttattctgagttatttcgtgcatgtatccatgtatcatttcactgtgctcctcctccttatgtcagggaatacagagcaagaggaagctcaggtatgccagctcagccccagagaatttttagagggtggggggagcaggattattggacaagagaagattattttagccacagaaactttcagcttgggcccggtaacctaaggtttttttcaagtcagcaggtgtcttatttaatagcgtcagaaaccaattagaacttttatcaaactatgggaaacatctgtagtcagtatgtaagtctaattgttctaaaattattattgagctaaactacagagcttccaaagaagggaagcaatgctaatgtcattaattaacacacctttgctttaaacaacaaagatgccatgccagcttttgaaatcagagaggaaatctcagattctgtattcattctgccggcctttcaaagaaatgattggtacagccccctcccaagaaaatggatttttaacatttggtcctcagaagctcagccctgagagtgctttattgtgctgggttttacaatgggtttaatatagcggggtgccaaagggcaggaggggaagaactttacaaagtagataaagtaggtcttttcaggatgcagaccaaaactggtagtgtgttttatttcatctcttaggactttcctgatggagttccgtttttaccatgcagttgttctgtgtttgtatgcctttttctgttgtaaccagatctaattttttttaattaagagaaaaagcatgcataaagccttaaaattggcaatgtgtttttcctgcttttaatactaatgttattcttgatttgctaacagagcttacaattggcattcgttgtcatctgttttactgactgaggttaatatgaatgatttttttttctatttgcatgcccactttctgtaagaataactaattcactgaatcacatactattgatgcatatagattgaaacaaacttatttaaaaattactgtttacatctttcctttaaaattttaggaagtctaaattatatagcagttgtaggatattattcaaaaattactttctaagaagtaaaagtggatgtcaacaaaaaaagggggagaaacattgccagaagccagaaaatctgttagtaaagctgctaattattcttaatgggcaagatgagcacattaagaaacaaatgaatacatcagtgaaatgtaattgaaaattggcctggcaatggcatatcgcatctgagtattggcctgtatattattcttatcattttaaaaattattttttttgttcttggcttctgaatttaatgaatccaactgaatcttcttagtctcttaagcttctaagattctgatttttacctttttttaaaaaaaaaaacagcatttcctgatatttccttttaattttatattatttctatttgttttagtatgtgaggcaatgaatggattggttctgaatctttatatcacagaagcatgtcaaccagttttgagtttatttattatctccctaaaatgtatcagatggattgcctatgtcttcttgagttttccaacttgactctgaaaagctagatgttgatctgagatttattaaacagagatgtctggaaagatattaagacttgaggtaaaaatttttaagtcacaaatattttcttagattcatgggtagttttccctaaagtctccttgatccttaaactgcattgctgggtctacgaactcaaagcccccacacctgagagctgctcttccctacagatgccattttatctgtaccccaagagaacaaaggataaattagaaatgggatcatttggtttgtccagttctcaaatttattctaaaatagtgtgaaacatgttccttttcttttttttttggcaatgcccctttagtgtcaagaaagaaatcttcaactgcccacatataataattactccataaggtttgtaacttgtgataacaatgacctaggaataggagagagacatggtatactgagttattattgatgctaagcctcttctaaattataatgaataaaagtagaactcctgaaggtgagcaaccctctctggctacaatcactaatgtgcccagcacaagcaccctgccttagtaaacatctagcagttctatgcagaaaattccaatgtttggtgacccatttctctgtaagcatcttatccccaaagtatgcacagtgtggatcatgatcttgaacttaggattctccaaaaatgggtaaatcccctgtgctttttaaaggagacacccctggtttaacattatttttatttaatacaatccctgacttgagtaactaataagtgaagcttcgtgtgggctgtgcagcctgtaccatagatggttaataacacggaaatcccgggccatcttcctgtgtccaggcttcttcttccaatgccggctgtacttccatctactgatgagtcataagtaaactatatgtgcctcagattgggtagcagcacaacaaatatgtattttttggaattaaattaaaattaattcaaccaatattaatggcatgtcattacaggtgctaaagatacaatagtgaacaagataggtctagtacctatccttgtggggcacagattttgccttggctagaatacatttatatacatgaagggcagaagttctttgataactttggttatttaaattctacagtataaatgttcacataattaattctaactttttttcttctcctttttgtggagaatgaggtcttgctgtgttgcccaggcagtcttgaacttctgggctcaagctatcctcctgcctccacctccctaagtgttgggattacaggcgtgagccactgtgcccggttcaggtaattaattctaagcagcaggaaaagaaaataaagtgtaactgccaaacctcatgttagttactttacccacctcttcaccctaccaaagcttttgcctgaattatacactaagataatgaattgacgtgaattgggcacctactgtgtgccaggcccatcacacgtgatactccattaagcctaacaaataggtatcattacttctgttttagagatggagctcagagagattaatttatcccaggacacgcagcccccaaatattagaaccagcactagaagccaggttcatttgacttcaaagcttatgttttttcgacttaaaccattctgggtcaccaaaaactaaaatgatttggtgaacgtcatcttgcatttccttacatgctctggaaataaaggcctctcatccacgaacataacaattggcattgctaacagagtttatagtacctctatggtatcttctcaattcatatgagtaataagcacatttaagaatattttgcagccttaaattagcaaatattgccacattaagcattaaaaaaaaaacttgagagatcaaaatgaatagggtttatattataatctcatagtttcctaccctcatttttggtattccagcgaaaataaagataacataaaccaagaaagtggtgctttgtgaatcacagtgttattatttttgaaatatcttcttgcttaaacaacatgccaactctcaaaatatatatataactactgataaataattgctaattgcaggaggaggctgatatttttaacaatatgatgcatacatataacatgtatataatttgtttaaattactattatataaaaatattttttaagaataaaaatcaactgaaacaaaattgaaatggagccctacctctgaacggggctttatttgagaagaaaacctagagttagaattccggtttctttttagccacaaacatatatcctgtagctctggaagtccagttgcctagacaaggggattggaggcaattactctgtattcatttaatcagaaatcacattaaggctttctttgcacccagtccctcccactgaagtcctccagaaggtgggtgcggttcagagaacacgatttggcccgttgtgttgaacactatcctggacatatcgactcaatgtgattggatttcctttattacactgaggtgacacagaagaatgataaaatctattattggacaacacagtgccgtccagaagaaccatcaaaatctgacctaaagtaaggggtggggagcaggatgtctgaatttatctcttaaggtaatattttaatatactgttgacattttttcttctcatgctcattttaatatttaaaaaaacctcttaaaccacaaaacttatttcctgtccagttctaaaaataaagcagcctaaatactgctgtcgaatttttttatttaaaaaattgcttctagaatataaatacatatgtttgcttcagcctgaccacctggagtcacaggtttataaattgtataaaagtatatagtgttaagatgtttactaaaaattattaataggttttctgagttatataatttaacttccctgagactattttataaaaagtattacctccactaacaaaataatatgttttgcttgatagattagtcatgtactcatacgactctacaggtgtactgggcacattatggcatgcggttggatgccatggaaactctaaggagggtgtggccagagtgtgggggaacttaatcaaaaacagttgtcagctgactctttactaattttgttcttctcagaataaagatgtcagctgtccttttctgcaagacatttcatttagaagactttcctgaaataatttcttcctgaaatagacagaactgtaggccgatgtgtcattttagttaatcaaaacaagtaggcaaattagtctcttttatttttttaatgaatgtaatttaacggtatttaatttgcatacaggaaagttcacccaggaaaaaaaaagtctgcattatagcacttttgtaaacctcaacaaagcccttcattagcagacctaattgatttttcctacccacccctgggggaagaaagctatcacagtacctgcttattcactcagagaagaaatgggtgtgcctggtggttcaagcagagatttgggttaaaaagtcctgtggctctgtttttgcagggagatcttggtcaatgcttgctttgagcattcaggaaatttgtttttctgagcaataggagaacatcgcttgtctgcttggtgtcctccccatgggcccaatttagttcaacttgcagccttcactggaattattttatttcttgtttatgtaaacctgccttattccaaaagagggattttgaggcttcttaccatgacacatagaatatatcatataaaatgaatgggaaagtgagggcagttggaaattggaaagccaggaaaatatgatgaagccaggaatagaggtcagtagagaaaacatacgcaacagggtcttttgtggttgttagagttaggccacacatttggctctgagttgcacaggtgctggagcaaagaaaaagaggatcaactctaagagttatagtgccaggaagtggaagcaacatcccttgatctgcagaccagcctttcctggtgctgaaacctgactattttttccaacaggcccttgtaaatatggcgctgggtgatgtaatgaaccagctcctgaaaacatgtcttccataaatgtggctcttttgtacaagtccttccatgccaaaggccatagcgtaagtctgtaaagacagttcttcaggggacttttcactcaactgactttcttcagtaattcattttctctcaaagattctccaagattttcttcatctttttcttctcacttcctcccaagtgtcatcctgctgctcctctccacccctccctagcagcatttaggagattggaaatacttcacactggaaagtctcaggagactgacattgctctccctgctgacagagaggcttgcctttggactccttgcccttttaagcaagtaggacatggcacctatgggacagtcatttcccaccagcactcataactctggggcttgccatgatgatccatctcaggtgataaaatgcagcccagggaagtaaaagagcttgcctgtggcaagtcagcatcctgcttcacacctcacatacagctcttctcctttcgctgtgctcatcccatgtatgataaaaagattggccaggcgcagtggctcacacctgtaatcccagtattttgggaaactgagacaggtggattacctgaggtcaggagttcgagaccagcctggccaacatggtgaagcccatctctactaaagatacaaaaattagctgggtgtggtggctcatgcctttagtcccagctactagggaggctgaggtgggaggatcacttgaacccaggaggtagagggtgcagtgagctgagatcacgccactgcactccagcctgggcaacagagcgagaccctgtctcaaaaaaaaaaaaaaaaaaaagataactgtttctggacctttttttttggtcacttcacaatcagtgcagatgttttcttaactgtgtcctgtagatgtgcaagacatcatcacaaggaatcagaaggctggtgtgtttaagacccagaaaatatcaagctggtaagatacctttctgcattaaaaaattcccattgaaattgcttttcttgatactatggatggttattaaaaataataatagctaacatttattgagcacctgctgtgtgtcaggcactgttttaagcactttacaagtattatctcatttaatgctcattggaatactatgaggcagacagacactctcattagctccaattaatagatgagaaaacaagataagtatattaaacactgggttggggatgatttatgattatacagtatgaggttgggagaagccaggcctgggaactccttaaatggctctcttccagtgagtctcagcctaggagcagttttgcccccaaggggacttttggcattccctggagatatttttttttgttgtcatgacttggtaggagagcggggaatgttgctactggcatctagtggtagagaccagggattccactgaacatcctatgttgcttaggacacccccgtacaacaaagaaacatctggcccagaatgtcaatagtgccaacactgagaaaccctgctctgtttcatgattttaaaatagtctaggtgtccattcgcttttagattctgttaattcttatacaaactaggaggaatgcttgctcttagccacaacaatggtgtgttctgtgatgctacattttatttttgccctgttggtaatggatctagagaagtgagtaatcatttcatagttttcacatgaaacagctgtatttgtgcattttttgtcattcatttaaccacagactttattagaataactctctgttaaattaattgttttctttattactgtgaagctgtcatcatttggtattttgaattttccctatggtaaagacactttcccaccccaacttcccagtttgattttttttattagttatataaactactcattaacagacaaagcccacagactgatttctcttggacacacccacgatacagccccggcagccagtgatcttggtgtgctggcttcggacatgaaaatagctacaatgcttaaaaaccaaagtgatgacacatattggtgtgaggctatggaatagcaataatttttttctcttatattaattggtgaatgtaatgaagtgtccatagtgtatttttaaatcctgtttaaaatgttgggagtaagctggtggcacaggggacagcatattctgtgtttctcatataaatgaacaaaccacttctgtttcccagaaaacctggggtaggttgagagaaagagaaagggtctgccgttacctgtggggtcctcattgttaggacagcctttccttcacagtgcagacggccttacccttctggagaggacttcgtttttggacatgattttcaacctggtcttttagttatcaatcaaaagtgcattttctatgttgtcctcatttacatttatttaatgtttaaggtcatttgtgagcatttgagtgtatttcagcatatggaatcagggaataatagatttcagcttcatgctgtgaagagagattgtgtttttacaagacataatgttgtttactgggtgttaataatcactaattaataaacatatctagacatctaaaatgttgcattttgaggaacaaaaatgtcaagtgtttaacttatggagtgcaatggtattttctgtcatctcttcataaaataattaagttacataaacaagcaaaatgtcattattcaacaaaggacatataccaaatgcttaatacatggcctttgtttctatttttctgttctcaaaaatgctatttctagatatattgctctgatatgtacctggacatatagactatatgtcaataatagtcatatagaaacctccaagatgaggatgggctttttttgtcatcttcatctcatactaattgtggtcagtttcttttcttttgacccctgtaagcattttgttcaaagtctactaaagcactttctagtgaacaggtagatgagttagtccttgaaatgccttgatcttatattaaggagtgacctgatcacttaactgtcaagaagctaagagaaatggccagccactgatgtaataatcagtattctccctccatccactgctttcccacccataaccagtacaatgtgatgaaagtattagttccatgagagaagaaataaaaggaagccattcacaaaagagctaagatagagttcaatattcttttttagtgcctcagtgcatatgcagaatttctcctccaaattggagatgtggaataagagtagtgacagataactaagaagtatttaccatagctataaagcccacatgtgagccaaatatttctgctattaaatagcacttcaaagcttgacatgaggtttgtaacagctgaatgtctcttgtgacttcatttgcaaagaagatgtataagctgaaaggaaagtcgtggtatgagaactataagcctaagaaatggtatttaaaaaaaaaaaaaaaaacaagctgcccagaaatttgactggcacccaagctcctattcccactactccgatgatgttctcagtaactatcagcatttctcctgctaccaacctcttcctacctcttacacaggggcagacccaggttgtgtggggcctgaaacttattttgagggcccacttaggaagaatgaattctattataccttactttgataaattttacagaaatatatgaccatgtgaacacattactagggcttgtccaagggccttggaaggggccttgcaagaggctctgacgctgaaccttcattagcttcacagtcaatccacctctgctgtcataagcaccaccatccttgcctaaagtaactcttctcttagctaccaaactttcctgctccctctatccattttaatcatagtctgattgtagctaaatgtgaaagacatgctggtgaaagtctggaagccttagccctagctgaatctaagatccacatatatgaagaattatattcattacatctcagcttaatgcagtcatttggtttatttgttgtccatccatgcagccatccattcacttaacaagtatgtccaaagtactctgcttttgagaatataaatatgcagttatcaaaaataattcttgaacaaaggaaaccatgctactaaatatagctagagattgatgaaagagcaaggatatttacagtatctcaattgttgggtttatctaaagctgtcttcaaaattgtgactgtttaacaaagaaccatttggagcttttgacgtctacgtatttctaggtcttccagaattagtgaatagcgtcattctctggttaatattagttgagagttcttaaaaagtctattaaatttaccctgctgtgatgatgtaagtaagtttcacttaagaatgtatgtatctttgtgtgaaagttgctagtgaattcaggtttatgacctttattattctttgataatccatgaattttagtaaactatggaacttgtgttaagactttttttataacccaaactttacctttatgtgggcccccaagattggttattggtcccattgccctattgctttttaaagatttatgcctcctctgagactcagtttcctttagaggttaaaatggggatgtggaaaatgatttttgaaaggtacgttccaaccaagtagaatccagtggttgattttcctgggccttctgcagtctgcccttatatccacatctcatctagctgctgcctcctcttttggttaccctggacccctcacttgcctccgacagatatgatctctccatctctagtctttgccattcttgtttctctcctcttctccatctaaatccttccttctaggatggctccactgccattttccccttgccttctcagcctaccctaatctttttaatttctgctgcccttagaatagtaccacagttgaacatggcatagtttctttttgttcaaagcatgttggctttgtttgcatgttcactggtttatctacttgttgacaaatattttgaccaccttctgtttgccaagtcctattctagatgctagagatggagtggtaaacaagatggaaaaggccgtgccttcttggagtttatgtcctagggagggaaacagatcatgttcttgaaggcaagaattctgcttaatatgtttttgtactccctgaagcaattagtacactttatccttggtatatgaaagcttttaaaattggtatttagagaacattttgaaagacatgaatccataaggcttatggaaccaaaccatttttagtagaggaaagtcaagctctagagaatcagacatccatttctacatcagatagctgactttcatttcagtgttggcctcttctcaggcatgcgcatgtagtgtctgtagacaaactgacagtgtgagtaggcatttatctgttctttgtcaggttgaagaggaaggttagtagaaggtaactgagataaggaagctgaaggctctctttaagaaattttctgataaaatatacctgttagtgagttttgctagaattatagtaacagaatcctgaagaccgctgagaattctagagatgccacactcctgtttccttctgttgctatcttggctatgacaaaatgaaattatcatgtgtactttctgttactaacataacactgttgatttgcttaacaggtttatagatgggctcatatccctactatttagtgttttgcactgaagacaccaactcccataagaacgttagccggttcagctatttttgatagagttatcctttttgtattaaaatgagccagactttaaaataggaggatgctgtatttttagggaccctcttaaactacagtcaattaaaaattaaggccttttattttagaataacattgtattgattctttggatttgcccacttctactttttaccaaggtcaaaatctcactaccaaaaataggccaggtgctgtattgatagctaggtatgcaagtcagactactgtattctctgtgaaaatgtcttctggttttaagagagaaatccttctcccttcacagaattttatattgcagaagttacatatcaataaaaatatttttattttcaaaggagttcttcacttaaaaatagagccatcttaaaaaacttttttagagaatggccacatgataaatcattgttaaacaatcatttattttttaccttaataatggacattagtttgttttcaatattttgttattataaactgctgcagtgagacacatctttacataaattatacatttgcaagtgtgtctacacaacagattttcagaagtggattgtgtctatttgtacaaccctaccaaactgcataatttttgtcactataactttgtaatatattttcatatttcatatttactaagacttgacattttaaaaactgggagtctttctatgcaagaacaggtattctctttttaagtttttaaaggtgtttcactagcatttttatttctcttaagtttatttttagaaactttttgttggtcttacaaatagggttttttcttcgattatattttctacttccattatgttttactatggggtttgatatagtaagcgtttagtcacctcagtgggttattgttttgaatattttgcaggtttatcctcttgagttttccaaacaaacaatcacatcatctgcagatgatgacaattgtaacttctttctaattctcatacctcctttttctctcttgtataattttattggataaaaatatccaccatgattattaaataataggcatctttgagtctgactttgttgggaatctactaatttttcaccattaagtatgcattagcttttgagttgagataaatatgatattttttatcttcttaaaatttcttaagagatgttatcacaagtaaatatggaactttagcagatatcttttcagcacctatggagatgttcaaattgctttccctattttatttgtaactatgacaaatcatatcaaaaggtttcctaatattgaaacatccctgcatttctagtagttacttattcacagtgtcttaattcttcttttaatatgcttctgtgttctaataacaaattatctgagatttttgaaaattacaactttattgagatataatttacttactatacaagtcacccactgaaagcatatataattaaatggcttttagtgtattcacagagttgtgcaagcatcacaatcattttagagtattttcatcacccccaaaagaaagctcatacttggccagatgtgctggttcacacctataatcccagcactttggggtgccgaggtgggagggttgcttgagcccaggagttcgaaatcagcctgggagtttgaaatcagcctgggcaacatagtgaaaccccatctattgaaaagaaaagaagaggagaggagaggggaggggaggggagggaaggggaggccctcatactcatgccccttcctcactcctccctcctcccttccagggctaggcaaccactgatctatgttctgttgctatgcctttgcttattctggacatttcacataaatggaagtgtataatatgtggtctttcacatctggaatctattgcttaaaatagtgtttttaaggttattcatgtgtagcatatatcagggcatttgtcatttttggtactattccattgtatggatagaccacactttatccactcatcagctgatggacatttgagatgtttcctttttcttttttctttttttttttttttttctattctggataatgctgctatgaacatttgtgtacacatttttgtgacaagtttcatttctcttgggtttatatggtcacatggtaactatatttaacctcttgaggacctgccagactgtttttcaaagtggctgaaccactttaagttttctaccaaaaagtatatgatgttttctgagctgcttgcttagatattcatcagtaaaattggtccagaattttctttattgtgcaatctttgtctgattttaaatagcactgacataatagctatttaaaagaattttgaagtttgtcttatcttttgaaccacctcttagtgggttgccctacactgctaccataattctagatcagaacaatttttaccccattattttgtacgtgatatttggagatatagtggcaagaaagaacaaaattacattaaaaaatgcactgcacttgaaagtatgtaagtttgaaacattaaaaaaaggaagaaaaataaatgaaaacaccaaaaagcaataaataattttgtgatttcatctgagatggtatataattgtactttctagtccattcattctaatattttgttgtcactttgttttgctactatgtaagttaatcagctgtcataggatcagagatacttgaaacggaaaatataattagtaaaataattagtacctttcatttcaaggtcttgaaaccctttctagtcctctttaaccagtgcagaatatactggtccccagcatgaggggggtctgaatgttaggaaaatatccctcttttggactctgaaataagttcatttctgctaaattccaaacaaaaacacagagctgggatcagttttaaagtcagtccagaaaaatgtaagtgataagctggaacaacagttctcaaactttgttctcagaatcatttgtagagcttgttatgacacattctagatccccacaccctgagagactgaggcaggcctggggttttgcattctaacaggtaactctgacgcctggtctggagccctcacgtggggaccaccaaactagagttctcgctgagagcttctcattcaattctgcagtgttccattgctttaaaattgttcaaattttcttgccgggagttgtagctcatgcctgtagtcccagcactttgggaggccagggtgggtggatcacgaagttgggagttcaagacctgcgtggccaacatggtgaaaccccacctctactaaaaacagaaaaattagccaggcgtgtcggcgggcacctgtaatccgagctacttgggaggctgaggcaggagaattgcttgaacctgggaggcagaggttgcagtgagcggagatcacaccactgcactccagcccaggagacagagcaagtccatctcaaaataaataaatacatacataaataaataaataaataaataaataaataaataaataaataaataaaataataaagttgttcagatttccattcattgaagccacttccatccactgtattttcttgcttatttcgtagatgttatgcacttacaagaaaggaaaggacctgacttacagtcagctctcatttgtctggaattcattaatcttacaggtcttctgaggtaaacatttcattgagacctaatttttcttccccctcgcctttctcccagccttattcctagtccagaaatgtaaaataattttgtttcatgataaaatcaatgaagttgatcagataatctgtttcaaggaatttacatatgtgaaatcctgttttggttaatctgtgatgttgcttccttctctgagataagggaagtgttcttaatcaagtctgtccttaggggaactgtcacttctctggaatggcactttctttaaatgcttgggactaaaaagcctaggcctgtggctaaagaatgttctagccaggtgcagtggcgtgtgcctgtagtcccagatactagggacgctgaggcaggaggattgcttgaggccaggagttcaaagctgtagtgtgtcatcatcctgcctgtgaatagccacagtactccagcctgggcaacacggcaagatcccctctcttaaaaattttttaaaaagaatattctaaatgtaaattcatacaggtagagatcttctgaaacgagattttcaaagtggttcatgacccatcatcacctgtagtgctaattttaaaaacaggtttccagacatcacataaaccttgctgaagcaaactccatagagttgaggttcatttgaacaatccgacatttgaacaatctgacagttgaatcaccttctcaggtgattctaatatatctgaagcacagagcatgcttcgagaagcccattttatatccctggattgttgctcagatgagtaaactgaaagcgtgagagtgaatccatggatagcctctgtttgtcattagaagaggcattttttcactctcatgtgagagctttactccccacattggactctgaatttctatggtatcatcttagtgaagatgtgacctcagtggaaaggggaaagttgtatagataagaaagtaattctgattcgtttcttgtctacatcacagcttttagttgttgggattcaacaagaagcacatatcggaggtggacaggcctgaggggatagtccaaccacagctctcaaccagaagtggactgtgtgtccacctctgcactgtttgtaatcatatgggacatttttgttttattgtcacaatagctaagtgctattatggtactgggaagagcagcaactgtaaatattctgcaatgcaagggacagttcaccacaatgaagaattgtcctgttcctcaagactatcccagctgagaaatattagttccagactagatgagaaatggagatccaaaaatattgcctggatctcttttacagcattgtcttgctttctggacgtgtgtgtgtgtgtgtgtgtgtgtgtgtgtgtgtgtgtacctgtatgcatgtgagtgctatatcggtcttacatacattcttctttaaataagggcatggaattgatttttctaatgaataaaagttttttgcctaaaatattttactaagttgctattctagtccaacttttattattcagttcagtgcaatgaaatataatttagtgtctgctatgtgtaaggtactatgatgggctttttatgggttataaagattaaggtgaggtttctgcctttagtaagctcaagatgtccagacaagagatggacatttccccagctaccaagttacaagacagagtctgctctaattgagttaaccatgctatgtgagtataaagagatctgccaattcaaggtggaaggatctgagaaagcttcatgaaggaggtggaccttgagctgtgatctagcaaattaaagataacgaaaggaaagaagttgaagtgggcattcctggtataaaaggcagggaggaaataagaggtagaagtagaaaagatgtgtccagccagatttagctatttgtgataaatagagagaggctagaggcagaaagaccagttaagaaatcatcacactggggtgaaaggggagatgaatgagacagagcacatgaagggacttctaaggttccaagagaagttctatttcttttttttttttcaacttttatttaagatacaaggagtacatgtgcagatttgttagatgggaatattgcatgatgctgggatttggagaacagatcccatcacccaggtagtgagcatagtatctgataggtagttttttaaaactgccccccaccttctaatagtctgctgtgtccattgttcacacatatttatatccatgtgtgctcaatgtttagctcccacttataagtgagaatacgtggtatttggtttcctgtgcctttttggtagaatgatttgttttctttggggtatatacccagtaatgggattgctgggtcgaatggttgctctgttttaagttctttgagaaattttcagacagctttccatggtggttgaactaatttacattcctatcaacagtgtgtaagcgttcccttttctccacagcctcgccagcatctattgtatcttgaccttttaagaatagccattctgactggtgtgaggtgctatctcactgtggtattgatttgcatttctctggtaattagtgatgctggcattttttatatgtttgttggccgcttggtgtatcttcttttgagaagtgtccgttcacgtcctttgccctttttaaatgaggttattgttttttgcttattaagttccctagagattctagatattatgcctttgttggatgcatagtttacaaatatgtgctcccattctgtgtattgtccatttaccctgttggtagtttcttttgatatacagaagctctttcgtgtaatcaggtcacacgtgtctatttttgtttttgttgcagttgctgttggagacttagccaaaaattatttgccaaggccaatgtcaagagagtatttcctaggttgtcttccaggatttttgtagtttgaggtcttacatttaaaaccgtaatccattttgatttaatttttgtatatggcaataggtaggggtccaattttattcttctgcatatggttagccagttatctcagcaccatttattgaacagggtgtcctttcccccttgcttgtttttgtcagctttgttgaagatcagatggttgcaagtgtgcggctttatttctgagctttctattctgttccattggtctatgtgtctatttttataccagtaccaagctgttttggtgactatggctttatagtatagcttgaagtcagtagtgtggtgcctctggctttgttctttttgctcaggattgttttggctatttggactctttttttggttccatatgaattttaaaataacctttttctaattctgcgaagaatgacattggtagtttaataggaatggccttgaacctgtaaattgctttgggcagtatggccatttttacaacattgattcttctcatccatgagcctggaatgtttttccatttatttgtgttgtctttgatttctttcagcagcgttttatagttctccttgcagagatcttctacctccttggttagctgtattcctaggtatttcattttctttgtggctaatttaagtgggattgtgttcctgatttcactctcagcctggacattgtgtaaagaaatgctactgattgttgtacattgattttgtatcctgaaactttactaaagtcatttatcaattctaggagccttttggcagagtctttaggattttctaagtatagaatcatatcaacagcaaagagagatagtttgactttttatttggataccttttatttctttctctttgctaattgttctgcctagaacttctagtactatattgaataggagtggtgagactgggaatccttgtcttgttccagttctcaagggaaatggtttgagcttttgcccattcaggatgatgttggctgtgggtttgtcatagatggctcttattattttgaggtatgttccttctatgcttagtctgttgaggttttttatcatgaagggatgttggagtttatcagaaactttttctgcatctattgagatgatcatatggtttttgcttttgattctgtttatgtggtgaaccacatttattgatttacatatgcttgtttgtttttagagacagggttttactctgtcacccaagctggagtgcagtggtgtgaccatggctcacagcagcctcaacctcccggggtcaagcattcctccttcctcagcctcccaagtagatgggactataggtgtgtgccaccacaccagggtatttttatttttattttttgtagagacagggtctaattttgctgcccagcctggtcttgaactcatggactcaagaaatcctcctgcctcggcctcccaaagtgctgggattacaggcgtgatccagtgcacctggctgttttgtgtatgttgcgccagccttgcatcccaggaataaagcctacttaatcatggggtattaattttttgatctgctgctagattcaatttgctagtattttgttgaggatttctgtgtctgtggtcatgagggatattggtctgaagtttccttttatcattgtgtctttgccagagattggtatcaggctgatgctggcttcatagaatgagttagggaggagcccctcctcctcaattttttggaatagtttcagtaggattggtatcagttcttcttcatatgtctggcagaattcagctgtgaatccatctggtccagggcttttttttgttgtaggttatgactgacttaatttcagaagttgatgttggtctatgcaaggtttccatctcttcctgattcgatcttgggagactgtgtgcttccaggaatgtatccatttcctctagattttctaatttgtatgcatagagttgttcatagtagtctctgaggatctcttatatttctgtggcatcagttgtaatgtcacctttgttgtttctgattgtgcttatttgtatcttttatttctttttctttgttaagatagctagggggtctatccttttttttttttttttttttttgagaaccaactcttggtttcattgatcttttgtatggattttctatttcttaatctgggtggtggttagaagggtgtttgcctgataatagttaaggcatgtatttattccgtgtggtttactgtgtcttatttcacaatacaacatgtcttttgtttttttaaaaaaaaaaagccatttcagtagtaccggagagagaaaaagagggagccccagcctgaatgagagtggaaaatggtgagcaaatacggggtcattccagagaagtgactgtacgtagaatgtaaaatagaggcagagtaagagatagccatttggaaatttacatttgaggtggcagtagaatagatatgtgacagtaactacaagaggttagaaataaaagttcagatctcagaaaaaatattgtgctagaagatttggagatcaaaatcaagtgatcagaacataactacgggaattggaaagtcagaagagaagatgaccaaggacagaatcttagaaaatgtctgtgtgtcaggagtagtaaaaagagccagaaagggatactaagaagggactggagagcaaggttgatggctcagggtggtacggtataataccacttcttaatggaagaagtccaagaaagcatttcaaggagagtgtggttggctgctgcagattactgaaggtaggtcaggcagattgcaaagtagttcagtgactgttggaagaaaggtcatatcatcagggcaggtgaagcaatgggagtgtccactcccataagaatgttggtggcaaagggagagaagttgtgtgtgtgctaaggggaagctgaggtggaagagttgagcatgtgatcaggcaagccgctacagccaagaaagaagaaagaagaaagaagtggagacaagaaagggaaatatttgatgaggcaaagatctagatcagggcttctcaaagtgtggccccctgaccagcaccaccagcatcagttgtatacttgttggaaatgcatattccaaggccccacctcagacctgctgaatcggaaactctggagttgaagctcaggaatgtgtatttcaacagactatctaagaattatgatgtatgccgaagtttgaaaaccactagggaagaggaaggggtggctttatccagcacacagatggagaagttctccttaatgagaagagtgaccctacttccttttagacaagaggaaaggagaaaaagaagaagaggagaaagatggtatcagatagatagcctcaggctttctgtaaggtcacctgctgagaacaaagacttgggatatttggggagcttaaagcgtgagtgtgttcattccagcctccaaaccctggcctcttctttaggctttgtctgatatgtcctcttgcttcttcattccccatccagatcctgtgtgtaagatcacatgcagttccaccttcttcaggataccttccccaacttgtccagtccacagtgattactcctttggtagtaccttacttacatagggccatcggtaattcttttgtttcatttgaatgtcttgtcttccgaatatgactgtatgttccttttgacgattatgattttgctacttgaggaacatgtcctcattgtactgctgctcacagcatccactgaggcttcaataacatttatagacagacgactcccaaattaggaagtcaacggatcaatatcccctttcattctgagttttcaattccagatttagatggtgtccttttctctaagtgtttaaaacactttcttagagaggcttctatgatatggaagtttaaaactctataaaagataaggaaaattggaggagaaagtggcaaataggaaatcatttgaaagaagagaagtgattcactggtttgggtaaacactgtaaatgacttgaacactgtaaacactgtaaatggccctctacaagagtgagctgtgccaacatagactttgagaagtgacataaaagaaactgtgggaaaggatactggaatcctctgtaaagaatgcctataatagccatacaaagaacatggctgccttccctactgctggtaagatagcttgtttttgaagttcattacatttagcaagcatgatcaagaattctatcagtgcactactttcacaaatacacaagaaactacctttttaacagcagagtttaaaaccaagactcagccgggcacagtggcccacacctgtaatcccagcactttgggaggctgaagcgggtggatcacttgaggccagaagtttgagaccagcctggccaacatggcgaaaccccgtctctactataagtacaaaaattagctgggcatggtagcacatgcctgtaatttcagctactagggaggctgaggcaggagaattgcttgaacccagggggcagaggttgcagtgagctgagattgcgccactgcactccaccctgggtgacagagcaagactctgtctcagaaaacaaacaaacaaaaaacaggactcactcccctacagccaggagtctgaaaatataaaggtaaacaaagaagtactaaacatgagaatatgagaaaataaattctttaaacctctatagggagagttatctgtgatcactgcaatgaaatacaaattagggtgaacccatttgacattaggttttattacaaacttgaaacagagactctctgtttgagaaattctttcagtgtgagttttgcatcacaaggtaaaaatcctatcagaaattgacttggttttgtttttcagattgaaaccccaaactcaaagccagaatgaaaggacataagttagtacaagaataagggaagggaaactaatatttcttgagcacctataatgtggtttcatttactccatctctttcaattcttaatgagtcctgtgatgcaactcttactgtctcttttttacagatgagggcaatgatactcagcatctctcatcttcactgccttgcgtttgaactcagagctatccagctacaaagcccatgcattctttctgctatactatacctgttaaacttcataggtttggcatgtccatagctgttatgatttttctttatttttaaaattagagacaggatcgtactttgtcatccaggctggagtacagtggcaagatcatagctcactgtaacctcaaattcctggactcaagtgatcctcctgtctcagactcctgagtagctaggacaacaggtacataccaccacaactggctaattttttattttttttgtagagacaggggtctcactatgttgcttaggctggtctcaaactcttggcctcaagcaatcctcccaccttggcctttcaaagtgctgggattacaggcatgagccatagtgcccagccaagatttttctaaaacatggagaattctataatgattattgattttgtaatgtttctgcttacaaaattgtattttactttgtaatgaattttgaatggaaataagattttaatattgtgatgaaataaaatggagagaatataaattttactttggtgtcagtgtaattacaagcaacatgttgacatgatttgatgtctggtagaaccatcctttacatgtcttcgcacatgaatgttatgctttagatggtaaaacttatataggtaagggtcctacttgtatgcgccttgctctttttcagaaagcattttctgttcagtttgtttaaaaaacagttttgtagctgggactataggcacatgtcaccatgcccagcttggagttctaatttgaatttccctagggactaatgatgttgaatatattttcatgtacttatttgccattcacgtatcttctctggtgaagtgtctgttcaaatgctttgctcattttttaaaaaattgggttgcttgtttttcttatcattgacatactctgggagttctttatatattctggatataagcttatatcagatactatatatgatttgccattttcttccagcctgtagctcgtcttcattctcctcacaggatctttcaaagtgcaaatgtttttaattttaataaagtctgatttaccaatttgttcttttaaggatcaagactcttgtgtgtgtctaagaaatctttacctaactcaaggttacaaagattttctcctgcattttcatctacaagttttatagttttgggttttacatttaggtttatgattcattttgcatcaatatttgcatatggtgtgagatatagattgaagttctgtttttaaaaaatggagactcaattgttaaaacatcatttcatcctttgctcaccaaattgcctccatttacttaggtcttatttaatttctctcatccattgtcagaattatctttaagtgtttcatatttttatgctattataaacagaatggttttttaatgctgttgtaaacagtataaaattggaaattccaacttccaattatttgttgattttatgaagaaatacaactgattcttgtacattgatcttgtatcccacaatcctactaaagtcacttattagttctagaagcttatttttgtatatctctttatacagaaagggactgtaatctccagtgcagtgttgaagaatgaaagaaaacatacttttcttatgcctgacgttaggaagaaagcatcgggtctttcaccattaagtatgatgttaactataggtttttcatagatgacctttttcaggccaaagaatttcctttctatttttaggttgctgaaagtttttagcaggaacagacattaatctttgtcagaagcattttctgcctttattgagatgatcatatgttttttcttttttggcttgctaatatagtagattatattgatcaattttcaaatgttaaaccaaccttcttatattcttaagataagccccacttgatcatgatgcattgccatatgtatgttcatatgtatattatggacaactttggatatgttgtattaatattgcataaatattatcctcttaatatttatggactctgtattgatggcacctctcatattcatgatattggtgatttatatcttctcccttttttcctgataagtcaggctagaggtttatcaattttattgatctcaaagaatcagtgtttggtttcattgatttttctctattatttttctgtttccctttttattcacttctgctctaatctttattacttctttttttttttctggtcaagtttaacttactcttctttttcttgaatatttagctagaaactgagttcactaattgagacctttcctaataatagccatttagtgctattaatttcctctaagtacttcattcgtggcatcccataaattttgatgtgttgtattttcattcaacgcaaaataattgtcagtttatgttttcatttattctttggaccccaggttatttagaagtatattatttattttccaaatatttgagaattttacagagattattgatttctagtttaattccattgtggtcaggaaacattctttttttttttatttttatttttgagacaggttctcgctgtgatgcccaggctggagtgcaatggtgcaatctcagctcactgcaacctctgcctcctgggttcaagctattctcctgctccagcctcctgagtggctgggactacaggcatgcaccaccatgccaggctaatttttgtatttttagtatagatggtgtttcaccatattggccaggctggtctcaacttctgacctcaagtgatccaccccctcagcctcccaaagtgctggattacagggatgagccaccatgcccagccagggaacatattttttgtatgactagaatcattttaaatttattgagacttacactatgacccagaataggtatatattggtaaatggtctatttgaaaagaacatctgttctgctattgttgagtgtattctataaatatcaattaagtcaagttattgatagtgttgtttaagtcatctgtagctttgcttattttctgtctacttgttccatcaattactgagaggggagtattaaaatctctgacaataatttggtttcatctgtgtttttttgtagttgtacttctatccatttcagcttcataaatttgaagctctgttattcagtgcgtgaatatttagaattgttatgtctgcttcttgaccctttaacattgtaaagtgatcttccttattcctagtacattctttgctctgaaatctactatgtctgatatgaatatagacactccagctttcttttgactagtgttgcttggtatagctttgtccatctttttacttttaacctagttgtgtctgtatatttaaaatgcatttattgtaagccacatgtacttcggtctagctgttttgtccagtctgacacactctgccttttaattggagcgttcagaccatttttgtttagtacagttactgatggggttagatttaaatctgtcattttactatttgttttgtgtttcatctattctttgttccccctttcatcttgttctgcttgcttttggattaaatgagtttattttcttattctattttatctcctttgttggcttattagctgtaactctttgttttttattttagtggttgctttagattttatagtatgtatctttaacttatcacagactatcctcaaatgatataccatttcatgtatattattaaaacctgtggctgggcatggtggctcatgcctataatcccagcactttgggaggccaaagtgggcggatcacttaaggccaagagtttgaaaccagcctggccatcatgatgaaaccccatctctactgaaaaaaaaaaacaaaaacaaaaattagccaggcgtggtcgttggtgcctgtaattccagctactcgggaggctgagacaggagaatagcttcaacctgggaggcggaggctgcagtgagctgagatcatgctactgtactcgagcctgctctgtctcaaacaaaacaaaacaaaacaaaacaaaacaaaacaaaacaaaaccttacagtagtatactgccattggtcccctgccagtctttatgctactattgtcctactttttatctatacatatattatcaccccacaatacttgcttgtttaaccaattatatttaaagaggtttaagtaataagaaacagtcatatatatatttacctatatagttagtatttctgattccttcatgtacatttccatctgatataatttttcttctgccttaaggatttcctttaacatttcttgcagcataggtctgctggtgattaattccttcagctttttgtatgtctgaaaacatctgtttcaccttgttttgaaatatattttcactggctatacaattctaggttgacagttgttttttattcctttcagtactttaaagatgctgctccactgtcttctaacttgcatattcctcacaaaaaaaatatgctgtcatccttatctttgtttttatataaaacatctttttcctctgggtgcttttcagattttctctttatcactacttttaggcaattcgattattattatgtgcctgctagttttcttcatgtttcttgtgtttgggcttgttgaaatttcttgctgagttaacagttttcattaaattaggacatttttcagccattatttcttcaaatattttttctgttgtctcccttctcctattttttgagaagtccagtttcacatgtattgaccacttaaaattgtcccacagctcactctttattttattcctttttttctccatatatttcattttggatagtttctatcactatgttttcaagttcactagtcttctcttttgcggtgtctaatctgctgttaatcttatccaatgtattgttcttctcaggcattgtagttttcatctctagaagtttgatttggggctttaaaaggtatctcccatgtctctacctgattcttagaatatattaaagaccattatgataactattgtaatgcccgtgtctgctaattctgacatctctgtcagttttcgattgagttcagttgtttgatttgtcttgtcattatggtttctattttttcaattttttatatgtctggccatcttggattatatactaggtattttgaattttacttcgttgggatctgaatgtttttatatttctgtaaatgtttttgagattttgcgtttgttttagagacagagtctcactcagtcatgcaggctggagtggagtggcacaatcacagcttactacagcttcaacttcccgagctcaagtggtcctcccttctcagccccccaggtagctgggaacacaagcatgcaccaccatgctcatctaatttttgtatttttttgtagagatgggatcttgccatgttgcccatgctgtttttgaacgcctgacctcaagcagtcctcccaccttgaccgcccaaagtgtgtttttgagttttgttctgggatacagttaaattactttgaaatagtttgatatgtttgggtcttgcttttaagatttgttaggcagaaccagagcagcatttagtctagggctaattattccctactattgagacaagacccttctgaggactctacacaatgcttgtaaattatgaggttttctaatctggctggtggaacactcactattcctggccctgtgtgagcactgacctactccccttcaattttttgacatgatctttccccaacttcaagtagttttctcacatacatgcatgatcagtcatccacagaatattctagggggaccatccacagatctccagagttctctctctctctctttctctctctctctctctctttctctctcaagtgctctcctattcagtattttatcctgggaactctgaagtttcttagactctcagttccatcttcttttttttctttttttttttttcttgagatggagtctcgctgttacccaggctggagtgcagtggtgtgatctaggctcactacaacctctgcctcccaggttcaagcgattctcctgcttcagcctcccaagtagctgggattacaggtgcccaccatcgtgcccagctaatttttttatttttagtggagacggggtttcaccatcttggctagcccagtctcaaactcctgacctcatgatccacccgcctcagcctcccaaagtgctgggattacaggcatgagccaccatgcctggccccatcttcttaactcaggcagtccacctgcttctttctcatttcctccatctatgctatggcctggaaactctcaaggcagtaagctggggtaaaggtagggctcatttcatttatttctgtcttcttaaggattactgtcctgtgttgctgatgttcagtgtcttgaaaactattgttttatatgttttgtgtaggttttctgttgttgttttagacaaaaagctaaatgagggccttgttacgccatctttgctggaagcagaaatctttagaaagcattttaagtggacttcatatctagctaatccacacattgtattcaaagaccaatttaacaatagaaacctctatttcttgagggccttctgtgtgccaggcactgtgctaggtacattcacacacaattcatccatatggcatatttattgaacagctattaggtgctagggactattctagacattggaaatacatcactgtacaaaacagattttaaaaatctgtatccctgtggtgcttatattctagtggggaaagagagaagaaacaaaatcaataatttagttatattgcacattaaagggtaatagctgctacagaaaaataaagagcaagataagggggttttagaagtgctggactgaaaataaatgattgcagttttaaagaggatggtcagggaaggcctccctgagaaggtaagacatatacacaaagacctgaaggaggtgacggagtgagctgtagctatagagatatctggaggaagagcattttggctgctcaagcagccagtattaagaccctagaacagaaccatgctagtatattcaggaaagcataaggaggccagtgttactagagcaaagaggccaaggaggagagtaatagtagatgaggacagagtggtaaccaggcccaattgtgtaagggttttcaggtcattgtaaagactttggcttttgctctgagtgaagagagaaaaggctcatgatctgatacatgttttaaaagaatcactctggctgctctcttgagcagagattgttggatgacagatggaagcagggagaccaattagggagctatgaaataattcagatgagagatgatagtagtttagactggggagagcagtagagatagagagaagtggttagattttgatatatttcaaaggtagaatgacctgcacttgtggcatattcaatgtggactgtaaaagaaagagtcaaagatatattcaaggtctttggcctgagcaactggaaagatggaattaccaataacgagatttaaaaaagactgaatgaagtgagttttagggaaaatgattgggaattcaaatttggacatgttaggtttgagatgtctagtagatacccaagtggaaatattaaaataggaagttggatatatgaatctagagttcatgggagaggttcaggctgataggtcaagtaagataaagactaagaactgacctaaatttagcaatgtggagatctttggtgagtttgacagcagcatttttggtggaacggtggggacaaaagcctggctggagtgaattttaagagaatgagaggagaggaattggcaacagagcgtcaaacaattttctcaaagagttttgctgcaaaggaggaatagagaaatggtgcaataactgtcaggagaggatattttacaaagggggaaataactccatgtttgaatactgatggaagtaatccagagagagaaaagaactgatataggaaacagaagggaaattgctagagcacgtcctagaatagatcaaaggggatggatctaggtggcataagagaaggtactggctgtagataggagtatagatagttcatctatggtaatgggcaggaaggcagaatgtgtagatgcagatgctattaggagcataagtgtggtggtaggagtttatggaagttcttaactgattgctgcatttttttttttttttttttttgagaaagggtctcatttttgtcacccaggctggagtgcagtggctagatcatggctcactgcagccttgacttcctgggctcagatgatcctcccaccttagcctccggagtggctgagaccacaggtgtgtgccaccacacccagctaattttttgtatttttagcagcgagggggtatcgccatgttgcccaggctagtctcgagctcctaggcttaagcaatccacccgcttcggtctcccaaagtgctaggattacaggcatgagccaccgtgcccggctggattgctgcaattttgacagtaaagcaagaagcagggtcatcagctgaaagtgaggaggaggggaatagtgtcagaattttgaagggagagtacaaagtgcaaaataatgacctaggatagtgggaaactaaatggacaaaggaaatgtaagtataactgccagatgtcattaagagtccacttgaggttcatagtcatgaatttaaagcaaagccagtgaggatgcttgtgtgctgtctctagccacattcaggtgcacaggtgcagtcatggaccaggcagagagctggatttaacaaatacgaggaagtaagagagggacaaggaagttgagggtgtatgcaagggagtaattacaatgataagtcatgaaatttaagctgagcaagaaagaaagataaatattagggaagtgggatagtgacatggtgataagatcagtgtgggccagtgggactgaagagtaccttctagaaagaatgagctgtgaaagataggaggggttggtcagagattggctagagttgcagtaactggtaaagataggtttggaggagtgccactcaatgagtaggccatggactggtgccagtctgtgaactgtgtgttactgatctgcaaggagataagttcagaaattgaaaataaatgtttagaaacactgctgcgacatccaagcatatgatcagtggacttgtatttggaatgcctttgtgtttttaatctcatttttgtgactatattttacaaaagtattggtctgcaacagattagatacaaacaaagtctggtcctcccccacagtggaagcacatgctctcacgagcatgcatgggagtgtatctccaaaggtggaggacaaggtcactggaggagaggagtgaacagtgaactcaccatcatctctagtcttccaagatagcaggctgcctgactgcacagctccaggaagcaccattctcattgtatgttacatgaacaatacaactccaggtactgtatgaatggtgctcttagaatgttcaaggagatagctagtgttatccccatcttacagatcagaaaacaagctcagaaaggttaaataattgcctaaactcatacagctactaaggggaggagccaagatttgaacctaggtctgtctgctgtgctaaagctgaactctgtccacaataccactctctttctctgtcacatgcatgtagcacagccataagcctcatgagaactggggaaaaataccttttaggaatgtgttatggtccatgtgaccaagccaggcatttcaatttattttagagtcatgactcattacagctgctgtgggaatccatacccagtcgctgcttagacccctatctctccagtttgtctttgttgaaccaaggggctgaagcacctcaggaatacagcatccactatcaccacaggatttcctgcagtctgttcttgtgctttagtaattgcatatgtattaaaagcaaattctaaagagacatttatggaatggtaagattatgagtaattttaatactttaatctttttttttcaaaattcatatgatggatagatacattacttttctgatcagagaatgtctagtatagatgtatactttaaaccatcttgctcatggttcaagtcttagactctaaaactcagggctgtgatgagggctgggaaggccccatctctcactgagcctgagtcccagatacactgggagcctcagcatttccagaaaagttggtgtttgttgcttcctgctctccccaggtgcatggagtttctgagaaatccgtaaacaacgtaagcattgatctcttaggatttcctaatttccttcatttcttgcctatccagtaggcctcagcaagtacagcaacactaaagttaatttgtaaagcttatctgggtgttactggacttgtgaaccctgaggtaacccactgcttctggaaagccctcccatgctccaagtctgtatattcacccaatgcataggatacagcgtaggaattgggggtttctgtgtccatatggcccatcaagctgcccctgtgaaggcatggtctatggcacagcacaggacctgacacacagtgaggagtggctcagtaggaacgagttggacaagtcaatgaacaactgctgcccagcgtgtgtaggtatttttgtggtgatgtctttaatcttttctaccttgagaaatttactggcattaatatatattaatgtattgtatatgaaaagaacttttgggctgactggtataagacttattattacattcagacacatgacttttcacctagggaagatatagaagaaatgaatccaccaaaataagcaaatataactgggcagggtaggacatgttcaatccggttaggtttaaagaatcaaaatagaaaataggaacagaattttactttgaaaaatagtactgtaaatcacagttttggtgctgtggtaagacgaatcattaaaatacttgaatatggtaaaatgctaatcatcacagttattaattgagagtaactaaaaacctctggttggcctcataagcattagtaaagttttcaaatgcatgttactaattattgttattaatgtgaagttttaaacctgatcccctttgggagactaagtgtcagtgtgggtgaatttttcactatgcctaaaaaccaagaactaccaaatgaaatttgactcttcttttcttccatcttaccaaattgctcatttcatcaatatgaaaagcaactgatatgccaggcagtatagatataagctgtctcacatcatttatttttataaatttgtgttccagtcaaatgtggaatactttggtttcaatatgtaccttattgatgttaagggtctagaatcattataatgactacggtaaagataagatatttttctctagtttgtctacaaaaacctataaaaactagcaaaaaggttaactattttatttaagtagagaattcttcttctagatttgaatactaaataaaacacagaagacagttacatcctattttttattataccttttgaaataatttgtatataccttttaaataatttcaagtgccacaaaaaaataatgttaatagctcaaaatcaaaatttaaaaaaaaccctatgtataatttttaaaatctttttctcctcaagcgttttacgatgggataatgagacagatgtctctcaactggaaggacattttgacattgttatgtgtgctgactggtaagtacataaaaatcacaaaactcctgttagaaaaaaatagctttgctggagtaattgggctgtgttgcttagctgacggctaagcaaagtcaacaaatgaagcacaaagccaccttaacctcaacaaattaatattcatctccatgtgacagttataaggtagtcttctatcacacagtaacttctaccacattatttcccaaagattgattttgagaagcatttccattttctggaattgcctctgtttcatgcttgacgtatcagtaaatggacgacttaggcaaattgcaaataattatggctcggagaggaatagtctggagaaaaaggagtttatcaacacaaacagctcaattagcttacttcttaggagagatctgactattgatataagggaaaatatatgtgtgtgtgtacacacacatactctctagcaaataaacatatctgtggaatatctttggggaaatagcttttcttaaaatatatgtttgctatctaatgttttcagtgtattcaattataatagttaattatacctaaaacaaaaattataaaattacattttattcttatgcaaataataacatgacaatctctgtcaggtgcctgccttttaaaaataatttacattcggtattttgccctctattttagcccaatctacttatttgttaatgaaagtctgatcgtaagttacaggataaatatgcatcagaccttaataattatttcaactaatcttatgtatttcttcatgcagtttgaataataattatttcagcttatgggaaacattgacaattcacaagtattttccctgttaagagtaagatcttgtttgaggttttatcatgatgtttattaggacactttagatttgaaaacacattaagttcagattctgaagaagttctgttatattgataaggccaatcataagatccagaactcagggaagactttccctagaggagaattgaatgaaattttcaggaagtgggttttgttattattattattttaataagattttcaatggataacttttctacaaaagtcattggaattaggtttgctttttttcttcagaaaaaaaaacacttctccatgaaaaataaatattttgtctattcttagctgagagtttctagtttttcatagcccttttagtctttttgcacccaatttcagaaaatcttgttccaaaaataggagaaacctggatttctgactaatcaatgataatgtgcctcaatgctgcagccctcatctaatcaaaaataaggagctaaaacctcaccgtatgattcgagcaagtaatttagtaaatgcctttcctcaccaaatatgagaaagaatcctccaggtttcattgcacagatgaagataatgctggcaggattagatcagattaagcatgaaagtcagatcagagagcagcggcaaaagggaaggggcagcatcttcctgaagctttagacaagggtcacacgtggatgggctctgattatatggggaaggcaggtctggccaggagatttagagttaaatttgtcccttacgcaaatatcaaaacagcctggctttgtcataccttgtgttatggacactctcaccatgtcatcctatttgtaccagagggaaaagcagaggaagtaagatttaagctcttttctgattaatgttctcaggttaaaaatagccacacaacatgtttggaaaacattcttttttccctagccgacaacagggtcacgtacactgatatacataatgcatattcaatttaagacttacattacacacacataacataatattatatgtatacacacacacatagatacacatctggtagctgtgtgagaatttatggcttcaaatgaactaaatacaccaagcttcattttataaatggcttttccatgcatgaattgtttttttttttcccctgggtgttgtaaatgccagaatgtcagcctgtttatactttcccatttgtaaatgtgaaacattaagctactctcactgcgatgctgatagtatttccaaaagaaatgctttggtaatggtctctcttcatattcgcggggatgggtaagctgcttagaaacttagaaagtacagtaatatttctaatatgcacgttgtgcatgtagcagtgaagcacaggattccacgagttctttatgtcctgttggtgtggtgtttctctgtaagagttattgcatggatgctgcttctaggggcaggcaggcaggcaggcaaaccgtgctacatatttttaagaatgtcactggggaggaaaagaaagctctctttagacactacctccaagacgaaacctgaaatcctcagtgtcaggaagaggtgccacacataaatagatcacattaagtctcacaccatcctttagtcattgtcagcaatgagatctggattaggccacaggaatatgaagcaagagtcggagttcaaatattaggtacatggattaaaatcttattgaagcgtttccagcaagggtggcattgtctgattccctgaatagctaaccagtggtactgcttgatcccatttacatgaaaacaagctctattcacaaacctattccaaacccacattgtggttcaagtaaaatgcacatgattacaacaaatggtgatatgtttatgttcttaaatcattcatatattcagatatttacattcaaacattcaaaaacctgtaggcagtgggggaaataacttatttcccagaagagacagtctgttagttcacaactaaatttagtagctcaactagattataaaataaagaggcaaactgtgaaagctagtcattatttcaccattcagcatttttgacaatgaaaaatagtttcatggttcagcagttcctaaataacttgtaaaatgtcaactttgaaataaacagaaggaaaaaatgaggtgcagccatacctgcaaaaggatgctattgacaaacatcaaaatattagaatatttaaccacaggtgtagaaaaaaaacctgcctattaagttcctcagttgacttgtttaatgttgagtttaatataaggattcctttctgctggaatgcagtccagcctggtccttgctgagttagaatagtgagtgattgttaattttaagcctgcctttccagactcctgttcaatcacaatataatctaagggtctggaagtaagatgttttttatccaatgaacgctttcattcagtgtttgaacggccctccagtttattgtagctctgcaaaaatagaaatgactctgtgcatttgaattctcaaaaggcttagaaagcatatctgaaatgccacccataccctgaccggcccattgagctgggtatgcaggacaatcagcacatctgtgtgcctgcagcccgagactttggaaagaaataagggaaagtacattggcctgtagcaacccaccccgattgctctctcagcgtttttgcacttgctatatactctaaattgtttcttttttttagtcctttttactttgctctaaatgatgaaaaatgtttgatttttaagctgattttgtgaaaatttttttccctcaaaatggaaatactgtaggctctagaatttgttttctttcagatgctgtgatcatggacagctccaaatcacaactcacggaagtttacacctgaaaatatctttcgcccaaatatagtcagccctttcacctgacacctgagaagactcagtcccagagaaaatacatgaatcacccaagattgctcaactaaaggggtagagccaagtaaaattagaatacagcattattctgagctctcataaaaatcagttggtaaatactgaaagaggtcattcctttgctgaagttaaatctaaaacagtgactttaactcagcacatttcacattgaaaattacataggggtcttcctttctgtggctattgacagagaaaaatgtctccttgttctctgcactaattaacttccctatgagaggaattacagatgctctgcagtctgcatgaaactgattctaagggaggtgatgaaaatggtctggcacctttcctttgttggaaaatctgtgattcagatcaatggaagaaagcaagtgttgatccacaagtgaattatatagaggtctgtgtgtctgtgtgtgtgtgtgtgcatgggtgccctttaatggtcaaactagactgccaatgtattttgatcagtaactgaagtgagagttaaaatggtatctctgtccccatcactgacccactcagccttttttaatagatccacttaagctactgctgttctctcagcccattaagacttatttaaggggtgaattttcaggagattatatatcattccctctaaaacacattgaaattgctcagatgacatactctacaaagtgttataaattctgcatcagagctaagtagcaagtgagcttacttggaataaagatctattagagaactacaaagaattaattttgggaaatttgatttggagagatggagtagacagcattacctttcaaataagtctgtttggaatgtgtgccgtgtgttaagctgtgatgttaacatctttgtaatcctgaccaactttaaggggaaatagcactttataagggcatgtttgaagctcagttcttaaggtgctgttcattttttttttctaacgatcttaccggttttaggatgcacagatataaaccgagtgtggtcctttgcttaaatgccgcatgtcccaaccagccaggtttcccgtaggcctgggtaactgacagagatattttcctacaatcataatcttcttttaaaaatccagaatgcttaattattaaaactcaagatattgggccagacgcggtggctcatgcctgtagtcccagcactttgggaggccgaggcgggcagatcatgaggtcaggagatcgagaccatcctggctaacacggtgaaaccccatctctactaaaaataataaaaaaaaaattagatgggcatggtggtgggcacctgtagtcccagctactcgggagactgaggcaggagaatggcatgaacccgggaggcggagcttgcagtgagccaagatcgctcaagatattattgcctcactaaggaataaaatagagagtcctgaagagcgaatattttaaagacatacttatagtttgattcctttctcgttaattcttaatggttattaattactgtttaatatgacttaatggcaagtttgtgtagcacttaatttacatacattctgtgctccaagatttgagaatgtagttttgggaaagataaagtctttccatgggtaataatcaggtcatcatgagtgatggatggaatgggatgaggttccattctggacgtggtttctagctcatctgaggattcttttcccattgctcaaagtgaccttccatagaagaaccttccatggaacctgtgatgaccaaagacactcaagcaatgactttttggaaacttcttataagctgctctcctcagaggagaaaatcatcagatcggaagagaacctagtctgttgaaatatcctacctgaaagttggttcatccttgacagtatcagtaaaggagtgtgtactacccactttagggacattgaaactaacaccctacataagctcctcaattccaaggactgtgatgatctgccagtctgtccacaagtaactgccagtctgtgtgtacgctgtgctggaactattaatagtaaagcaaaatgaagacagaatggaagctccttgagaatgggaactttgtcttattcatagctcatccccagttcctaaatttgcccttagtatatagtagatgctcaacaaacctttatcaactaacatatcttattaatttgatgtccacatagtcatataggtgggtgtttattgacaaggaaactgaggcttcacatgaagtgacctgcccaaagtcacacagcagcaacatcaaagccagagctctttaaaaccctgaaccaagttcctcccttgtctgaagtacagctccacgcaacagccccctctgagcgaggacagcagccctcccactgacagctgatacccacccttagctaaaaagaatgatgcagggccctagagtaggtggtgcttactcttgctgtgtgaagagacaggaggccaaatcagaagggtctgacctgcagcattagaaatgggagtagggggccttacttaggcccctcatggagatggctgatgcacaaggttgctgagtgttctagcttaaggtaagggactcaccgttagagaagaaattcaagttgtgaatggaacagttttccatattactttccaaacaaacgtatttgaaatgctgttatgggttaagaggtttcaaaagtagttttgctgtcactgctttttttttttctctctctctcaagacaaagtctcactctgtcacccaggccagaatgcaatgtcacgatctcagcccactgcagcctccgcctccgcctccaaggttcaagcgaccctcctgcctcagcctcccaagtagctgggattacaggcacacaccaccacgcctggctaatttttgtatttttagtagagttgagatttcactatgttggtcaggctggccttgaactcctgacctcagatgatccacccaccttggtctcccaaagtgctgggattacaggtttgagccaccgtgccctgtctgctgtccctgctttttaaaaagacatcgttgtcaatttttattaagtagaagacagtccttttatttatttattgctttgcaaaagacacagcctagaactgatggctctaaagctgaagatgtatgtctcatacactcctcaagccatacactatcactatagtgactacctctacagcacggctgttcttccccaggaatcaacgttttcgtctactgtgtcctcagctgttttccaaatgttatgagagaggcaaagaaatgcaaagatgaggccgggcacggtggctcacgcctataatcccaacaatttgggagactgaggtgggcagatcacctgaggtcaggagtttgagaccaacctggccaacatggtgaaaccctgcctctactaaaatacaaaaattagctgggcatgatggcgcatgtctgtaatcccagctacttgggaggctgaggcaggagaatcgcttgaacccaggaggtggaggttgcagtgagtcaagattgtgccactgcactccagcctgggcaacagagtgagactcggtctcaaaaaaaaaagaaatgcagatgctctctgccttcaagaagcatagcagctgaatgagaggacagctgaatgagaggacaacaatgaaatgcagggacctgggagaacctccaaattctctacttcttgtactgagcttggaaaagggagagatcactatggatgcaagtaaacagggatggctttctcgaccaaccccgcctaactctagtcatctgatgacctccgtcttttgcctaaaccagtcagtgctctcttccgtacattatttcatgctcaggagtaattacaattagatgtgagaggcagtaccaagcagtggctcagagcacagactctgaagccaatatggtacagaggtgaatcccagccctgccaattagtagctgtgtgactccaaacctctctgtgcctccatttccttagctgtaaaatgtggacaataataataatgctaacagtaaaaactacctcataggattgatgtgaggattaaatgagctatgaaaacctcttagaaggtacctgttagctagtactcagctcagtgagtattaactgttttgttattaagacgtgtgtgtctctgccatttgtatttaacacgtgtccttgtgcctggcttacctccctgttatactgtaacctccgtaaggacaggcatagtgcccccttcttccttatctctttactgcttgtattagtccatcttgcgctgctacaaaggtacacctgaagctaggtaatttataaagacatgagatttaattggcttatggttctgcaggctgtgcaggaagcatattgctggcatctgcttctggtgaagacctcaggaagttgccttatggcagaaggcacaggggaagcaggcagtcacatggtgagagagaaggagcaatagagagaaacaggaggttctttcaaccaaccagatctcacgtgagctcattaccacggggagttcaccaagacaaggatgaaggatccgcccctatgacccaatacctcccactaggccccacctccaacactggggatcacatttcaacacaagatttggaggggagaaacatccgaacagtatcactgcttttcggtgctgtatatacaatttgggccccatggttttggcatcctggatattccagtactgttcagatttcagagattcagctgtactttctaagctcagttattatgacctcagttcatagttactatgttggtgcaaaagtaattgcggtttttgccattaaaggtatggcatggcaaaaaccgcaattacttttgcaccaacataatatcagatcacgtatcccaatatggggttcagaaaaaaagtccctatcaataggtatcattggcagcctctagcagctttgctttctcttggcagagtgctctagcaatgcccaggagcccttctgcagaggctggacaactctcctggtgtttggcagccagctctgttctgcatgccttcggcacaatatgctttcacctgtccccaccctaaccccacccacagaatcctttccttggttttaataaacttccagctgtcttcgtccattttctgctgctataacagaataccacagattgggtcattgataaagaacagaaatgtaattctcacagttccagaggctggtaaatccaagatcaaggcacgggcaggttggtgtctggtgagcatctggtctcttctgccaagatgacacctagaatgctgcatcctctggagaagaagaacacgtgtcctcacatggcagaaggcaggagggcaaaaaggagccaaactccccacctctcaatactgttgcattggggattaagtctccaacacatgaatttgggggaaacattcagaccatagcatcaggcatggccaagttaagtaacttgccacctactgccaagcaacccaaactcaaaggtctgcgacctgcaagttcagataaggaaactgtctcaagcttccaagataataactggtgaagacagagtcagactgacccaagcaaaggggtgacagagctgcatgaacagaaattctctaaagatcagggatggaaaatgaaaaatcaaaatgaactataaaaacatgaacctgggttgggtacagtggcatgtgcctgtaatcccagcactttgggaggttgaggcaggaagactgcttgagcccagtagttcaagaccagccctggcaacagagtgagaccctgtccctacaaaaaaaaaaaaaaaaaaaaaaaaagaactagctgggcatggtggtgcacaactgtagtcccagctacttgggaggctggggtgggaggattgcttgagccctggcatttgaggctgcagtaactggatgacagtgcaaaatcctgtctcagaaacaaaaaaaaaaaaagaaagaaagaaaacaaagaaaagaaaaaaaacaaaaaatcaatgtagaggcccagagaggaaaatccaaagttgccatggtctctgtgatatattgtctgagattgttctttgtttttgtagctgttcactcctaagtcagacgttgaatctaacctcagtgctgtttctagtcactaaactctattacctcctgagatatatttcatggtttgggtgtcatagggctggtggtttgtggtctgagggcagccacacagcacccttggtgggcagagggcccaggtctaagggagactaggctctaatgacaggaagttgccagagtgcttcatctcaaccagatggctaccccaaacagcagtttggaaattgtccctgtaacattaacacatggcccagtcacgtgtgaatcctggcccattgcatgttgacaacttggctttagttggataacactgaccacaatatcttctcccctcccaccccctccagtgagacacttgaatggtaggaaacaatttctcttttttagcgttgggtaaacatgtgtaattagccttgtacttatctccattagtatcattagacttgaaaacccagtttaatctggattctgctctcttctcaatgtcagcctgtttctggaccagtacagagccagccttgttgatgcaataaagagattactccagcccagggtaagtatgtttctattttctcctgaacactggctacagaataattagtctgtgcacaaagatggagagagtaatggaatggcaggattaatgtcatgtaatactttaatacttattatgtccaacttcaattgggtcttctgatctattagattctttcctaatcataactaggaaacttcttacccttggccttctgataagaaacacagtgggtagtgaaataaatgcagccgcttcaaagatagtgtgaggttatttttatcaaagaatttcttgagtcttttcccttgataacaatatcttcatattaaagttgaagtatgatattgaaagttttctgttgacttctgtcattttcaattccttcaatggcaacctttctcattggttatttatttattgcaaaataatacttttttctttttatttctgtttatattaaagaaaaaggacttcagatgaatctgtatattaatagttctttgctttaaaaggaagtcattatttacatattataaacattaggtcacaatgaagccaagcatggcataaaatattgtgcacatttttacatttatatatccatttatgccggtgagtaaattacagagtttgtatccactcttattttgttggactgttaaactaagctaggaggtcctgcagcctaaacggagagttaatatacatctatttaaagtaagaaaatgagtttaaagctcatgcattaaaaaaaaaaaaaccttataactatgtaagactcttgctgtgccataggagtttaaaataggttaacagtattaatacagtcgaagataggaacgcatatttatctgagaacactgaagtgtgtgtgtgtttctaaagtatttttttaaaaaggtccactctagtcttctgactcagtgagacttacagaccaatacctttcaacctttcttttatatcttttttataaccttcagtggttcccagagcaatctgataatcatcctttgccatacactgttgctttttattttgctatctctatgtagctcagaaacttaaaacaggtgtcttggaggagtagccatagcttcgtaagtggtagtcagtccaattcaattggcctcctcagttcccctgtgaaatgggcaccagatcttgaggcaaggaaggggcatgttccaagctattgacggccactgcatggttgaataggccacccaagttgaggacagaagaaggaattttgggtttcagcatccccccacccctgtcggccttgggtgattcttgtgggcatttgcaagactaggattttcaggggcggctcaagattcttgaatatgaaggcctctatgaaaatgtatcatacataaatataatgctttcaaggactcctgaatctcacactgtacaaatagtacttcactcatcaccaataccccttcaaagcccatttgtggcaaatactccattttgcagcagatttgcatgatttacctaggatctattgtaaatcattcgcatgatttacaatagaaaagtgcccaagctatgaatagacctaaacgcagattagactggaatccagcagctcttctgtaccctctaataaaccctgaacacactccctccatctgaatcgtggccacacgcagcagccccctctgagcaaggacagtagtcctcctgctaacagctgatactcacccttagcctagagaagggtgaggcagggccctaggggaggtggcacttactcctgctatgagaggaacagggaggccaagtcagaggggctcacactaacctgtagcattagaatggcagtgggggggcctcacttaggcccctcttggaatggctgatactcaaggctgccaggtattctagcctaaagtgtaaggagcccaccatcagaggggaaatcccagttgtggatggcacatggacttactgaaattaccacccaggaacctcatccccatcaacaggtctggggtagtgggcagttgtcctccctgagcctccacccaaatggaccacagaaggaccatgtgggcttgccagtgaagagcccagtcccacatcctgtgttgatgggctaggaggctgtccagagcatgggagcaaccagtagaaaactggacttttcttcttagctctcagggctggctgtttggcttctggaggacctccccctctgagtatacagtccaagactaagaaaatggtcaaggttttatttcattacaattagagctggttttagtgtcctcttgagcccagacaacaactccatggttttgtggcccagaggctgaaggtgtcacaagaagcccacaaagatggccgggcacagtggctcacacttgtaatcccagcactttgggaggccgaggcgggcggatcacaaggtcaggagatcgagaccatcctggctaatatggtgaaaccccgtctctactgaaaatacaaaaaaattagccaggcgtggtggcgggcgcctgtagtcccagctactcgggaggctgaggcaggagaatggcgtgaaccctggaggcggagcttgcagtgagccgagatcacgtcactgcattctggcctgggcgacagagcaagactctgtctcaaaaaaaaaaaaaaagaaaaagaaaaagaagcccacaaagaaacaacacaggggctacatggtggatcctgagttcttgatgattcagtgcaagatacagcaagttctccgtgcacttccagcaaatgcaaacactgcacttccagcaaatgcttcaagttcatagtgtggccccagtttctgaaggtctagtgtagtgggtggaaagagtcagaaaaatctgcatacaaaccccaagtctacattaactaccttgtctctctgagcctgcatttcctcacgtgtcaaaaggcaaggctagtgcccaccttgtggattggtgtgaaatatttacatatgtataaatccttgatctgtgcctggcttacaggaggtgctccttaaggggagctgcttctcttttattgctgtagaacttatcaaggttaatccacatgagatgtttatccagggggatgctggcttggctgatgggatgcctgagttccaggcctagtgtggccctaacaggctctggaaccgcctcttgctccattatccccaaagagggaaaatgagggagttcacctgtgctctcatagagttctatcagctctgaaatcctgcattctcctcgcagagagaaggtatacatgggctgtggaggcagaaagcttaggcccaaatctggtctctgccactgactgaattaatgtctggaagcctcagtttctcatctgtaaaatggggagtgaaaaagctgatgcactgtaatgcacatgattggctctgagtatctattcaaggctagctctggttactttggtaaatacagactatgggggctttttttttttttttgagatggagtctcgctctgtcacccaggctggagtgcagtggtgcaatctcagcttattgcaacttccgcctcccaggttcaagcaattctcctgcctgggcctcctgagtagctgggattacagacacgcaccaccatgctagctaatttttctatttttggtagagatggggtttcacctatgttgatcaggctggtctcgaactcctgacctcgtgatccacccctgccccgaccccttggcctaccaaagtgctgggattacaggcatgagccaccacgctcggccttatgggggcctttttccaagcattttcctggagaaatgctggtgggaggggaagacatgattttcttgacctggactttgagaatttctgcacataattggcacactgcatctcccctgcacatgtatcctgaacacctgtagcaggccctgtactggttctgggaggattgcctacctggatgaagatgacactttactatagacggtccccacggagtgggggagagtactctacattggcaagacagaagtaactgcaaaatgaaggttcaagtgtcaagctgtgggaacaaatgaattctgccatctaggggagtatggttgatttctaccttgagcaaatcagttgtctggagtcagagggtccagaagcaaagaaagtagatggagagggggagtttccctgcctttcattttctatactggagctatgaatgaagagaggtccccagagagaccttagccaccagggtgggctccttgcttggcccaggggtgatgtcagatcccaggctgagcttagattctcaaccaaacaggcacctgtgcctgaaaagtctttacaggaggccccaaattttagcagggaatatttgttaccacctgaaatgcaggctttcctcaacctgctagtctaaagaaactgtaaagatagttaactcctgtcataacactacaagggactctccagcaaacttaatagatgaaaacaatagaataggcatgaaaaaggaatgaaatcagcacattttacgcattccaagaagcaatgtccccctcaaccccccactcacttttccctctggtgagtggcttgttgttgctgatgattgatagggtgactcactgtcattgtattccttaaaagtccatgacaacagcagtgtccagtatcagaggacccaaacgtaatttaaaatataggcgcagcagcctgcaagttgaactttcgtccagaaatgacaaccaacaaatggtatctactaatattcctctgaaatgactttgggtacagggaggggagccaagccaaccagacagcatgagtttactcaggaccagaggatagaatattgacagtaatccagcttgttaccactgctaaccaactgtcaagaattcagaaatatcactgtggaattcacttaaccttcttcagaaattggccctacccgatcaccagattcccagagtcctgcctatctccaaggtgtgctataaatgtaaatcataaactctcatattataaaagcaattttttgggggggaggacagggtctcacttggtcaccaggctagagtacagtggcaccatcactgctcactgaagccacaaactcctggactcaggtgatcctcctgcctcagcctctcaaatagctaggactacaggcatgcaccaccatgcctggctaatttttgtatttttagagatgggcttttgccatgttgcccaggctggtcttgaactcctgggctcaagcaatcctcctccttggcctcccaaagtgctgggatgacaggcatgagccactatgcccagccaagttctttttgctcagatactttctcatctttttttttaaaaaaagtctaacatctctgcccacttctgtacaaacctttttgtttgcttgtttcagggaaattgccttgtgtatgtgggatcagtaccgtgaactgaaatggtgctgagacacttgggttcttatctgcttactgagtcagagacccagcgactcctcaccagtgcttggtgagaagttagctcctacagttgtaggattccccttgacacaagggttgtagcttatagagagtcctcagatggttttaagaccctcagtgcaggggcccagccctgagaagtccttttctaatatctacccagatgctgttcagcacatacagtaatgtgtgcttagcagagaataccaagacatgaggtagaatctctgcccccaaagacgttgcagtctggttgtggagatataacatacacacaggtagaactatagcagacaatgtaaaatacagcccagtgctatttttatttgttttgtgaatctttcgaatttacgccttagtattggactctgtcctgattcaacaaacatttgttgagcaactgctatctgcttggcactgacgccattcctatgcgctgaggaatgtgggctaggagaatgaatatgcactaggagcactgtgggaatctcatagtttagcaggacagatgaacacatgaactcccaggaattacagtgcaatatggtgggtgccaggaaagaggtaccaggagaaagcaccaagagtgactgcctgaggaaggtttccctagaggcagtggtgtctgactttggtcttaaatagtaagaagggcactttgagtgtgtggagtaagaaaaatcatggtgtgttttgggatcaacaagaagtttgctctggctggagtgtgagagtgtctgtggttttgaggttagggttggggaagggcaggaagatgaagttaaagagttatgaatggccatcgagaccatcctggctaacacagtgaaaccccgtctctactaaaaaatacaaaaaattagccgggcattatggcgggtgcctgtagtctcagctactcaggaggctgaggcaggagaatggtgtgaacccgggaggtggagcttgcagtgagcggagattgcaccactgcactccagactgggcaacagagcgagattccatctcaaaaaaaaaaaaaaaaaaagagttaggaatggccaagaacattgtgatgaagagaccaggctctactgtatgggtaacggagagccattgaaagtttttgagcagtggtgtggtcaggtgtaccttctagaaagatcactctgcccatagcataaagggtagattggagtaagggagagcttgaaagcaatgaagctcctcagaggtccagtgtggaccaatatccacctggaatcatccatttaggagctagtgaagacctgaaaatggagaagaggacaatgaatggatattcactgagcgttccactcagcaaacatttattgagtgcctctcagatgccagtcactgtgccaggccccggggatagagttagatatgacctaactctacactggaggggcttacagtctagagacaagcaagggacgatcacctggtggtgtgtgattggcacagcagaggtgtgggcaacccttgggggcagggagtggaggtggccaactggggaggaggcacagtagggaggccagagaagtcagcaaaggcgtcacaagggcagggagtctaacctgggtgctgagggatgagtaagagtaaccaggcagacagagaactggaggtgagagaggcattccactcaaggggagcatgtgcatgtttgaacacacaggatacataaaagaacagatgggggatgtgatgaggttggcctgactagagcccaagatgtgtatgagggagtggcaggagaccaggctgcgataaaggcatggggccggtcacgtggggctttgcctgccataccaagaaggtgggacctaagtcaaggttttcaaaccctgtttaaatggcagaatgttttggtcaaaattttttagccagcaccccaattacaaaacagataaaaatgatgcagctttagttaaactaaatgtgagactggtacttcctctgtcttggtcttcctcttatccctccaggccacccctgaagcaattcagaacacagtttgagaaccacctgcagtaagtgacagtgatgcaggtagggggatgtggcactgagaggtcttgaagggcaatgccatgtttcccaagtttccagctttatttcgaaagtgacagatacggaagtgcttggtacctaagaggtactcagcttgcatatctgagtgtatgcgtgtgtgtgtgctgcatttgatggatccttccctgggaagggtaggggttagcagtcaagaatattgagttttattttggacaaaatggattaaaggtattttcagaatacccacatgcagagatgtagtaggcacttgaaaatgtaggtgtgagccctgggcaatggtgaaagctatagttatagacttgggagttattggtctataagtgatagctgaagccatggacatcagtacaattgccaagaattagatggaacgtgatgaaaaagtaggcagagccctgaggaccactgacaattaaaagacaggtcagagaagagaagctacaaaaggagacagagagactgagagagatgccaggagaggaagcaagtgaaagctgcatttcagaaaccaggtaaagaaaataggctggacacagtggctcacatctgtaatcccaacactttgggagaccaaggtgggagaatcgcttgaggccaagagttcaagagcagcctgggcagcataacaagacctcgtctttataaatgacaacaaagaaatagaaaatcagcataagcttaaacatagaattggtatttaatagtttggttgctaggaagtgaaaaaggaacaaactaaatgtgagactagtgcttcctctgtcttggtcttcctcccctaatgcattttattggcatagcatattccttttaaaataaatctgaagctggggggagtggggagggatagcattaggagatatacctaatgttaaatgacaagttaatgggtgcagcacaccaacatggcacatgtatacatatgtaacaaacctgcacgttgtgccacatgtactctaaaacttaaagtataataaaaaataaaataaaaataaatctgaagcataccaattttttccagaagtacactccctttaatgtgtaagtatagattagtctagcaaaataacaacaactgagctcacaaggtaagcagtatctctgtggtttagtggaacttctccctctcctctccaggaataaatgaattctcttaaatttctgctcatcagtcaaagtgttacattcaattgagtattcattctgcgtttaaaataattctgcaacggaatgcttagaaagttgtgctttggcaaattgaaaataatttttctaaagtgatgggctaatttgaaatccatattccttttctggttttgatttgtgcagctgaaatcgtaaagcatatccctctgatggtactgttccccctgtgacgtgttctctcccctggggatactggggtctaaacccattcattatggggagggggagatgctggcactcagtagggctcagtgaatgaatggatgatgggctcttttccatcctaactattaatccacctctcaaaggtgtctgtattcaatgaactgaaaaagaaaacaaaactcctaagtagttagagattaaaactactgcccagtctttctctttctcgtgggtacagtgttgtgcacagaatgctgctctctaaaaccccatcatagcagctgactctgtaaaagcttctcgggaaaatcttttcaaaggaataagcaatagaacgtggcttttgaattcccaaagactcaaattctttagattactcaacttctggatttagtttattgtctcatcaaatattgactgagtgcttactatgtgctaggcactgagaaaacgtagtgaataaaacattagaagatcctgttgtcacggagtatgcattccagccagagaagacagggcaataacaaacaaggatacaatgtgtgtccctggtggtaagtgctaagaacaaaaataagcccggcgagggactggagagtgatggggcaggggctgcgttctgaacagggtggctagggaaggacaggtaaactgagagctgaaggaggaaagggatgtttaggcagagagtgctgtcacatgcttagctgctgtcacttacagcttaccccaaccagggcatgtggagatgcattgctttgtcaatgcaaggatcagcccaacctagaaacctgtagccttgtgaacatgatgatatgcagcttagataatagctgttaaaaaccgactcttcaagtgttactgtgagacaattttttgcaggtgacttttaaataaaacagcttccattattcaaaaatccagaatggcaaccagctcttagaaatgactaaaatgacctaccagcattccctgttgtttttttttttctaatggagacttttgctgtcctgccgagaccatgtattatatctagtttcacataaaaatgaatttttgctgctaagtttgaaaactgcctgaaaatagcaattaatattgaaaaagctgacagaaccttaagtgtagtggcatgattggtgctgctataattatgtgcctgagtgtgtacaggctgatgtaaacacagtatgaaaacacacttgatgctcaggacagtgtagccacgtattttcttacgggtaagtgagggcgaaggggagagggagagagaattgatagcatttttagagcactgttaggtggtgtagatctttctaatcttacatcagtataatctttctaattattttcacattctgtatttgatcctcacaatttgtcggggggaaaaaggcagggcaggctttgttcttcccatttaatggatgagaaaactcagtggatcagcgaggatgggttaaggttcttatcgacaaaatggagagattggactacattatttccaagcttccctctaactcaaaagttctatgattattttctgattgtcctgaggtgacaccgctgtttaatggtggagactccccttaagtccagtcctttctgccacagttcctccttatattcttcaaatccttcactgtatgtttaatcatctgtaaaatgcaatgtctactgtacaggttgttgagaagatcgctgaggggattaaaggaggatttgtgaagcacctagcacagtggtagctatcattatcattgtcatcactgttactaataaggagacatgtagtgtagtggagagagcatcagtgctggggcttctgatcattcactgacagagttgataatacctacaacatagggtggtttaaagactaaaggagggttgggcacggtggctcatgcctgtaatcccagcactttgggaggccaaggtgggaggaccacctgaggtcaggagtttgagaccaacctggtcaacatggcgaaaccccatctcgactaaaaatacaaaaaaaaaattagccaggcgtggtggactgtgcctgtaattccagctactcaggaggctgaggcaagagaattgcttgaacccaggaggcagaggttccagtgaaccgagattgcaccactgcactccagcctgggtgacagagtgggactctgtctcaaaaaaaaaatgtctaaaggagatgatgtttatatgaatgcctagcccagtgtctgactacactatacctacaacatagagtggcttaaagactaaaggagaggatattcatatgaatgcctagcacagtgtctgactaccaggtgctcaagaaatggctggctggtgtgaatgataaaccactcttcataagaaactcagatatattttcatgattccctcaaaacctaaagaggcatttcacagaggtgaagtgtaaccttgagagtaacagaagcatatagccatctttatttttttttttaaaaaaaaaaaaggagattctgaagtttggccattctgtacacatctgagagggaggaaaaatccgcatgcatccaatagttagcaaatggtcattgtgaagtttcatgtcagatggtcttctgaaatccagtacatactttattcagttcctcccattctccccactgcaacaatcacataagattgtgtggattatttagaaaaggctgtttaccctcattataccactttctttgaaaagcaatcatgtgaatactatgaggaactgcttggctatagtgatgaccatcatgagggattcaataaagttggaaaccaagatcctggagcctgtatctgacagcgtggtcacagaaaaggctagggcaggactgaaatatgaaaactctccaagaggaattgtggttacttgtctctatgaaggatttcttggtactgaattttcagggtgcaaaaaactaacagatgtaagcatctgttgtcacatgccccaggactgtgttggggaagcgttggcaggtgctaaggagtcacaaggtgaatggcactgccctggaccagttactctaaaatctagtcaatggcttaacccactggacctgagacaatgcatattgttcggaacaccggctttcaaccacattttgttttttataagtattatttgaaaaagataaaacacagcaactggccatttggatgtgaaatcgattcttatatgatatacatctctcctggaaattattctcactgtgaatgtccatcctgcatagacatctcaagaacaattgagtttttctacttgagagcagtacattaaatgctttgaccaatgtctgttatgtttggttaccttccagttttaaaatatgtgaatttcctttttactgttctaggggaaagcgatggtatttgccccacgccgagggaatactttaaaccagttttgcaatctagctgaaaaagctggtttctgtatccaaagacatgaaaattatgatgaacacatttcaaacttccactccaaggttagttttctgcttgtgttagataacactttaatccgcattgcattttgaagagatcatggtctttttggcaggtaacctaaatatttgattaaagtactccttagatgtgttgcttctgaacagctatttgtatctgattattttgtgtggtaaagccatcttttatctttgcatgtctagaaggattttacagaaaccattcctgtttactcttttctctgaaacaaactaatcttttcattcataatagactaatttgtaggatgtaaggggaggtggcatagaatgaataacatgcatttatattttaatgaaaaaccttcagcttttaagtaggttaaatgcttagccgcactgaaataaatagaaggtgaatgtctaattgtatcatgttggactgtaaatctttatctctgcttgctttatagctgggtcagttggcagtttgagactgttaaatctcatacagaatttcacagttgtggggttatatgtcagatggaggcactacaagatttaggtcaaaagcacttatctgagagtgatttctaagcctgcttacataaagcaatgttatcagcctttttattatttataggtatagaccaatataggacactgagaggcgagtgtttcactgaaaactttttaggattctcacgtttgctagtagtacatgtcacagtgactagtataacatgtattatttcagtaattttgtgccttacggaaatctcccttcactgagctagtctgaccttggcaagagactttaacttgtcatgatttcacaagttgtaactgcagaaaaataaaggcccgagcttaattttctcctgggacaatgtgaacagcatcctttattacccaggactgtaatataatgtagaagtgtgttggcttttggaaaaatatatgaaaaattaatctgatcttccaagcaagagaaagaaattctcactttctgaaaatgaatttatttatttgaatctttaaggttccatttagcctctgggggaaaaatggtgctttgtgaactgaaagagttacattacatcctctcactggtggagtcaggcccattgctcatgatcagaaaataaaaacaggatggtatgtgattcagatcttaccagcctctctagaatgatgttttccccttttcaatccctccccctaaaaaaaagcgggtctttacctggtaggaaaagggtccctcctggctccctggactcctccacccaaaggaataatgtggctttctctccagggtcgggctggaactacaaggatcagctgacagctgcttcaatgtcgtgccattcactttccccctagaacaacaaatgcttttagtttcccagtgacagctcaggagagcaaaggcttgggtttctccaccagcaaagacgttcagcattgtgcctgataccctccgtctcctccctgaaagacctgaggagcgttgggacatgccaggcacgcccacctctcctctgtctggaactttagagtgttagcgcctggtggccagcacacctcctctttttatttccaacgttgtacactaccctgctaagtgaagcacataaataagtggctttattttttctctggtcataattgctgaaaagtcaaattcacagtttgctgacattggtacattggactaagaaatagttgtcttcgtggttgggggtggggagagtgtagaaccctaggagaatattctgcagagttggcacatcctggataaaaggtataaacgggcgcccatgatatatatatatatatatattttttttttttttttaataatgagagctatttcagctggtgtggggttctgcttctagcaaaagaatgcctctggtccctcctgtacctgccccagcagcggggatactgtgtgctgaccgggctggcacgtgcagttgtgctcctttgcaggagaaggagctcgcccagaggccggagcagtgagccgggggccacgctggagggagcgggcagcgccgctgctcctcgcccatccccatgccctgcagcagggcgcgaaggcggaggcccaaggcagcacccctgcccctccagccctgcccgcccgcccggggctccgggacgcggccgccgggagcctccaccctggcggcttttgttggccgcgtgctaatagccagggcttaaaagttttccatcttgagcggcaatcagctttcttcctctccatctctggccaaagccccctcgtccctgggacgcgctgctccccaatggaggagcggcgttttccttcaggctgcgtgttatcctcttagccctactgtgttggaatagagcgtaaccagctggaggactgtaagacgcctgataatgccgctcttttccgctgtcccgtcttaatcttgttacacaaatggtcgtgaagagattcatgaattttaattttgccctctgcattagtgcctcgcgtcactcatacacagctgccttcgaagccgagtttttcacccctcctcttacaacaggggaaaaaattagttacttggcagtagtgcaaggtaaaaaaaaaaaaaaaatctacagatttaggcaaccacccatgaagctgattaacagtcagtgatcaggaggaacagctttgcctcttaaacttttcacctctcattgttaactgtgaaattttatttccgttaaaaagcaagcctgtaatcaaaacggtgccattccgcacttttctgccagtgcttttgttaaactgtgcccacaccatgcagccagtgtgctcaggaaccaggcagccaaaggtgtagcatgttttaaaaatattgcttttcagtccatccttgcaaggggagaaaaataaaacacttccctctcctccccagccttttggtctcctcaaggctgagaatcaaattcattgccctcatagtgtggttcaaaacctttcggatagtaagatagcaaatcgttttgtaaggtagagatgtgacttcgagattacagctggcttgatgctagttggtaaaaatactctcattcatgcaaatgttctttgaaatataattttacatgccgtgggttttttttttataaactttcgcaaaaccaccctgaagtgtttatttttctgtatttttgtacatagctctgaaaataggcttgggctgggctgtgaagtcagtacattgtgttaaaaacacggccatattgcacttctgcttatctattcaaaatgccacattacaagtggctggtgcttataatctgtgtggtgtgctgttgataattgtggatactgtaaagggtaaacagtctgaactccactcctgctgctgctgttcacgccgtagtaaggctgagcgtgttacatccaattatgaagtaaagcataatgctactaatagcagctatataatttagtttagtcctcaaagaccctgttttaacctctgaaattggaaaattattttattcatgatttgctttttcttcattttctttcaaggtgccttttgatatttgtcaaaattgtaattattaattgggcaaggaagtacagcctgggtaaatggaattattcttaaaactcataacattcccccatcgaagcaagtattggctaagagctttgtgtgtgttcaagtaccctcacataacagacttgcttgattcagaaatgatccagggctgggttatagtgttgcctttgagggttgtcagctcttccccattgtggaaaggtctcacaggcaagacggggctggcccctggcccctttcagcaacgaagcctccactttggcctccagaggtcagcatagaatccaagttaaaagtgatttctaacccatatttacagaagaattatttatcccacatattacctcagggactttataaagagctcatttgagtctctgtatattagtgcattgtgagtgagtaggtcagctgactgccactgagtaatcaactttcccttatccccaatccccaaggaaagaattgagctagcttggtcctctcttccctctgtaaaatacttcagtgagctccctctatcactagggcaactggcaacaaaagtatttacagtggtaagtcccggtcagtgggtatggactgggaagttggtgaagccattttctcagcattttctaaaattagactaaatagtaaggttggaggacctgtgtttaggcttaacactctcgctactttggtagcagcaaaaatccacaaggatcttcctaaatagacaacaaatcatctgtacacagaacaaactctgtctaagaaaacagaatgaagtcacctcagtgactgtaccaccatcagttcttgggaaagtagattggaaagtggattagaaattaaaggctgaattagctttatgttccccagcggaaaaggggaagtgggctcatgactcctgtccttaatagtgacagcatgtccatgtcatggtttgggaatatgatttagaaggaacatgcacttcgaaaagattcaagttaacatgccccagagggaccaacctgggagagtgtgatgttgaggccattcattttgctttagggtgggtggagtgggtggtgtttgactaatttaaacaataaaggaattgactccctgtataatttaaagaaatatttatttttttattcttataatctaaaaagaaattaacaattggctcataaattccaacttcaaaaatattaattttgtctttataaatagcaaatttttatttgctagaataaatataaatataactttaaaactattccagctgaatgaagaaaaagtgtacttcatatgtgagaaacctaactggattttaaaatcttatcacagaaatatcctcagaacttccctgcacagtatgaacaggaatgttgctagtctaattgttggagtatgttctcctcctcagagaaaagaatttttgagtgacttattattaatgttaaaacccctaagaagcacctggagagcctttgcagtgtcttgggccccacaagcctttccctgtgcccagatgttgccacggactccaagcagtgatctgaaatgcccgcctgcctgaatagtgtggcattggtcagaggcagagggtacagagagcagaaacttctatgtcaaatgcccagtcaggtgatgatgaatgagccccagctctgccttctgtcaagtgcctcacagtttatagaggtcaaagtgcagtttgggtatttatgaaaaaaaccctacccacccccaccaaaaacaatccccatgttaatgtatagaattgtcacattagtgccactgagaactactttgagttgcttttctgtgatttatttttccagaactatatattttggtgtaaaagtcatcatgatactcaacattaatattgactggtaaagatccctaattggagtccccttacctttttctttctattattgttttcagttgaaaaaggaaaacccggacatatatgaagaaaaccttcattacccgcttctgcttattttgaccaaacatggatagaagattaagcttctcaaagacgaagaaacgtatcaagtgcatagggaatatttttacaaaaacggaaatctgtaaggggtataatcgcctgcctgcgccctttgcagcatttcacgtgtgggctatggactccacctgtcctcacccacgttattccccagctgccctctccagctccctccccgcctctttttacactctgcttgttgctcgtcctgccctaaacctttgtttgtctttaaatgtgtataagctgcctgtctgtgacttgaatttgactggtgaacaaactaaatatttttccctgtaattgagacagaatttcttttgatgatacccatccctccttcattttttttttttttttggtctttgttctgttttggtggtggtagtttttaatcagtaaacccagcaaatatcatgattctttcctggttagaaaaataaataaagtgtatctttttatctccctccaat

SEQ ID NO: 859 - DNA, 45367 bp, Homo sapiens
caagaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggaagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtacatgcccagagatcatttagggtgggtgccaggatgagattggtttatggttcttttgttcttcagaaccaaattatgcctgggttgttcagtaagcacattccattatgactggtcatgccaagttgctccttgtttatgatattcttagaaaatcactcagcagaacccagcagttattttactagctgaagggctatttgctgaaggcctttgagccaaacgagttgtttaatttattgcccactaagtacatacagttgttcagtcatcaattctaacttcttagagcagccttccttctaaaatctatgtcctgtttctggggactttatagttgaatatgtcagggtggcagttgggaattgctttcccagtatacgaagcagctagtttggctgtgtggctgggagtgtattagtgaataaagcataaataatatttttttaaaaatcaagtgatatctgtaaaaagtataggctgagtcttaaagtttaaattctaaaaaaggaagggaagtagaaaaggggtagcagtatgcattcgtcattacttgaattaaggattgtttaaaaccatgtccgtattagtataaaacaagtaaagaattaaccaggggtagtggcgcatgactgtagttgcagctacttgggaggctgaggtgggaggatcgcttgagcccaggagctctcagccagccagcttaggcaacatagggagaccccgtctccaaaaagaaaaaaaaaaaagtgaaaaattattttttaaaagctaagttaatttcttggtgggttatgtgtaaaacatccttacaatatattgctcaaaccagaacatacttcagagtaaaattatgccagatggcaggcatacactgggaacttctgagcaaattggttggtatggtcactctacttcaaggcaacaataggaaacaaataaggaaactaacaaactaatgttttacaatgataattggtttgaagaaaacaaaacaggatgatatgaatgtggaaagtaggaatgggcttaatgtatctttaaaatgctacaaatgaattcttgaaacctgcagctttctttaatcactagtagaaggcttttctttttcacgctcctatcattctctctcttctttttttttttttttttttttgtgatggagtttcactcttgttgcccaggctggagtgcaatggcataatctcagctcactgcaacctccgtcacctgggttcaagcaattctctcggctcagcgttccgagtagcagggattacaggcatgcaccatcatgcctggctaattttgtatttttaatagagacgagggttctccatgttggtcaggctagtctcgaactcctgacctcaggtgatttgcccccccttggcctcccaaaactctgggattacaggcatgagccaccgcatccggctgtatcattctcgttttaaaaatcatcctgcattgtcactcattgaagaagagtgtatctgtccttcatggtgcagctcaaacccattgccttcattactctttctttagcctccctaatcagaccatgggctccccaccccagatcttcggctttggatgtgtttctagcatcctttaatcctgccttgagtgactccctttcccctgactcatgacctatgacctgctgccttttgcacattgagtgcttaggaaaagcaatgctctgactgcatagacctaaagccctaaatccagagatatgtttaccacttcctggccctgccttcttaataatctccttctggataggtccaacattcctgtaaacatggtggtttctaatcagctctgatgtttgtcatttccaatacctgttcttggaggaatgttttacttcctgcaatccataggcatttgtctttgaggttgaagggatttcattgttgttattatgaagatcccattccagctttgagtctggttttggtgattgccctctctccttctaaaatgtggggtgggatcccttgtttactttctccagccactttgttttcatcctcatgttcctttgtgcctcatcataagatatattttgttgctgtgctggcttagatcaaaaccctcttgctgcctgttgataccgtgtgagatcttgcagctacccatatgggggaactggggtacagagacagaaataagcagcctgtcaggccaggcgtggtggctcacgcctgtaatcccagcactttgggaggccgaggcaggtggatcacgaggtcaggagattgagaccatcctggctaacacggtgaaaccccgtctctactaaaaaaatacaaaaaaaatcagctgggcgtggtggcgggtgcctgtattcccagctatttgggtggctgaggcaggagaatggcgtgaacccaggaggcggaggttgcagtgagctaagatcgcaccactgcactccagcctgggcgacagagcgagactccatctcaaaaataaataaataaataaataaataaaataaaataaaataaataagcagtgtgttataggggaaaagcccagatcccaggtgtcgaatgactctgtgctttggaattagtgaccttcagcctgcggtgtggcctctgacagtctaattctaggaagtcacatcaggattacacagaaagttactggagattgaattctagactcaagttgctgaatatgcatttgggactctgaactagaaggagaaaacacattatctgctcattatcctacaaagttctaaatacaaagtttcatttccacatgtcttctcagccaagcctagaattctcttctgtataaattcctgggttcctatataagtgaacaagggaaatagtccaaatttagcaagttcaaaggcagtctgagagtggaaacaaagactcctcaaatattggcacaaacttaccttctgtgttgaggttgcactccttctcagaccccgtgcactgacaacatttatcacctttttaaattaattgatgcatttacttatttatttatatttattatttttttttttttgagatggagtctcactctgtcacctaggctggagtgcagtggcacaatctcacctcactacaacctccgcctcccaggttcaagcaattctcctgcctcagcctcccgagtagctgggattacaggaatgcaccatcgtccccagctaatttttgtattttttagtagaaatggggtttcaccatgttggccaggctggtcttgacctcctgacctcaagtgatccacctgtctcagcctccctaagtgttgggattacaggcgtaagccactgtgtcctgccttctcacccttttttagacatgccctgtctattcttgctccctcctttcctttgctgtgcctggaagcccttcactctgatcccctttgcccacaccatcctggaccttctctgtccttaccctcaggggtcatcagcttcctctgcccctgggggtcaagggccaatgccctgatgcccttaaagcactttctgcagctcttccttagctcttcagtctgatcatcatcccacccctgcctgcagacacttccgagaccaacaccgcccaaaagaaatacaatgggagccacataagaaattgtaaattttgtagtagccacattaaaaaaaggaaaaaagaagcaggtgaaattaattttcatatgttctgtttaatccaatgtatcatttcaacacataatcagtataaaaatatatacatattgttatttttttttgtattttaagacggggttttatcatgttacccagactggtctcgaacacctgagcccaaacaatctgcccaccatggcctcccaaagtgctgggattacaggcacgtgccaccatgcccggcccagtataaaaatattaatgagatttttacattctttctttttgtacagggtcttcaaaatccaatacatgttgttcccttacagcacatctcaattccaaccagccaccctgcaagtgctcagtagccacatgtggctcttagacagaacagtgcagtgtagaccacatgaccgacaggggccatgcgttactctgctctgttccttgacacttagcccagcagctggcatagattagctgctcaaaaaccatgtgtagaataaatgaacaataccacagtcttggttttaaatataaaatatgagtaagtcacagagattttttttaatgctatgttaaatgtcatcgattactgatagatgactaatttgattttctctttcttttttttttgagaaagggtcttgctctgtcgcccaggctagagtacagtggtgtgatcttgagtcattgtagcctccgattcccaggttcaagagattctcctgcctcagcctcccaggtagctgggatcataggcatgtggtactgtacccagctaatttttgtatttttaatagagacggggttttgtcatgttggccaggatggtctcgagctcttgaccttaggtatcctcccaccttggcctcccaaagtgctgggattacaggcgtgaaccactacacccgacctaatttgatattttttgtagagctagatcttcctatttgaattatactcaaattcaacaaaattctaagtatttttgccttcatgtaaatatttctatcttaggcatatttgttatattttttgtcctttaactaaaacaaagtagggtttattcatgactttgacttttttcttcaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtaagttgaatggaaagtgggcaagatggggatgaggtttgagagaagcactttttcaaatgtttacttaaagcatttcttctccttaactgtcatatactatttctttccctccctccctcccttccttctttctttccttcccgctttctctttcttcctttccttcccttcccttctgtttccttttttcctttctcctttcctttttccttccctatctcctttcttcccctcccctcccctcccctctcctttccctgcttttttttttttttttccaggcagggtcttgctctgtctcccaggctggagtgcagtggtgcaatcatggctcacttcagcctccacctcctgggctcaagcaatcctcctaccttagcctcccagtgtattggggttacaggcgttagccattactgtgcctggcctgtcatatgttattctaatacaatctttccctagcatttgaaatgtcttttactcattaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactgggtaagtatcaacctgtctgacttacaaaggggtaaaaggcagatatgtagtgattgaactgatttagtaaaacccttttgagggaaaaatgaatgaatatagtttatcggaagggggcaagtttctgaaagaaatagaaataaggtttccagttgttatttactcaggcttccaattattatttagatttctgatttcatcatagagatgatgtgttctagcaaattcaaacctattttctctccttccacccttccttcacttcctacccggtccaacttggattccatgtcccattagtttgataaccatttttctactatccatacccctttgcatttttttttcttgagatgtagttttgctcttgtctcccaggctggagtgcaatagcacaatctcagctcactgcaaactccacctgggttcaagcaattctcttgcctcagccttaccagtagctatgattacaggcgcgcgtcatcatactcggctaatttttgtatttttagtagaggtagggtttcaccatgttggccactctggtcttgaactcctgacctcaggtgatccacctgcctcggcctcccaaagcgctgggattacaggtgtaagccaccgctcctggccccctttgcctttctgactttttgtctcctctgtctgacaaaaccctagccatgaatgaacccaattatctattttctttttgcctaaaccttagtagttgagtctctggagacatcacaccttcattgtccccacctgaactgagccatccactcttcttgggaattttgctaatttcaaccgatcaactttccctccctccctcatttcaaacatcgtatctgcctctaccccatcttatcactctcagcagcaaactcgacttcacagagaaaacagaagccatcaagcctgcctgccccattcccaccctcttcctactcactccttttacaacagaagccagatccctcctttctggggtgaccagatttagcaaataaaaattcagaatgcccagttaaatctgaattttggacaagcagtgcataaaaaattttttagtgtggaccatactttcttttttatttttatttttcagagacagggtcttgctctttctcccaggctggagtgcagtggcttgatcatggcttactgcagtggcttgatcatggctcaccgcagtctttgcctcctgggctcaagcaatcctcccagctattcctcccaagtagctgggaccacaaatgtgtgccaccatgcccagctaatattttatttttttgtaaagacagggcctcactctgttgtccaggctggtcttgaactcctgggctcaagtgatcctcccgcttcggccttgcaaagtgctgggattacaggtgtaagccactgtgcccggccacatgagtaatacttatactcaacaatatgcgtgttgatctgaattcagatgtaactgggcatcctgcacttcatctggcagttctgcttctgtctcaggccagagcttccccttgcccgggtttgtgttctctcctgcctttattctggatcatccctccctcctccagtccctccttctctcttctggaccttctccataaatatttaaacatcaacttttaggtgatccaaggacactcagaattgatatatttgcaggtcaactttgtgatgtgtgattttctccctataaccttccgtctcccaggttcagtgaatggtactaccatgcagcctgaggaacaggctgtcagcaagtcctggcagtttcacctctttttttcctccagttcactgacttgttaaaattgcaatgacattagcaaacatttacaaaatacttactctgtgccaggctctgtgctaagtgttttatattcattaatttagttaatccactctataatcctatgagtctggtgtaattcctgttttgcagataggcagactgaggttactcagctaataaatgacagggctaaagatgggatctagtcatttcagctccatagtctgcttttaaaaattgctgccatactcaaactatatcatttcttgcttatagaatgatcacagctgccttgtgatccagtttttccattgcttttttagttctccactatagtcaaggttgcattttctaatgtaatagttaatatgttcaaaaatatgtatatgtatatgatggataaacaccttgtagtatatcatatatataaccatatattgcaagacttcgactctaaaaaaattattttttagtttcctctattttgaactttatgaaaagtgtcatgctaggtatagtcttcttaactaactttttcatgatttattcatgtaacttcaggtagctatggttcatacattttcattgttgtatatttcacagtgtgaacaatccatggtttacttatccactcttcagttgatgggaagttgggctacttccgttttttttattatgaacaatgttactataaacactgtcattaatctatcttggggtacatgtgcaagggcttcttttttttatttttgagatggtcttgctctgtcgcccaggctggactgcagtggcgtgatcttggctcactgcaacctctgcctcctcagttcaagcgattctcctgcctcagcctctcaagtagctggaactacaggcacccatcaccatgcccacctaatttttgtatctttagtagagacagggtttcaccatattggccaggctggtcttgaactcctgaccttgtgatctgcccacgtcggcttcccagagtgctaggattacaggcgtgagccaccacgcccaaccaagggcttcttttaggtaaataactaggagtaaaattgctgtgcaggatatcgcatgctcagctctacaggatagtgtcaaattcattatcaaaatggttgtaccaatttatatcccccacagaagtataaaaaatacacattctcattaattcctgatattgcccaactttgtaatttttatttaaaaattattattattttgtgtcagggtctcattctgtcacccaggctgaagcatagtggctcaatcatagcttactgcagtctcgagctcctaggctcaagcaatcctcgccacctcagcctccttagtagctgggaccacaggcacacaccatcatgtgtggctgagtttttttatttttttgtaaatatgggctctcactatgttgcccaagctggtcttgaacttctggcctcaagcagtcctcccgcttcagctctcaaagtgctgtgattactggcatgagctaccatgcccagcccagacttaaaacaatattgccttgagatcttaattttatatttatttaattactaatgatgatgtgtctaattcctaatacagtaattatctaattcctaatgatgttgaacatcttttcttacatttattcatttaagtgtccatttctgtgaaacacctctttatggtttctttcccctactttcttttgaattatttatccctttgaaattgctttcttcagttccttttgtattctggatactgattttttattgtttatgtacactaaaaatctcttgccctggttgtgtccaggtgggctgtgtgttgaattggaaagggtgcatgtccttgaaaggcagcagctactactcagcatctgcctgtgttgccatggacatgtggactcagtgtaactacgtcttccaactcaaaaagatttatgtaaaatctcccagttgttaaatgttttccagatgttctctttaacatgaaatggacaaaaggcctaggacagagccccatgaaactctcacattcaagggcccacagcgttgacttaaggagtggccagagatgtgggagggcagccgggagagtcataccatggggccataaatgtgagcatttccagacagaggagaccagcgacatcgtcaactattgctgagtaccaacacttgaagttgctttttattcttggagactggtagagattttaagtgaaggattctaataattttctggggatataatttaaatattcagtctatctgggctcaagctccaagatgagcggaatgtttctttcttccaaattgactaccattttgcttctcttcacaaacaagagtttggatcctggacagaagattcaagaaaatacattagtaatgtcagttccttaagttgaccttgtcttgggtttgagaacattggtttgctgttgcagttgttacaaacagcatctactgtaaaaatacgttgcaaccatgtttgtgaggcattaggccaatggggtggggggtatttggaaggggtttctttaacctgctgctctctgtagaaggaaaactctcaggatttacatactctgcctgcaaaggatcagggagggcaatgatctttatttgtgggcaataccattataggtcactgatgtgctgttttctttgtttgccagttaagtgtgtatggaaactccagttggcactttgacgaagtgcgaaaccaatgttattttcatcagtttatgaaagagcaacctgatttaaatttccgcaatcctgatgttcaagaagaaataaaagtgagtatagatacccacacagacttctccattaatggaggtttaggtatttatttaaaacactttatattgcacagtaattgtgtaggcaaaatcaagtctttaattatttgaaatactctatagttatttgaaacactttatattgcacaataattgtgtaggcaataatcaagcctgaattaaatcccaggattaagctctctggtgcaaatgtagactctcagacatgtctgtgactccttccttcatctaactcagagtaccctaaatggaaggagtcagaaacacctgccaccctagctccaagttgccccgccacctgtgacagtgagctgtacggtgcctgtgacggtgagctgtgcggtgcctgtgacggtgagctgtgcggtgcctgtgacggtgagctgtgcggtgcctgtgacggtgagctgtgcggtgtctgtgacggtgagctgtgcggtgtctgtgactgagctgtgcactgtctgtgacggtgagctgtgcggtgtctgtgacggtgagctgtgcggtgcctgtgactgagctgtgcggtgtctgtgactgagctgtgcagtgcctgtgactgagctgtgcggtgtctgtgacggtgagctgtgcggtgcctgtgacggtgagctgtgcggtgcctgtgacggtgagctgtgcggtgcctgtgatggtgagctgtgcggtgtctgtgacagtgagctgctgcagggaggtgggtcatttggggtctggctcctgcatctaaaatgggcttcttgatggttatttggctttcatgtcttagctgtctcatctatgaaacacagttggtggcaatatttgtctcatagggctgtttggaagattagatgagataacacatgcacgacacttctgtactcattgagtaaatattaacatattgcctactccgtgccaggccctgttctaagcactgggaatgcagcagtgaataaaagaagccttaccctcaaggagtctccaatatactgaggggaaagcaggcaattagccactaaatatatatatgttaggtggtggtgaatgccaaggggaaggggcatcggagtgtcaggtagaagtggctcttctatataaagtgtgtaggagacaccttcttatgatgagatgctgtttggacaaaaacctgaagtgagaaaggaaccatgtgactatctgggggaagagaatttcgggcagaaagaagaacaaatggaaaggtcccgaggtgagagtgtggttcatgtgtttcagggatggcatggaggccagagtgtagggttgccaaacttagcaaagaaaaatacaggatgtccagttaaattttaaatgaatgatgcaacatttgagacatactgctaccaaaaaattgttcattgattacctgaaattgaaatgtaattgagtgtcttgtattttatctggcaaccctaccagtatgctggagtgaaatgggttagggcgctgaagtaagaggtgggggctgatcatttctcacaatacaattcacaaaacatatcagctatgttcttgttcttgttcttgctgctcctatggctacagtgggcagaaacttaggggagtaggggagtcctctgagccaagtaggtgggaaggagaccctaacagaacggggagcattgggtgcctttccacagctcaccacgtcagccagatagagtggatgcaagctgtcatgctggagtcactaggggcacctagaacccttggtttagtttaattttgaaataacagtttaattgacatataattcacataccataaaattcaccccttttgagtgtgtaattcagtggttttagtatcttcacagagtttcacaatcactactaatttctgaactttttttttttttttgagacagtcttgctctgtcgcccaggctggagtgtagtggcatgatcttggctcactgcaacttgtgcctcccaggttcaagcgattctcctgcctcagcctccgagtagctgggactacaggcatgtaccaccatgcccggctaatttttgtatttttgtagagacagggttttgccatgttggccaggctggtctcaaactcctggcctcaaatgatccacccgtctcagcttcccaaaatgctgggattacaggtatgagccactgcacctggcctaatttcagaacacttttatcttctcaaaaagaaaccccatatccatcaacagtcactccttatggccccctccctttcttcccccaccccctgggaaaccacaaatctactttctatctttttacccacctaagcctcagttagataggttttgcctattctggacactttgtacaacagaatcatgctgtatctgtatatccctggtaggtgtctgtatctgtgtttatttgagaaactgccaagttgtttttcaaagcagctgcataattttacatttccattaacaatgggtaagcgttctaatttctccacattctcaccaacacttgttattgcatatattttttattacagtcaccctagtgggtatgaagtggcatctcactggttgtatttgccaaatggctaaagacgttgaacatctttttatgtgcttatagttcatttgtatatctgcattgtagaaatgtctatttaaatcctttgcccatttttatttcatttttatttatttattttttttgagatagagtttcactctgtcacccaggctggagtgcagtggtgcagtctcggctcactgcaaccccagtctcccaggctcaagtgattcttgcgcctcagcttcctgagtacctgggactataggcacgtgccaccatgcccaactaatttttgtattttttgtagagatggggtttctccatgttggccaggctggtctcgagctcctggtctcaagcaatcctccctccttggcctcccacagtgctgggattacaggtgtgagccaccgcacctggccctttgcccattgttaaacagggttgtctttttattattgggttgtaaaagttcttacatattctttttctttttctttttttctttttttttttgagacagggtctcactctgttacccaggctggagtgcagtggcgtgatctcggctcactgcaacctccacctcctgggttcaagtgactctcctacctcagccacccaagtagctgagattacaggtgcgcatcaccatacctggcaaatttttgtatttttagtagagacggggtttcaccatgttggccaggctggtctcgaactcgtggtctcaagcaatcctcctgcctcagcctcccaaagtgctgggattataggcatgagccaccacacctggcctcttttcatattcttgatacatgatttacaaataatttttcctattctgttggttgtctttttactttcttgatggtgccttttgaagcacaagcgtttttaattttgatgatgtcctatttatttatttgttttttgagacagagttatgctcttgttacccaggctggggtgcagtggcgcaatctcagctcactgcaacctccgcctcctgggttcaagtgattttcctgctgcagcctcctgagtagctgggattataggtgcgcaccaccatgcccagctaattttttgtatttttagtagagacgcgttttatcatgttggctaggctggtctcgaactcctgacctcaggtgatccacccgcctcggcctcccaaagtgcagggattacaggcatgagccactgcgcctggcccaatttatttatttttttcttttgttgcttgtgcctttagtgtcgtatctaagaaccattgcttaatccaaggtcatgaagatttactcctatgttttcttctcagtttcacagttttagtcttacattttagattgtctgtgatccattttttgttaatttttatatagggtgtgaaggtaagctgtccgactttttttttttttttttgcatgtggctattcagttattccaatcacgtatgtttaaaaatactattctttccctactgaattgtctggcaacttttgttgaaaatcaattgaccataaatgcatgggtttatttctggactctcagttctgttccattcatctatatgtctgtccttatgtcagtaccacacactgtctgaattactagcgctttgtagtaagttttgaaatcgggaagtgagaatcctacaactttgttctttttcagtattgtttcactattccaagtcctttggatttccatgtgaatttctgagtcagcttgacaatgtttgcaaagaagcctgctgtggttttgatagggattgcattgaatctgtggttcactctggggaacatagccatcttatgttaagtcttccaattcatgaacatgagatgtctttccatttatttacgtgttctttcatttctttcaacaatgttttgcagttctcagagtacatgtcttgtacttctttcgttaaatgtattcctatagactacttatttttaagactttttttttttttactgtatatgtttggtgtttccagaatttgtatgaattgttttggaattggttctggaagtaagcaccatgagtgagggcaccttgcctccatggggttgtggggttgtggggttgtggggtgggtagttgtagacatggtcagcagactaactaggggttagttttaaacttctctggtagcctgtggactctcctcttcttcatcaccaaaactccttatcacccacgcctcatgctctccccacacattctatgtgctaagtgctgttcctggataatttaatgctcagaataagcctaatttacgaggttttgtgatcattttacagagaaggaaattgaggcttagataggtaaagtcaccatccttgggagtcatggagcaggactgaaatccagacactcggacttgagttcatgctcttaaccacaatcctacacctgctttgaggcaatgtatgtgtttccctctccatgcttcactttttctgcacagatttgtcaaggaggttttcagttataaattgataaatgtgagtataaaccagctggtttacagttggtttatcaggcagtagatttttccaggctccttgtggcaatagtgatgaattgtctggggatgtttagacaagtgtgataaattctgcaaaaatgtgccagccaatacattaattatttttttgactaacccagctgtgctcttccagatacccaagccgtggagtgtgtggacaggatccttatttactggtcttctggctgaaatccctcatgtgatgaatcattaatgcctccggttgagagattagactttatttgcaagactggtttagaagatttactattagaagtaaataagaaatgctgagaagctgagaggaaagcctctttgctcctggaaagggacctttggcatgaaggagacttctgtcaccctcctccccaccttacccccagcagcgcttgtttctgcaatagagttaagcaggttaataatttgcagctcagagggtttgtgtggaggcggcgtttggaatgacttgcttgcataccaacttgtactcctggagcctgagcccacttcctccccgctcctatcagattttgctttatctgcacagtgggaagctggcatgctggggaaatccagcagagagcaccctctgctgtccttctctttctcctcctctttgtactggccatcaggggacttggctctgctctgaacctcttggggcttgagtgctttcagctgaagaagtcagaaaaccttctctgaggtatcaggggtatatatttgtataatactttatactttcccaatcactttggtttttactggtcctccacatttcttatttgacaaatgaggaaactgagacacagagaggtgaagtaacccagcgggttagcagcatggcaaggaagagactccagatggcctggcctcgtatctggggtttggagtgatcctacacctgccatatgggaatgctgagccccagggtagggactgctggggagacccagctgagagggaacccagagcacaggcgtaggctccgttctgtccctactaagcatgatactgctggaggcagcagctcaattcaaaacacaattcgctcactacctgcttgattagccatctctatgcttgataataataattgtgccatttattgcacctcctctatgccaggcactttattataatcattcactcatttaatgataggtattgtgtgtcttgaccatgtgctaagggtgtgggggctggtaagatagatacctcttgtggccatcctggggcttatattctggggtgggaggtggacaattaaacaggcgattacaataaaatgtgccaagcggtcatgacagtaggaggtaggaatacacagggcaagcgcctaacctggacacatttgcagaggaggtgagatacctgaggaacaggcatgagctaagtgaagaggcatgggtgggagtgtttccagcagaggaaagcgtggatcgtgacacattagaggtgctgggagttgtccagtatcactgggatgtgatatatagagcagggagtgacccgatgagactagagaggtcactgggggtgaggtcaggagcaccactgaaggccctggtaaggatttgggcttaaaaggtcttaggtatttattttttatttttattttttttcaatttgagaaatcagtctggttttggagaaggggtttgagtagggcaggtttggaggctttggggccagggaggaggatggtgcagtaatcgggaaagaaattctggtggctttaggccagtgatggaggcatagaggtgcagagaaatcatcagggctctgagaggagtcccctgtgaatcccaggtttcagatttgaatatggggtgggtggcagaaccattgtctgagatgggagacacaggaagagagagggaaatatcttaggtatgtagagttggagctgcctgtgacacatccaagtgttcagtggacagttagatataaggacactgggctgggcacagtggcttatgcctgtaatcccagcactttgggaggctgaggcaggtggatcacatggtcaggagttcaagaccagcctggccaacatggtgaaaccccatctctcctaaaaatacaaaaattagccaggcatggtggtgggcacctgtaatcccaactacttgggacgctgaggcaggagaattgcttgagcccatgaggcagaggttgcagtgagccgagatcatgccactgcactccagcctgggcaacagagcaagacaccgttttaggggggaaaaaaaaaagatataaggacacggagctcagggaaaagtctagtctagagataaaactttgggacttgttgatgtggctgatgtctacagagctcaggcaggtgtttggtgagagaagcaggctgggtaaggtgagcaagagggccaactgcaacgtagctggagcgaattgctcacatgtgaatgagggcctggtgttggtagaccttccaattaaaagaaaaatccaagggagccaggctagcaaataagtcagggcgccgtacagttgcaattctgctgccaccacttaccaaccatgaccttgtcaaaggcacatcatcttcctgagccacagtttcctcactggtaaagggggaacaataatggtacgtacctaatggggttacttgaagattaaatggtttaacctttgtaaagcacttaggatgctattttttttactgtatacagtacttgttaaatagtcagtaaattggtaagtaaataaatactattgtgaagtgcaatgtcgagagggtgtaagatggagccccaaggagcactgacatcaaagagctgcagaagagacagagaagggagacaaaccaaggggcagggtataacggagctaaggtatctgagtgtttccagaagacgagattggtcaacagtgtcaaatgatgcagagagattgggtaatataaagactgaaaggggtctgggcgtggtggctcatgcctgtaatctcagcactttgggaggctgaggtgggtggatcacttgaggtcaggagttcgagatgagcctggtcaacatggtgaaactccatctctactaaaaatacaaaaattagccagatgtggtgacgggcacctgtaatcccagctactcaggaggctgaggcaggagaattgcttgaacccgggaggcaaaggttgcagagctgagatcacaccactgtacgccagcctgggtgacagagtgagactccatctcaaaaaaaaaaaaaaaaaattgaaaagtcaattgactctggcagcaataccttatttactccatacagaaaccctccatactatgttattgatggagacactgaggcttagctggtcttgcagatgccctatgtcatgcagctggacagcgagagagctgggttgtacccagagggtcaaattctgaagtccttgatctttcctctacttcctgcttctggaggagttagcaaagaatttttccaagatttctgaacatgagtagggtcagttttctttctcttgcctctaagtagagaaccagtttcctctgtactctgaaacatcctttctcattccttcttgagatggacaacctgtgatttatgacattttcaagatgatgtcttctgtttgtttttttggtttgtttttgttttcttaatagagacagggtctcactttgttgcccaggctggtcttgaactcctgagcttaagtgatcctcccacctcggtctctgaaagtgctaggattacaggcatgagccaccacacctggcttaagaggatgtcttctctatcatcccatgtaagagtagacagagcttttcccaaacatgggtttttaggtaaacgggcccccaaatgtcagccatctgaaaaggaaaggcttggctcaaggttccatgtatttggatatgttaacttgcttccttaatgttgacttgctttcttttcactcagagcagcgagctatttaaagagaaaggagttaaaaggtgcccagtggaaaaaccaggagtgcgtgatgtcatgggagtcagacaggagtcaaggacgtagtgtatagtccagttcccagagtccacggcacctacatgggtcactagacctagctgacccaggctctgtgcccatttttgcatctggaaccctgagagaccttcatgggagtaaagagggttaacaattaaaatctgaagctctcttttccctcctggttgagagaataaatagcatgaagcaaatatttttcaagagcaaactttggattatcttggtgataatctgaattatcagcatttaaaatgactttcagaaaatgtccatcaagcttttactgttttgtctcattaaacaatgatattatttctgattatgctagggccataaaccttctgtgcggtacaagtttctcatgtttaatgtcaggtcaacatttcacaatgctgagatccggactccgtaaagaaaaggactggctttattttaggaaatcagtgcccaaaagcttgatgtttacacagaatggtgcttaatgttttcccacatttttgtcagaggccgcttggatgccttcagttattcgtgctctgccccaaccaatgttcacacttttaaagaacagcaccacctgggtgtggacccaggttgcgcggggtctgaagctgatagtaaattagggccttcttaaaatagagcacaaaattaagtacagaaaagttggtatttacttaaaatgagcaaagaaggggagttagatgagtgcaagtgagaggtcttgaagcttaagtttggttagcttcatagtaaggtcactcctgaagccactgaaaacctgttctagaaatgaggtgcctttctttgccccaccagacttctctagcccattctctgatgaatggctgtcacttcctgtttgccagctgcaaaccctccccagggtgaattgctgttttaccctcttgtattaccatgtttctctcctttgtctcagctgtgatttaaatatttttgtgttgctatttgtctagctggagattctaaaataatccgggagacctaggactgtgtctgttgtatttttcttgtggttgtagttccagggcttgcctaagtgcctggtatacactaggagttcaaatacttattgaatgaatgaatttggtaaaagataaaggcactagtaagaacaaatttgttttttatgccccagagaaaaattccactgggtagagattactggaggttatttgggtcacctgtgcccatgataagagttattcaccccagaacttgctcttaggcataaaaaattgattcaagcttcaccattcaaaatctcagcttaaagtgaattgacaggagcagtattaacccttgcatttagctgttgagacccttgacttgacttgaaacctccatattcacgtgcagatagaaacgcacttcaagtcaaacaagttgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgtgagtcaattaaacagctttacaaattacccagtcttagatatgtctctattagcagcatgagaacaaactctaatacacaagtgaactgtgggatagttgtcatttgggatctgtggctctgtttccctccataggtgaaaattggctgtttagtactttacagatggttctgctctaaaatgatatatacattcctgtgaaaccttccatacagcaagggatgagaaaagtagggagagccactgttcctttgcagagcttgtgagcaggtgccggagccggagcaggccttgctgggagaggctggctgtggggttgaggcaggtagctgaggctcaggacctctgcttttcacggtcacctggtcctcccacctgtcccagtacaggccagcctctgcctccacacttggctcatgttgtcccattcccaccctccattgaaatcccaccaggtcatctaggtcaagttcaagctctagctcttccttctcctgctgtgcccacccacatattttgaaatgtcttgaagctcttgcagccctgtaggcagaggtgtctcctctcatgaggacctgcattattaggtaaccatcccttgtcccacatgtccccaactgttctgtagacctgaagccagggaacatgctgtacttctgtaatgtttggtcattcaggctcaatatgtcattctttcatgctacaatttgttcactaagtaccaggtgctgtttcagaggcctacagacatgtaccaccacacgcagctaatttttcattttttgtagagacagggttttgtcatgttgcccggctggtctagaactcctgggctcaagcgatcctcccacctcagcctcctaaattgctgagattacaggtgtgagccgtcacacctggctagaaaaatcttttcaaggttcatccatgtcgtagcatgtgtcagcacattgttcctttccatggccaaatattcatcgtatggatagaccattgggttgtttccactttctggctattatgaataatgctgctatgaatatttgtgaacaagtttttgcgtggacataagttttcatttctctcgggtatatacctatgcgtgaaattgctgggtcttatggtaacttgatgtttaaccttttgaggaaatgccatactatacagttgattcttcatacatcagatctttaaaaaaaatgttaagtcagcccacagccttttctgattaaaaatccctccaggggtttcccatcaccctcacaaaaatcccagatctttcctgttaactacaaagctgagcatgatgagttagttttctttacctcctcctactcttacttatgctcctctggccacactggccacccccctatccctgccactgcctttttttttcttgaaacaggatctccttctgccacccaggctggagtgcagtggcatgatcttggctcactgcaacctccgatttttaggttcaagcaattctcatgctcagcctcccaagtagctgggactacaggtgcatggctccatgcccaactaatttttgtatgtttagtagaggcggggttttaccatgttggccaggctggtcacaaactcctggcctcaagtgatccacttgcctcggcctcccaaagtgctgggattataggcgtgagccgctgcgcccggactaaccacttatttgcaccagtcttcatctctctaatctttggcttcagcattaaaaatgcctgggaacaaggcagcccacgatgatgctctcaggagcaggtgaggcaggggagaggctgagcaggcaatgactaccttctctctagcaaggtgtgttggaagagtagggcaggagaggagagtgagccaggggcagtcatacaataattgggtttctagcacacacctttggaagaaagtctgtcaccaaagaataaaattaaatgtatgagaacctggatttttagcttaaccatttgtgtttgggatcaatttatttgtgaaattaaagccagtggaataatgtagattccttttttttttttttttttttttaaaagacagagttttgctcttgttgcccaggctggagtgcaatggcccaatctcggctcaccacaacttccacctcccgggttcaagtgattctcctgcctcggcctcccgagtagctgggattatgggcacccgccaccatgcctggctactttttgtatttttagtagagacagggtttcatcatgttggccaggctggtgtcaaactcctgacctcaggtgatccgcctgcctcggcctcccagagtgctgggattacaggcatgagccactgtgcccagcccatttcatcttttattatctgagtgtattcaagacaacactagtatctgagttttaccacaggatcgtcactattcttagttatttacttggttgatggttgattctattttttttctgtgtgttccttccatattactcctagcaggagatcctttaatatctaagcacttcacctctcatctgccttcctagtaaggagtgaaatatttaactattgaacaatgtgttattttctttgagtttgcagtgacagttaaggagttgggcatgagggagatgagaaactttcctagtttattctgagtcctatcttttcttatggtttcattctttcatttttagtagactctctaaactttgaaaacatccttataacatccattacaaatgtaactaattgtaattctgaattcacatatgaaggaggtgtgggagtcgctaaatgcagttagagtgcattttagtaagacagttatgctaaatagataaaaatagactgtgaatactgtgcttgttctgtatgtagatatctgttttatgatgccaagttgttaacagtcaaaactttgattaaacgttgtgataataacgtagttaatgtaaccaagcattttgcttcttcatctttaggaaattttacggttctggctcacaaagggtgttgatggttttagtttggatgctgttaaattcctcctagaagcaaagcacctgagagatgagatccaagtaaataagacccaaatcccggtaaagttttattttaaacgtttttcttttgccttttctgaaaatgtcatcagagtgttttctttctcagcctgagataccagttacaaagatgagttttgtcctgtgtctagcaagtaccctgatttatttctttaggaaatgtgcaagagtttgaaatgcatatgcactcgatgtttttttccactggttccctccagagcgagggatcccttgaggagtccttcagtgacaagggttctgaagacatggacagtgtgggctctaccaagggccacaaaatagaggacatttactcctgcaattttatcatctgacataggctcaagtgaggaggccttggcttggatgagatgtaattttttgttttgattctaggagattattgtcatcctagaaagacatagaaatgagacactgacatagaaatcctacaaagatacagaaactaggaaaaatttactgaaaccccgagaaagtataacagttaggagaaaggatagtgatggtaaagaaacaaatttaagtgcatgatgttaatagttttgtgagcagataaagtatacatgtaataatgagctctataaccactaagatctttttttttgtttttaaaagggtctgaaacattttgacaattacgtgttgagaactttgtaatcagtgttttgcttggtaaaatttatttgctaaaatgggtgacagtttattagagaaatattgcttagtagatttataaagttaacaacttgagcatcaaatgaagcattcttctccatccacaaaaccatgtttgagtgtgcgtctcgcttggcttgagccctttgaagaggttgtctacattcatatagagcgagctgtgggcatgcaatgtatgaaatgagggtaaccatgtcgtcctggttttcaaaggacacggtcacacaatactcggagctgtaccatgacttcaccaccacgcaggtgggaatgcacgacattgtccgcagcttccggcagaccatggaccaatacagcacggagcccggcagatacaggttgaccacggcatatgctctcatttcttcccaggcttagtgtgtgatctgcagtgtatccctcacaaccaagtgtatttggaggttcaagtaataatgtaacaagcctgcataactctaattgattacagtttggttgtaccagggcctgccatattcctttcctgtttgcttattttgctgactttcagtttcctcttttgtaaaatgatgcagatcacactacgtacttcacaggagttttgtgaaaattaggttaatgaaaaagagattatattagctaaatgttagccatgagctattattttttctttttcaaaaaccagttccaggccgggcacagtggctcacgcctgtaaacccagcactgtaggaggccaaggcaggcggatcacgaggtcaggagtttgagaccagcctggccaacatggtgaaaccccatctctactaaaaatacaaaaattagctgggtgtggtggtgggtgcctgtaatcccagctacttgggaggctgaggcaggagaatcacttgaacccgggaagcagaggttgcagcgagtcaagattgcaccactgcactccagcctgggcgacagagcgagactccatcacaaaaaaaaaaaaaaaaaagaaccaaaaaaacaaaaccagctccacctgggtgcggtagctcatgcctgtaatcccagcactgtgtgaggtcgaggctggtggatcacctgacggtgttcgagaccagcctgggcaacatggcgaaacccctcctctactagaactacaaaaatgggcaaggtggcacatgcctgtaataccagctactcgggaggctgaggcaggagaattgcttgaaccggggaggtggaggttgcagtgagctgagatcatgccactgtgctccagtctgggcaacagagcaatactccatctcaagaaaaaaataaaaataccagctccttctctgcagtattatttttatcattgttattggatctatagtttcctagtacagtatataaatccatatgtttcagctaaagtatcaggaacacagctttggaatcaggtaggtctgaaggagtcctgctctgtagctgtgtgacctagggccagttaattaacataagtctcagttgtctcatcaataaaaaagtgatagcaataacctctataaggctgttgtgagattaaattagataatgtatataaagtagtgcctggatcatagtaaacactcaataaaattacccatcattaagtttacatagatcactcaacagaatcaataggaaggaattaaagaaatttcatctccttaaagtaggtactccgattactctgtctccattttatagacaaggaaactgaggctctgagcatgtaagtaatgtccacaggtaggagtggcagctatgggatttgaactgaagcagttgggctccagagaccatgcacttatccataaatatgctgcctcaaatagctaaagccagcattgatcggagtcatttcaggtgaatgtgtcttcccccagggttttgctttcagcaattgagagtgcacaccaataataaggcaagatgttatagggactccaatacaagggggaagttcttttgaagaaaataccccacctaatttgcagacataaactttagattctaaatggagtgatgagaattgctaaagaaagtcttcatggatgtcaacgagttttagtgtcaggatgttactgaattttgattctaggagattatttctcctaggattctaggtttagaaagaaaagaacaggcttggtgcggtggctcatgcctgtaatcccaatagtttgggaggccaaggcaggcacatcatcagaggtcaggagtttgagaccagcctggccaacatggtgaaaccctgtgtctactaaaaacacaaaaaaattagctgggcgtggtggcgggtgcctgtaatcctagctactcgggaggctgaggcaggagaatcacttgcacctgggaggtggaggttgcagtaagccaagatcatgccattgcactccagcctgggcaataagagtaaaactctgtctcaagaaacaataacaaaaaaacaaccaatatagactgagatccaatttttttttttttttttaaagacattctcactttgttgcccaggctggagtgtggtggcatgatctcatctcactgcaaccttcacctcccaaattcaagtgattctcctgccttggccttccgagtagctgggattacaggcgcatatcaccacacctaatttttgtatatttggtagagatgtttctccacgttggccaggctggtctcaaactcctgacctcaagttatccacctgcctcggcctcccaaagtgttgggattacaggtgtgagccactgcacctggcacccaaatgtgtttcattttttttggggggggtggatttttctgccttattttttattattatacttttagttctggggtacatgtgtacaacatgcaggtttgttacataggtatacatgtgccatgttggtttgctgcacccatcaacttgtcatttacattaggtatttctcctaatgctatccttcccttagccccccacccactgacaggccccggtgtgtgatgttccctgccctgtgtccatgtgttctcgttattcaactcccacctatgagtgagaacatgcggtgtttggttttctgtccttgtgatagtttgcttagaatgatggtttccagcttcatccatgtccctgcaaaggacatggactcatccttttttatggctgcatagtattccatggtgtgtatgtgccacattttcttaatccagtctaacatttggtgacagcttgattatgctttctagaaggtgctagtcctatatggttaatagtgtgcattcagcccctacatcttgtacatgcaagataagcagctgtggagtgccttcccagtcttctgacaggccccgatgacactgaaccttgtcaactcttataggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatggtaagtcctcatgacagcagagtacataatgtgctgctgttgcctttgctgtccagttatctctaaaatgcaatggacctttgtctctaagtgaccatcacctctgccttatttggtgattgttcagtggtcaggcctgtcacagcctctgccaggttcttttcattaagggagggagactgcccactgaatggaatgaatattgaatgagtgcttgtctatgctcagaacactgctaggctttttggggatggatatcaaaccataatttctccccacatatctcagagtttatgatgtcaatgggaagaaagaggatttcgggtgtagaagaggtacacagcaattcagggcaacataaaactgtgacaaaacaccaatttgtggggcaggatgcactgcaaaaagcatttaaactacagagattgtcggagaaagaatttctcccccttctgtactacactcttgaaaacaatttttttttttttttttttttttttttgagacaggggctcactctgcacccagcctggagtgcaatggtgcagtcatggctcactgcagcctcgacctctgaggctcaagcaatcctcccacctcagcctcctgagtagctgggactacaggtgcatgccaccatggctggctaattatttttgtttttgtatttttagtagggagggagtttcaccatgttggccaggcttgtcttaaactcctgacctcaggtgatctgcctgcccaccttggtctcccaaagtgctgggaatacaggcatgagctaccacgcccagcactaacatttttcaagactggcaatacattacttcagtgaagaacagaagatacagcaatacatacctgtggtaacagaccagtattctcacttccacacccatcagggttgctttccctgatctgatttttctgtctttgggtttgagttagaggtcaatattaggctccttcgtaagatgtctgtagtattatagatgtaagccctgctgcttcaaagtcccacggtaatagtggtttaaacaaaatgcaagtttctttctctcatataaaagacaacctttcttttcttactttttttttttttttttttgagacggagcctccctctgttgcccaggctggagtgcatggcgtgatcttggcttactgcaacctccacctcctgggttcaagcaatttttctgcctcagcctcctgagtagctgggattacaggtgcacgccaccatgcctggctaatttttttatttttagtacagacggggttttaccatgtttgtcaggctgttcttgaactcctgacctcgtgatccacccccacctcagcctcccaaaagtgctgggattatgggcatgagccaccactcctggcccttcctttctttaatatattataaatgtaaactctaaaatgcctctttagtctcgataatcctccatctctctgtatctctaccaccttagactgtttctgtggtctcatcgtttaggtctcaggtaggtgtcaccacaggaagccttctggagcccccaaatgaggtgtcaggtctacctattgtatactatagcacccgttcattctctttccttaaagtccacacaattccacgatgtctgctttccccactagacagttcactggttaagggcagaggcaggttcccagcatccttgcacggtgcccacctcacacggaggtgctcaggctcagggtttgtttgttactggtgctgttgttattcgtatgcagttcagcgacttaccaaaggtgtgccttatatatagagagagagttgccttacactagtcaatatcttctgttgtacccccacaatacctgtaggtttgatctgggccctgaaaagtggtatgattttgatacttttcgcacagatcctgccagctatcttacacagcctgatgaaaacctgaaaggataaaggagaaaatgcagcctaggcagaaaaacactggcagaatctgtgaaccacaattaagcttatttcaatcttttctgatgctttaataggcaggaatgtgtgtttccattgccagagcctttctccgtctggtgaggggaaagaggctcaaatttttaggcatggtaaaagctttaatttgttaaatgtaagtattaaaactatacaatttttaaataacagctttgtcgagatataattcacataccataaaacttttttttttttttttttttttgagacggagttttgctcgttacccaggctggggtgcagtggtgtgatcccggctcacttcaacctctgcctcctgggttcaagtaattctcctgcctcagcctttagagtagctgggattacaggtgcccaccaccacacccagctaattttttgtatttttagtagggacacggggtttcatcatgttggccaggctggtctcgaactcctgacctcaggtgatccacccatcttggcctcccaaagtgctgggattacaggtgtgagccactgagcccagccaaaatttaccgttattaaagtatataattaagtggattttcggtatattcacagaattatgcaaccatcaccaatgtctcattccagagcattttcatcacccccaaaataaaccacatctccactagcaataactgcgcatggcccctccctctctgtcctcagtctctggcaaccactcacctactttccgtgtctatggatttgcctattcagggcatttcatataaatggagctatacgatatgggacttttgtgtctagcttctttcacttaacatagtgttttcaaggtttatccatgttgtagtatgtctcagtacatcgttcctttttatggctgaatagtaacttccataaagcccattttgtttatctgatcatgaattgacagagatttgttttcacttttggactattacgaatagtgatgctatggacatttgtgtacaagtttttataaaaacatgttttcaattctctctgatatatatccaggagtggaattgctccactgggcatatggtaagtctacatttaactatttgaggaactgccaaactgttttccaaagtagttactccattttacattcccaccagcaatgttacgagggttccaatttttccacatctcatcaagccttgtgatggtctgcctttctgatgatggccttcctactgagtgtcaagttgttatctcattgcatttttttttttttttttgcatttccctgatggctaattttgttgagggtattttcatgtgcttattggacatctgcatgtcttatttggagtaatgtctgttcagattctttgcctataattaaatttggttgtctttttattgtttagttgtaagaattcctgatatatactggataggtgatttgcaagtattttctcccattctgtgggctttcatgtcactttcttgatagtgtcccttgaaaagcacagaagtttttaatttttatgaagtccagttgttttgttgttgttgttacttgtacttttagtgttatattagaaaccattgcctggtctatttattccagcaccacatgctaaaaagactattctttgcttcattggattatcatggaatctttgttgaaaaatcaactgattgtaggctgggcgtggtggctcacatctgaaatcccagcactttgggaggctgaggtgggagttgagcccaggagttcaagtttgccttgagccatgattacactccagggtgaactccagcctgggtgacagagtgagaccccgtctctaaatgtaaaacaaaacaaaaaaaagaaaatcagttgattagatttccagactctcagttctgttcatctatatgtctgtctctatgcctgaacaccctgagttgattagtgtagcttagtaagttttgacatagagaagtatgggtcctccaactttgttatttttcaagattgttttagctgttctgggtaccttatatttccatgtgaattttaggatttccatataaattttagaatagccaactgggattttgatagggattgcattgaatctgtttatcatttttggcaatcatgccatcttgtcttctaatccatgaagacagatgtatcttatttaggtctttaatttcttttgatgatgttttgtatttttcattgtacaagtcttagactttttgttcagtttattcctaagtattttgttcttttgatattattgtaaactgaagtgtttgcttaatttcattattggattcttcattattagtgtatagaaatacaatagatttgtgtatattgatcttgtatcctaaaacattgctgaacttgtttttcgtttctaatagtttattgtgaattcctgaagaatttttttttttttaatttgaggcagagtcttgctctgttgcccaggctggagtgcagtggtgtgatctcagctcattgcaagctccgcctcccgggttcatgccattctcctgtatcagcctcccaaatagctgggactacaggtgcctgccaccatgcctggctaacttcttgtatttttagtagagacggggtttcaccgtgttagccaagatggcctcggtctcctgacctcatgatctgcctgcctcagcctcccaaagtgctgggattacaggcgtgagctactgtgcctggccttctgaggaattttttgttttaaaattattgcaaaatatacataaaacaattttaaacattcaaaagtgtgtaattcaatgcattaaatacattcaaaatgttgtacaaccatcaccattatcagtttctagaacttttatcatcccaaacagaaaatctgtacccactaaacaataattcctcacttccaccactaacccctgatatcctccattctattttcagcctctataaatttgcctattctaggtacctcatataagtggaatcataacaatatttgtccttttgtgtctgcctcatttcacttagcttaatgttttcaactttccttcatacatacaatagcatgtatgagatcttactccttcttatgactgaataacattccatggtacctatgtaacacgttatctattcatctgttggtgacgtttgtggttttgcctccttttggctgttggaataatgttacaaaccaatggtgtacaagtatctgtttaagccccagatttcaattcttttggatctataccatggagtggaattgctggatcacataatacttcttttgttttgttttttgagatggagtctcactgtatcacccaggctagagtgcagtggtatgatctcggctcactgcaacctctgcctctgggttcaagcaattcttatgccttagcctcctgtgtagcttggattacaggcatgtgccaacatgactggctaatttttgtatttttagtagaaatggggttttaccatgttggccaggctggtctggaactcctggcctcaagtgatttgctgccttggcctcccaaagtgctgggattacaggcataagccactgtgcccaggctttttttttgagacagggtctcactttgtcatcacctaggctggagcactgtggtgtgaacatggctcactgcagccttgacctcctgggctcaagcaatcctcctgcattagctcccacaaagtagctgggactataggtgcataccaccatacctggataatttttgtattttttgtggagatggggttttgccatgttgtccaagctggtcttgaactcctgagctcaagtgatcttcccaccttggcccttaaagtgttaggattacaggtgtgagccactgtgcccagccttggatcatatagtacttctgtgattttgaggaactaccaaactgttttccatagtgacttctccgttttacattcccatcagccatgtacgaaggttccaatttcttttcatcctcaccaacacttttctgtcttgatttaaaaaattatactcatcatagtacaaatgaagtggtatctcattttttcattattgaataacagttttgctggatatagaaatcttggtttacagttctttctttcatcactttgaatatgtcatcccattgccctctggccttcatggtttctgataagaagtcagttgctaatcttattgagactccttacatgtgatgtaccaattttctttgctcctttaaagattctgtgtcttttaacggtttgactgatatgtctaagtgtgggtttttaaaaattttgtcctacttggagttcattgaggttcttagatacacaatttttaaaaaaatcaaatttgggaagttgttggctattttttttttaaatattgtttctgaccatttctcttccttctctccttttgagactcccattatgcatatgttggtatgcatgatagtatcccacaggtctctgagagtctggtttttttttttgagacagggttttgctctgttgcccaggctggagtgcagtggtgtaaacatggctcactgcaaccttgatgtcctgtgctcaattttcccatctcagcttcttgagtagctgagactacaggtgcatgccaccatgcctggctaaatttttaatttttttgtagacatggggtctcaccatgttgcccaggctggtttagaactcctgagctcaagcatcttcctgccttggcatcccaaagcactgggattacaggtgggagccacagtgcctggcctcattcttctttttctttctggttctcaggccagatactctcaattgagtcttcaagttttctgattcctttgctagttcaaatttgtcaagtccctctagtaaacgtctcactttagctattgtactttttaactctaacagttttattttttcataatttctcttatctatttgataactgttcatatactttaaattcttcaggcacaggttttttctttgaatatcaaaatattagctggtttaaaatctttgtctagtaagtccaatgtttggtcttcctaagcaatatttgctattgactccccccaccattatatgagccatattttcctgttttctttgactgttttgtatatttgttgttgttgttaaaaaccggacattttaagtagtatgacaattctggaaatcacattcttcctttcccagtgtttgttgtgctctatgtccagaagtcttgagaaatcaaagggtttcttgtcagaagatctcatgacagtgaaaagaataaaaggatggaggcaaaaattgacctaattttctggccataaacatagaaaaatacttcacaatggtctataaaaacgtaattataaagatcattttcatacagctaaggaagttaaaaaaaaaaaaacccaacctcctatttcttgaattgtagcaattaagtcttgtcctaagactcaagttcgaacgctagttctgtcttagactactacttgaataaatgatgtaatttctcagagcttgtttcctcatttgtaaaacggagatagtacttgctagcactgttgtgtgaaggagggaaatataggtgtgaaagtactttttaaaaagtaaagtgccatgctcagcgtatgcacatgagggtttgagttgtgggttatggagagagttgtcaggtgatttaaataaattcttatttaaacaaacttatttaaataagggctagaatatacctagaacgtttaacatggaaatatatttacaaatagaaaacactttataaaatttcatcttggagtatgtaaattctttctaaaagttgatttactttaaaaattttgtctgaataattcataagtcaaaacaattttttaaaagaggacacatcagaagtctctcatgcctgtccctttcacctgggttcccttgtcttgctctctgccacagttttgcttcctttcctgtcaatattctcttatccaaatatgagaaaatatgactatgtaccctctgagttttatttgcaatatcattgtacaataaattcttatcacccttttcttgctcatcagtggccaagataataaattggtcagttacacagcaaatagcaggcctaggactcaagtccaggcttgctagtaccaaggtaccacatctactttgttttgctacgttgtgaactttctgtgaaatagggtaaatctttcagaaaactgtgtatacagctgtgttcttaaaaatatctgcctttcagattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttgaatacaacttgactattcatcacagctataaaaccaagtattcattttttattttttgccaaatcagagaacttactatctctctattgcattgctgaaaatcatggttactttgcttttctttcttactgttagtaagaattctcagctttcttggtggtctgagagcttattttaaaaatgctttggagccatacaactaaaagtttcttgggtagggcattttaaagatgttttctacctgataggcacattaaaatttatttatttattttgccaggaatactgtgttgagaggcacactaaaattggagaaccggtggtttagtttagaatatgactcatttccctctacttgaaatgtggagttaggaacacttatttctttagttctcatttgtcctgtttggtcttgggtgaccacagcacaaggacccttttcttttctgttatcaggtgcagtgcacagcctcagagttaagcagtttttattttgtagctacagatttcagaattgtgttgctgggtagacgactatcttgcaactttaattgcctagttagctttcaactatatgagatccaatttccctaatatttgattaaggtgaagcttttttccctctatcagctcctacatttgtgtgtgtgcactcatgagcaataatcaggctgaataaacgagtaggacagaattcatactcacttgtacatggcagtgttcttaaattcaccaacactgtaccatagtagaagtcgtgtaaactggcaatagcacattttgaaatcctgtattattgatttttaggaaaaagcagcagagatttcaagcatgtattaaagttcgattagtattgtctattcaaactcaaaatgttattaggtactttctagttaaaagggtgaaactggtttatgtaccgaaagttgaggccttttcatcacaaatgctaatgagtacaaacactagctaagaactatggggaattaaataattatgaagtaaatcaggaccaaagcacatttcttctaataaccaaaccactgttttccctttctggtcttttgacatagaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctgaatgtgtctaaaccttaacggatactctttaaatcaatcacagacttccttgcagttttccatttgtaaggagtttgtaaatcatgcctttgtgaaaatacaaactggtacaaatctaccaagtgaagtgaagtatcatatagaatatacaagtcttcattgcaatgacctttactaaggcctttgagctatgaaggaaattttatgaagttttttagctagcccagctgcctttcctcctctcttcccctcaaaaggcagggagagaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatagttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcataccagcaaagatggagaaaatgcaaattaaaacagtgattttttttttttttttttttttttttgagatggagttttgcttttgttgcccgggctagagtgcaatggtgtggtcttggctcaccgcaacctccatctcctgggttcaagcgattctcctaccttggcctcccaagtatctgggattacaggtgcccgccaggcgcctgccaccatgtatggctaatttttgtatttttagtggagacggggtttcaccatgttgggcaggctggtttcaaactcctgatctcaagtgatccgcccacctcggcctcccaaagtgttgggattacaggcgtgagccactacgcccagccaacaatgacacttttttctaagtcataaatcccagacaatgccattttaataaaatacatccaaatgaccctggaaaggaacagaaaatttaagtaatttctaaaatacataaagtaaaattagggctgggcaccatggctcacagctgtaatcccagcattttgggaggcaaaagccagaggaatgcttgagcacaggagtttgagaccagcctaggcaatatagtgagaccttgtttctaccttccccctacccccgccaaaaaaaaaaaaaaagggaaattagctgggcctggtgacatgtgcctgtcatcccagctactcaggaggctgagcccaagagatcaaggttgcagtgagttgtgattaccccaatgcactccagcctgggtgccagagtaagaccgcctcaaaaaaaaaaaaaaaaaaaaaagcagagaatagaagtgggagtctaaaacatacaggagaaaaacagttctaacagagacagcactgtaggaatttcctgaactcctgcaatttgccatggcataatttccctaaggaaaaaaaaatctagaactgtttggtgatcacatgcatggcagaattagtagaacaaagcctgaagcttctacaagtgcatcaaagaaagaaaagaaggaaaacaagacctaactctagcactgtcccctggcgagaattcactgtggaatgctctcagaaaggagagcttttactactcagctcagagtcacagacaccaggagaaaaaaggtgggaatctagaaagcttatcaccttcaagtaggaaaagaaccctacatcccaatgtcccaaagacaagtcagacccacatccaacttggcttcccattatgagaggcaggcaaccaaagacaggcaaacaaggaaggtcaaaacacaaaagcaaacagatcaagaatcacacagcatctgagaaaaaccaaggccataaaagggagacaccattcctaacagaacactgtagaaagcagagaaaattatagcaaacataagacttaaatataagtataaatacccccagtagattgctgtttaatggagctccttgacattctttcaagaagtgattagatctctcagaagtataaaagactgtcaaacaatgaaataaaatagaacataagtgctaattagtgtgctgaaaaattgatccaggggcttgtccagaacgtactgaaaaagacaaagaattaagagcataagaaaaaatcgggatacatggaagatagatacagaattccgtacatgcagtaacaacaattgcacaggagaacagactggaggaaacatacaaagaaataaaatacataacccagagataaaggaagactttgtcttctttcagaacaggtaggataaagagaactccaaaactactcagaaagaaaccaaacctgaaaatagattgcctgagaaaagggttgagaattggactagcatcagacttctcaattggatactacaccacattagaactctatcttcaaagttgtaatggaaacggaattctgtatccattcaaagagcaaaacagagatggaaaagcaaggacccacattttaccatgtgtggccactttctgaaagaatagtcaagggactatccaacaaaacataacaattctaagagatacaatgtattaaagaaggaaaaggaaataacttgatttaaataatttttgatacacaatgtaaaacaaggtattctggaacaaaaatcttagtgatttgattctatatgggaaatgttagcagggagggtgtgtgggtgggagggggcacacaggagcaagcaaatgagagagcagtgtttgttttgcacaggaaaaagagtaactctagatttgagctgttcagtagccattaaccactgtgactattacattaaatagaattaaacatttagttcctgctgggtatggtggctcacgcctataatcccagcactttgggaggccaagactggaggatcacttgatcctaggagtttgagaccagcctaggcaacatagtaagaccctatctatctcttaagaaaaaaattagctgggcatagtggcacacacctgtagtcccaactactcaggaggctgaggtgggaggatcacttgagcccaggatgttgaggctgcagtgagccatgatcatgccactgcactccagcttgggcaacagagggagattgtgtcaaaaaaaaaaaaaaaattcagttcccatgtcatagcaacacttcaagtgctcattagctgccatattggatggctctgatatagaacatttccagcattacagaaagttctattggccagcattgttctagacattgagaaacattattttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaa

SEQ ID NO: 860 - DNA, 173227 bp, Homo sapiens
cctcggcgctcttcatctaccgcactatggtgccggaggaggtggaggtggagattggtgagcctcgacgcgccgctcccttccccgggcttccctcctgcccgtcccggcctctccggcgggcgccggggctgctagagcctgcccatcgtccggccccggcctcaggtgctgtccacaaacgctgccgcccgccacgtgcaggccccgggcgaacccagcaatcacagccgtccctgccctcctgggcccacagcccacttgaaagtcaggccttgattgaaaaatcacagcaaacactgacttagcccgcaccccgtgccaggtgcggttccaacgcttgtatcaactccttaaccctacgaggcgggtgtatcctcatccctattttacagatgagcaaactggcacggagggggttaagtaacctgcccaaggcccacggggcgtcaagatccactgtgcaataatccgaacggctgggtagagccatgcccaggtgtggcagggacccaggtcactgtcactctccttgacggtcgcagcctctcacggagggtccgaagagcacccctttctacttctggaggctccttatatcctaaaaagtaaaataaggctaggacaaagtttaaaaactacagtagactttaaatgtttatgttgaacaaattagcatcgcaaatacaaaaagacagtgaccagggtcccagaaccctctgtggaggcggatccccagccccacctactctctgataggccagggacactgagagggcagggaggggccagcacaggtgagaggaggaggcaggacaactcgcttcagaaacagctagaaggagactgggacctcgaaagccgcctcctcgcaggagcaccagctggagcacagctaccgggacctcctgcctggctgtccagtctcctgggctacttttccagccccttaaggacttggggatcccttgcagggcctctcactgggttcgggtggcagggccggcagacctttgattttttttttaaaggtaccaggcagattcatttattgtattctattttttaacttttttttttttttttttgagatagggtctcactttgtcacccaggctggagtgcagtggtgcgatcttgactcactgcaacctctgcctccagggctcaagtgattctcccacctcagcttcctgagtagctgggactacaggtatgcgtcaccatgcctggctaatttttatatttttggtagagacaggtttcaccatgttgcccagggtggtctcaaactactgaggtcaagtgatcctcccgcctcggcctcccaaagtgctgggattccaggtgttagccatctggcacctggccacttcttttttttttttttgagacagagtctagctctgtcgccaaggctggagtgcagtggtgcaatctcggctcactgcaacctccacctccctggttcaagcaattctcctgactcagcctcccaagtagctgggattacaggcacccatcaccatgcctggctgatttttgtatttctagtagagacagggtttcaccatgttggccgggctgctcttgaactcctgacctaaagtgatctgcccacctcggcctcccgaagtgctgggattacaggtgtgaaccatcgcgcttggccaccttcatttattttaaatattcattatttgcttgcacaaaataaaacgccttcatcataaatccaaaaccataaataaacaacaataacaaatccctagtgccatctggagagaggaccacgtgatcacgttttggaatttaaccttccagcctattatttttttctccctggcagacctttggacctgaacattagattataactggacctcggatgtaggcactttcattggcaccaagtgaaattatggaaaccaaaaacacactcgcaggattgaccgtttaacatgtaccaccactgcaggaactcgggtttcgtttacattaaaaaaaaattacaagaccctaaaacaatggatgtgacttggatttcttgcagaagccctccaagggcctctgttaacggtggggtggctgttgtctgctgtgtttactagcacgtgtttagcccaaatgtcatccagtgtggaagcagagttcagtctcacctcagagggtccccctggttaattcctggaccctccaaagggagctcagaactcccccaccccgccccctgacccgtttctgggctgtctctgtccctggtcttcccttccattcccgtcccttctccactatcacctcatggtgaaaagctgatggattcctcgccgaagatgctgtctctggaaactctcaaagctgccgattctggaggtgccagatggcgtcgggtgttgggggttctggccaggtggggagaagagacctcatccccaactccacacgttgtcactcactctctgcttgttaaacctacaggctcatataacccttgaacagtttccctagattatttttgggggacaggtggttctggtctgttcagaggacctgcagagagcccagcgtgtcctttgtttccttttttttcctctttctgccccccttccccggtcaagatttctctctgctcctggttaaaaatgataggaatggagacaagcagatactggggcaggtggtggtaataaaggcgaggtgtccttccgggcagcagatacccaagatactgatgcagtaggtacatgtgttccttctggaaaaaacaaaacggaatcgtactgtacatatcatttagtaacttccttacatttaaagaaattacacaaatactgccataacacatgttctcttatgaattcacagaacatagaattacatataaaaagaaaaagcaacgcttctccatcccttaagccccagtcctgctcttattcctaggggtaaccactattattagtttggtgtgtttctggttggctcttttgtcaaattatcagtcaatcaatcagccaatcacctaccaaccgactgatctgtctccctaccttcctatgcatctatctatactttatctatctatctatctatctatctatctatctatacatacctctatctatacatctatttatctatctcctgtctacctacctacctatacatctatctctctctattatctatctaccaactgaccaatctgtgtgtctatctacctatcattcacctatcatctatccatctatcaattatctaccaatctacctacctacctatacatctatctatctctgtctatacatctatctacctacctacctatacatctatctctatctatatatctatctacctacctacctatacatctatctgtctgtctcctgtctacctacctaattacctatacatctatccctctattatctacgtgccaactgaccaatctgtgtgtctgtctacctatcacttacctatcatctatctatccatctatcaattatctaccaatttatctacctacctatacatctatctctgtctatacatctatctacacatctgtttatctgtctatacatctatctatacatctatctatctatacatctgtctgtctatctatctatacatctatctcctgtctacctacctacctatacatctatctctctctatctatacatctatctatctatgtacctacctacatgtctgtttatctatctgtctgtctgtctatctctgtctgtctaggcataaggtcagggctgttgagatcaattaatcagcctacctacctacctacctacctacctgcttgtcatctatatctgtctatccttgttccatctacagtctatatttctctctataatgataatatatggatatatagagttcctaaaactataaatatcatactatatatacatattattttgtgacttctccccccaccacatgttttggttattttttcatgccaattcctatagttctacctaacttgatagatttaaatacatagatgtaccacattctactcatccattctctaattaatggacacttagcttttcagagtattcattctacaaacaatggaataatgtctgtctatccttgcatactttgtgtatttctggaggatagatttataaaaatgaaatgcatctgtaacaagtgtggtcttttacaatttgagtgggtcctgttggtccacagccagtggtggtggatgaggcacctgtttcccaatggcctcctgacatttgatattggccattttttagatttttggcaattccatagaaaaaagtagttgtactcccttactctaatttatgtaaatgttagtgtagttgagcctctttttttcccttcagttttttcttttcttttcttttttctttttttttttttttgagacagagcctcactttgtctcccaggctggagtgcagtggtgtgatctcggctcactgcaacctccgcctcttgggctcaagtgattctcctgcatcagcctcccaagtagctgggattacaggcgcgcaccaccacacccagctaatttttttgtatttttaatagagacgaggtttcaccatgttgaccaggctggtctcgagctcccgatctcaagtgatccacccacctcggccttccaaagtgctgggattacaggcatgagccactgcgcctggcctccttcagtttttaaattgtggtaacatacacacggcctgcaatttacatcttaaccattttgaaatgtacagtttagggtgttaaatacgttcatagtgttgtgcacccaggagcctctttcttatgcttcttggttatttgtatttcttctgggctggtggtaactctgatcatttctgtatccttcgtctcttggcagaatttgcacaaacctccttggctgtcactgaaagctggctccatccagtaaggaatactgctgtaccactgtaacataacgagtctcctgtgggccacataccaaccccttggctccacagaaagcaaagatatcaggtgtttcatgcagtgaacaattacgtttaatattttcttcccatttatgtggccataaagatgagatacctgtcctgtctgaagagggagaagaggaagaagagacttattctcaaaaagtggagtccgtggataaagtgcgaggtgtggagttgggaggggtcatgggagggtggaactgagaaagcccccccgcagcgggagtagggtgctgcctgccgtgccacaatcagttgtactttcactgggtatgaaccacaaagagaaagtgctgggtcatgaatagacggatgtagtagtttcccacggctgctgtcacaagtgaccacagactgggtggctgaaaacaacacagatgtattctctcacaactctggaggccggaactccaaaatcaaggtgctggcagggctgcgctccctctgcaggaccaaggggaggatccttcctagcctcctcactgcagtctgggggtcagggtgtccttggcctgcagcatcatcactccagtctctacatccatcgtcacatggccttgtcccctctgtatctttcttctccgtgtgtcctctctcctcctcctcctcctcctcctcctttttttttgagacagggtctcgctcttgtcacccaagctggagtgtaatggcgtgatctcagctcactgcaacctccgcctcccaggttcaagtgattctcctgcctcagcctcccaagtagctgcgatctcaggcgcccaccaccacgcccagctaatttttgtattttcagtagagacggggtttcaccatgttggccaggctggtcttgaactcccgtcctcaggtgatccgccctcctcggcctcccaaagtgctgggattacaggcgtgagccaccatacccggccgtcctctctccctcttatacaggcaccagtcacattggattttgggcccactctaatccatatcacctcatctttactaattacatctgcaaagaccctgtttccaaatgaggtcacagctttaggacatgcattgtgggggacactcttcaaccgagtgtagtatgtaacatacaaacactcatgcaggcgatgtctcagccagctcagcaaacacatgctttgtactttgttttgtaggtgggcttcccactgtgcaagctacagatgccattttcttaggagaatcttcaaggcacagaacttttcatgtatttatttgtttttgagacaggacctcactctgttgcccaggctggagtggtgctgtcatagctcactttagcctctaacttctaggctcaagcaatcctcctgactcaggctcctgaggagctgggactgtagaggtgcaccaacatgcctggatgacattttgattttttgtagagatggggtctcactatgttgcccaggctggtcttgaagtcctgggctcaggcagttctcccacctcagccttccaaagtgttgggattacaggcatgagccactgcttctggccaagcatttatttttaaccaaattgtaatcccctcaagtagcaaagactgtggagagggaactacaagttagaaataaaagatggtttgagtaagccttgtttaaagtgggtttttggtttttttggagacgaagtgttgctctgtcacccaggctggagtgcaatggtgcgatctcggcttgctgcaacctcctcctcctgggttcaagcgattctcctgcctcagcctcctgagtagctgggactgcaggcacacgccacctcatccagctaatttttttttttttgagacagaatcttgctaatttttgtatttttagtagagacggggtttcaccatgttggccaggctggtctcaaactcctgacctcaggtgatccacccacctcggcctcccaaagtgttgggattacaggcgtgagccaccacgcccggcctaaagtgggttttgataaggcagatggtagttctggatgccacagcaatgtctgctgaggtatcctaggaaggcactctcggcttcggagcccagtacatccatgaagaggacaggtttgggaaggaagagctgtttaggtgggaaggtcggggaagtcctttctcataaagtaaattaacattattatatattttcttcttttctttttatggtggtaaaatggatgtcacttttaccatttttaccatttctatgtggcattaagtacattcataagtgtattttcctttttaaagatggggccttgctctgtggcccaggctggagtgctgtggtgtgatcatagtgccctgtagccttgaactcttgggctcaagcgatcctcctgcctcagccttccaagtagctgggactacagatgtgtgccaccatgcctggctaaggtttttttttttttttttaacttaaatttaattttttgggctgttgtggtggctcacgcctataatcccaggacttagggaggccaaggcaggaggatcacttgaggtcaggagttcgagactagcccagccaacatgatgaaacccatctctactaaaaacacaaaaattagccaggtagccaggcatggtggcatgtacctgtaatcccagctactcgggaggctgaggcaggagaattgcttgaactcgggaggcggaggttgcagtgagccaagatcgtgacactgcactccagcctgggtgacacagtgagatttgtctcaaaaaaaaatttttttttaaaattttttttgtagagatgaggtttcactacattgcccaggctggtctcaaactcctggcctcaaatgatcttccaccctgtagctgggactataggcggcaccatcactcctggataacattttgattttttgtagagattagagactactctaatgctgttagggaattagcaatggactacaggctatttatggcacggcacctgctcgtaagtgtgattttttttttttttttttttttactgtagtctattgctagttctctaataatgttggtactgctgtctatagactattcccttgccaaccacggtgccaatgcccttacccgtgctgtcatttagtcctccagaatttggctggtagatgttactgtcccattttatggatgcaaaaactaatagcagagaggattcagacccctgacattgagttgatgccaaagccacagtgactttgcacagtgcctttcaaagtaagagctgagggaaagctcccagggaaagctcctttctctaatcaccggccttgttggatgttctgagggctcagacttggtgtctgctgaggtttctgaatctgtatcaatcagagtggacttgagacaggtgcgtcatttcatttagactgtttttcttcttgtccctcacaagttttgcatctcatagtgaaaaaggagtaaatgctaacatgctagctgtaattcttttttttttttttttttgagatggagtctcgctctgccacccaggctgcagtggcacaatcttggctcattgcaacctctacctcctggcctcaagcgattctcctgcctcagcctcccgagtagctgcgattacaggcatgcatcaccatgtccggctaatttttgtatttttagtagagacagggtgttgccatgctggccaggctggtctcaaactcctgacatcaagtgatccacccacatcaacttcccaaagtgctgggattataggcatgagccactgcgcctggactgtaattcttgtctttatgataaactcccttttaagtaaaaaacctcagagaagtcacacggtcacagggtggacactgtacctgagagaacgcagacacaaacatgtaaaatttctgatggacaccctgtcaaaaacgaaacacaattcttgtcaattacaatgtgagtcaaggccacaatttgattgattggaacagaaggtatgcacagctatttgataactcgccttttgaatgaaatgtactggtgcacaaaatgcagggctgctcttgatggtaggaaacctaattttctgattattttctcttaaactgattgctgttttgcagctaagcgtgtgtcactgagaaccgaatctctaggccaacctctaaacagagaggatgaagaaatggacaaagagatttcagaaaaactcccttccaaagtaagcatggctctttgtccttgttggtggggtaatggggacccttgatgccctctaggattcagggtaactgacatagccccatccaagggatttatcatgttggaatggaaattataggatcccaaggccaccctcagattcagtgattggctggaaggactcacaggacccagaaaatctgttatattcatagttatagtttattacagggaaaggatgcaaattagactcagcaaaaaaaggaaaaaacgtgcacaggacagagaccagcagaaaataggcacaagcttccatctgttccctcccaatggagtttcatggatagcacttaattctcctggtagctatgagtgacaacatgcatgaagtattgccaaccagagaggctcacctgagccttgctgtctggggtttttaatggggatcagtcacacaggcatggagcatccacgtggctgaccttagttactcagctccccttcatctccagccctcaccaccaccctagaggttgaactgatcctgtatgactggggccccagcaaacaaaaacaggcattcaccaaactcgcattgttagcatacaccttcaggcatggcccaaggctacaggtacacaaagactcccatattaggaagggtattccaaaagcttggaagttgtcaccctaagagccgaaggccggttctgaagacgtttggcatgtgtggggtttggacaacacagacctgctaaatgaaccctgttctgtgaaaaccccaaggttggagtttaaggctaggatgtaagcattcagcctggcctatgcttaccaaaatcgtgcttcattgcttcataagtacgtcccatctgcaaaacaaaattcaagctccatctggacctttgccaggtcagtttgtttaggtgttgctgtactggttggtcaatagaggagtcaggctgacagctcagagtctgggtgcatttagctcctgtgtttggctggtacccactgtgtggctgtggctacattgtcagaacatgagaccagccattgtgttgagaggagagcttaggtgtacttgaatattaggttctttaggtgaatggatgtatcacaagaatgaatggtttttgttccccatgtttcagagaactgcgaagcacatcatggaaaagatgcatctccacatgctctgtacccctcttcccgaggagttcctggaccaaaacgtggtgtttttcctcagaaataccaaaggtacatttctggcacgtgtgtgtgtatgtgtgttgagggggtgtggttgtgcatgcacttgttcactctcattctgttgtctttttatggttatctttcacctatgccaagctctctttcttttccatactgtactgggttcttacgtagtcttctcaaagctaatttccagtaaagaagtgttagagataaagaaatgtattcagccagtgatagtgcatgtctgcacatatttggagaaggtgtgaagactgaaacttgtgaaataatggcttcagtgggcatatttcttgtgtctcttttgtttcccagttagatcaagggaagagtccaagtaacctttaaaatgtttaccatggtgattgatttttggtcaggtagagcaaatacatatcaaataaaaccttgtttgttggaagggtagatattaccaagtaggtcttttcaaacaacccatgactcaaaatatgctttggcaatgaattgaggaagacttgctggggagtgaagacaggcaaagcccatgcccaagccagcttggatggttgtaacaaattgccataggctggggggcttcaccaacaaacatctatttctcacagctctggaggctgggaagtccaaatcaaggtgctggcagatctggcatctggtgagggccacttcctggttcacagatggcaccttctcctatcctcccatggtggagagcagagagagagagagcaagctctcctgtctcttcctatagggacaccaatccaatcgtgagactccaccctcatgacctaatcacctaccaaaggccccaccttctaataccttcaccttggggatttaagcttcaacatgtggattttggggtcattcagtccatagcagcaaagaatccagccaacatttctagacaacccaaataatttctgattttgtccagcgttagatactccaaccagatcagcaaatgtgtgcagctcttgtgcactgttcatactaatccacgaaccacagtgcattggtatccatttcagcttctcatgggccctcagatttgtttaaacacaaataggggatattctgaatctgtaaccagaacattccttgtagcagcttgggaagaaggagaagattcctgttctcttggaaatgttaactgttggctgctctctcccactgaccttacattctacacctgttcttctttagaggcaatctctgaagctaccgacatgaaggaagctatggaaattatgccagaaacactggagtatggaattataaacgctaatgtgctccattttctgaagaatattatatgtcaggtaaacatggagaaaggaagaaattctagtatttctaaagttgaggtcatgtggtttgtttattccacaaataggtagcgggcagctcttctgtctcaggtgctgttatgggcactgaggtgctgagaccagctcggttggggagaccctaacccagcggcgctagagaaattaaagacacacacacagaaatataaaggtgtgaagtgggaaatcaggtgtctcacagccttcagagctgagagccgcaaacagagatttacccacatatttattaacagcaaaccagtcattagcattgtttctatagatattaaattaactaaaagtatcccttatgggaaacgaagggatgggccgaattaaagaaataggtgggctagttaactgcagcaggagcatgtccttaaggcataaatcgctcatgctattgcctgtggcttaagaatggctttcagcggttttccaccctgggcgggccaggtgttccttgccctcattcccgtaaacccacaaccttccagcttgggcgttggggccattatggacatgttaccatgctgcagagattttatttatggccagttttggggccagtttgtggccagattttggggtcttgctcccaacactgagggtcaagcagtggacaggacaggcaatggccctgctctccaggagcttatgtaggggaaagacatggcacacaagcacatctatgagaaaataccgacaagtggcatgaggaaaataaaccctgatatgagacagaaataggcatgtgcactgtgtgtgtgcagagggcatggtgaggaatggccttgctgaggatgtgatgtctaagctttcttttttatttttattgtttttcgagacagggtctctccgccatccagtctggagtgcagtggcccaatcacggctcactgcagcctcaactctcaagtgatccttctgcctcagcctcctgagtggctgggattacaggcatacaccaccatgcctggctcatttttgtacttattgtagagacagggtctcaccatgttgcctaggctggtctccaactcctgggctcaaacaatctgcccgccttggcctcccaaagtgctgtgattacaggcatgagccaccatgcttggcctgagctttatagaccaaaaaaatgaaaaactcatcagcaggcctttttcatgaatgataagttattagggaaatgcactagggaaggaaggaagaggtgatattgaactgagacccaaatgaggccaaggcatcagacatgataggatgtggaggaagagcatgctgggcagagagaacagcaggtgcaaaggccctgaggtagaagcagcctcagcttggcccagtagcaggaggatggccactgtggctggagggagggctggaaatgaaggcaggtttaagcaggggaacaacaggatctggtttgcattttacctctggctattgtgggaaaacatattgctggggtggaggggaaggaaagaccaaatagaaagccatggaagagcccaggtggagggctgtattagtccattttcatgctgctgtagggaactgcccataatttataaaggaaagaggctaaattgagtcacagttctgcatggctgtggaggcctcaggaaacttaaaatcatggtggaaggggaagcaaacacatccttcttcatatgacggcaggaaggagaagtgctgagcaaagagggaaaagccgcttataaaaccatcagatctcatgagaactcactcactatcatgagaacagtggcatgggggtaacctcccccatcattcaattacctcccaccaggtctctcccatgacacgtggggattatgggaactacaattaaagatgagatttgggtggggacacggccaaaccacatcaagggtgatggttatttaggctccaatcaggggagggagggagaagcagacagtgtgaggaatgccttgaggatcaggccatgggacttgctaatgaccgggatctggaggctttgaagagtatcacaagaatagagagtaccaagaatgactcttggtcccagcactttaggagggtgaggcgggaggatcgcttgaggctaggagtttgagaacagcctgggcgatatagcaaggccccatctctaaaaaaaaatttaaaaaagaatgactcttaggatttgggcctgagaaactgggaggatggtgaagtcattactgagatggaggatggggagaaacagatatggagggaaactcaagtgttgtattttgcattctagacgggaaggttgcagagtatggtggtcatgccactgcactacagcctgggtgacagagagatattccatctctaaaaaaaaaaaaaagaaaaataaattaagataacatcaaaacatgatgtataatgttaagcacaggtggcctcttagacattcaaatcaagacgtgaagcaggatgtatgaatctggagctctgcggggaactcagggcatccgtctagcaaatattcattgagcacctactgtatttcatagcaatgaacaactgagacaaggtctctgcctcgtggagctttcattctagacaggaagatgtacattaaccaagatcaatgagaaaatatatagtgtgttagacagcaacaagagttagggagaaaaatgaagccagataggaaagaaaaaggaaacaagggggagagggaaagttgataggtggaaaggtggggcttttgcaattttagatagggtggccaggaagacttcactgagaagatttggacaaaaaagtccaaaccaacacaatatcctcttttgcttggactatcgcaggagcctccaaaaagatccctcagtttctgttcttaccctctacgctgccttctccacatgccaaccagagtgatgctttaaaacatgggcatcatcagcacagagatggtgtaaaaccaagggactgggtggaacaaccaagggagggagtagagatggaagagatgaggggagaggaaagttaggacgtgggtgatccagaagccaagagaagacaatgcttcactgaagaagggaggggcccgccgtgccacttgctgctggaagtcaagaaggcacaggcaaagaagagctggagggcttggccctgggtgacttccatgtgagcagttctggggatgggagcagacgaggtctcacggagtacaagtcatcctgtgagttaggctgtggggccctccccactgagctgcctgcacacaagggactttctacctgaagacaacctccttcatcgggatgatgtctttttctagtgtgactttggaggactcaagaacattggctaccttcttatttatttatttatttttatttacttatttttgagacagcgtctcattctgccacctaggctggagtgcagtggcgcgagcatggctcactgcagccttaacctcccaggcttaaacgatcctcccacctcagcctcctgagtagctgggaggattactaaaaattagccaggtgcacgccacaatgcctggatgatttttgtattttttttttaaagacggtgtctcagtatgttgccaaggctggtctcaaactcctgggctcaagtgatctgccctcctcggcctcccaaaatgttgggattgcaggcatgagccaccatatctggccacactggctaccttcttatgcaaactgaacttttcattctaaaataacaaaataacatcaaccccatctctaccaaaaagaaaaagaaaaatctgctgggcatggctgtgggtgtctgtagtcccagctactctggaggctgaagtgggaggatcgcttgaacccaggagtttaaggttgcagtgcatggtggtcatgccactgtactacagcctgggtgacagagagatactccatctctaaaaaaaaaaaatgaaaaataaataagatgacatcaaaacatgatgtataattaattcttagtggttatatgcattatgacaaccagtcatgtctaaaggacacagggctcaacttgaagaggctcatgccagccacagatgggatattttgaccttcagtaaggataaaattgcagtgggttgaagcatagaaaatatattcaaatacagccaggcgcagtgactcgtgcctgtaatcccagcactttgggaggccaaggtggatggatcacctgaggtcaggagttcgagaccagcctgatcaatatggcgaaacctccatctctactaaaattacaaaaattagctgggcatggtggcatgcacctgtagtcccagctacttgggaggctgagggaggagaattgcttgaacccaggaggtggaggttgcagtgagctgaggtcatgtcactgcactccagcctgggtgacagaaagagactccatctcaaaaaaaaaagaaaaaaaatatatatgttcaaatgcatgagttaaaaacatttttttaagagacacagttcttactctattgctcaggctatagtgcagtggcacaatcacatctcactgcagcctcaaactcccaggttcaagtgatcctcccatctcagcctccggagtagctgggtctataggtgcacaccactaagactgtctcatttttttttttttgaggcggagtctcactgtgtcgcccagtctggagtgtagtagtgcgatctcagctcactgcaacctctgcctcccgggttcatgccattctcctgcctcagcctcccgagtagctgggactagagagaggcacccgccaccacacctggctaattttttgtatttttagtagagatgggttttcaccatgttagccaggatggtctcgatctcctgacctcgcgattcacccgcctcggcttcccaaagtgctgggattacaggtgtgagccaccgtgcccggcctaatttttttcttttaattgtagagatggggtctccctatgttgccccggctgttctcgaactcctgggctcaagagattttcccgccttggcctctcaaagtgctggattacaggcataagctaccatgcccagcttttcaaatccatgaatttataatgatctttaaaagtcctgatgggtcatttctggaggatgataggggaccactgtactatttcaaaaattgggcaaataaagaggagtcaagcatttatgttgccttccccatatgaaatgtacgggatcatctagcagtagctgtgagaggcgtctttatatcagcatctcagctaataaacagacattttagaacatttcaattttggaacccccacttgattaatggacctgggggtgggggagagagagagagagagaaacaaaaccaaaaccaagaatttgattcctgatggaagatacaccctggtcaagtctctggtcccagctgccaatttgcaggaaatacacatcacagaggaacttcaactgcacagtgagtgtgtagtcagcaaaatttggattgggcagctctacaaatccaacattctgggttcttcagtatgttgcaggaaatacatatagattcaaagagtcataaaaagatgtatcaaaattttaagaaatatagacaaaactaaaaaacaaaaacaaaactcagccaaccaaccaaccaacttaatcaacccacaggcatttatagatcactttttatgtgggctgggggctaagttgtttcgtaattgtattcaggtgacttcataaatgcatgcttctctctctagctacattttgaagaaactatgtcctcaagaacttaattttcaagaacaagatggtcctgagctgatggtttaacacagtttcttacctccctgtgccagtttcccctccctccctccctcctttctctctctctctctctctctctctctttctttctgagacagggtcttgctctatcgcccaggttggagtgcagtggtgcgatctcggctccctgcaaccgccgcctcctggttcaagcaattctcatgcctcagcctcccgagtagcttggaccacaggtgtgcaccaccacacccagctgatttttgtatttttagtagagatggggtttcaccatgttggccaggctggtctcgaactcctgacctcaagtgatccaccagcctcggcctcccaaagtgctgggattacaggcatgagccaccgcagccagctccctgtgccacagtttgtaacttctcagttactggtggtatacagaaataacagcactgtttttggggcagttgtgtcaggcctggttaaaattgatgcccttggatcactttaagtcaaatgtaatctctctgtctttaggtctgtgctccggtttgagtggttttcactttgcatatttgtatctcaatataaaagaatattcaggctgggtgcagtggctcacgcctgtaatcccagcactttgggaggccgggggtggatcatgaggtcaggagatcgagactagcctggccaacatggtgaatccccatctctactaaaaatacaaaaattagctgggtgtgctggtgtgtgcctgtaatcccagccacttgggaggctgaggcaggagaatcgcttgcactggtgaggtggaggttgcagtgagccaagtgcacagcactccagcctggtgacagagtgagactctgtctcaaaaaaaaaaaaaaaaaaaagaatattcaaaaccagaggcaatttgaataaagaatattcaaaaccagaggcaatttgaatacatgaattattgaaaatgacttcatatgatgtatttcataaaattggcatttcaggtttttttgccagcattgtccttcaatcagcacaggacgagtacaaccgtgggagtcacatctggagaagtctctaattcctctgagcatgaatcagacctgccgcccatgcctggggaggcagtagaatatcacagtattcaattaatacgggatgaatttttaatgaacgtgcagaaatttgcaagtaatattcaaagaaccatgcagcaacttgaaggtaaggtttcattttcctcctttttagttaagaatgattaatttactgtagttgggattacaggtgcatgccaccatgcctggctaacttttggaacatttttgtttgtttgttttgtggagacggggtctcactttgtcgctcaggctggcaaaaatcattttagcacaggattttttgttttgagacagagcctcactctgttgcccaggctggagtgcagtggtgagatctcggttcactgcaacctccgccccctgggttcaagggattctcctgcctcagccccccgagtagctgggactacaggtgtgcaccaccacacctagctaatttttgtatttttaatagagacggggttttaccatgttggccaggctggtcttaaactcctgacttcaagtgatccacctaccttggcctctcagagtgctggggttacaggtgtgagccactgtgcccagcctagcacaggatttttgaatacatttttcttcattgttttctagtagtcaacatccagtgatgagaaactgaatgttcttctaatttttctcccctccccctttacgtaagcttttaagagcatctggttatccctagtgttttggtgttaggatgatgggcctttgtgtggaattttttccattgattttttaaacactcagtgggtgttttcagtccaaagactgaaaaatcatcttgacgttttcctccactatttgttttctcttgctgaaattcctgctggatggatgtctagagattctatttcttatcttttctcttgtatttttcatctttttgtctttgtattctttcctggagtgttcttcaacttctatgttaccaacgtttgattgatagtcatatcagctattatatttttaatttttaagacctctgattctctgattgtatcttttttcatagcatcctgttcttgtttgatggatgctatatgtctcaaatctctgagacaaatagttgggctttccttttggaaatgttctccttttgccctgccctgcctcccctcccctcccctcccctccccttctctcccctccccttcccttttctttcttttctttcctttctttctttctttcttttttttttttttttttgacaaggtctcactctgccgcccaggctggagtgcagtggcacaaacatagctcactgcagtctcaaccttctgggagctcaggcaatcctcccacctcagtctcccaagtagctgggattataggcacacaccaccatgcctagctaatttttgtatttttagcagagagggagttttgccacattggccaggctggtctcgaactcctgactgcaagtgatcttcctgccttggtctctcaaagtgttgagattacaggtgtgagccatcgtgcctggcctgttctccttttctttacattatttcaatttcccctgatgtcatttttcccctgatttatctttgactgactgtttcaggctggtggttatctaaaatgtctgctggctctttgttcaagtttttaaaaattgaagtcactaggttataaactcaggaacatcttaaataactaaatcattttgatcaagcttaacaccggaacaattatctaaaatgtttgaattacattctaatgaaagagaatgagatacagatattatcaggacaggggatgcgtcagaccttattatactgatgaagcttgagagacgacccagccggtgaacttgaatgtttctctttgtaatcatttttcctgaacgaatgactgactgatcacttttattttcctaggtgagatcaagttagaaatgccaatcatcagtgtggagggagaggtgtctgacctggcagctgacccggaaaccgttgacatcttggagcagtgtgtgataaactggctgaatcagatatccacagcggttgaggcccaactgaagaagacacctcaggtagtttgtgcagggctttcagagagccccgatccaggtcatgcttaccatgctgggaaagagcccggagtctggggtctgcatcatctggcatcttttcttactgttttatgacttccttaagccatcaaaataaacacacccaaaatatcatttctgggctttctgatgttaatgtgctaccaggttactgcctggattgataaagataacactttggatcagtcaggaagcttgggctgccaaaaacaggaaacccaactcaagtcgatcaactaagaaagcaaattccttggctcacataatggaaaagtccagaggcagggttggcttcaggtccagtctgatcagggctctggctatatttctgaatctctcagttctagacccctttctaggggctggagagcttcattcctcaggctggcttccttgcagcagtttctggcctcacattctgtacacctcagttgtccggagaaaggcagagtgtgtttctagcattctcagctggagccctgagattcactatgattggaccacccagggtcaagagcccacccctgaagaccctgaaggattggagcagttggacagaaagaacggatgctggagaaaccaccataagtgtctgctccaccctaataatgagagttctttgtgtgttcatttcacctctcagggtaaaggccctctggctgaaattgaattctggagggaaagaaatgcaaccttaagtgcgctgcatgaacaaacaaagcttccaatagtcagaaaagtcttggatgtgatcaaggaatccgactccatgcttgtggctaatctgcagccagtgttcaccgagttattcaagttccacacggaggcctcagacaatgtgcgctttctctccaccgtggagcgttatttcaaggtatgctgggtgtgctgcactttgcagtcagctctgtcaaagagatttcatatgatttaatttcccttttaaaaatgttcagcatttggccaggagcagtggctcatgcctgtaatcccagcactttgggaggctgaggtgggcagatcgcttgagctcaggagttggaaaccagcctggccaacatggtaaaaccctgtctctccaaaaaatacaaaaattagctgggtatggtggtgtgcacctgtagttccagctactcaggaggctgaggtggaaggattgcttgagcctgggagatggaggttgcagtgagccaagattgcgccactacactccagcctgggcaacatagcgagaccctgtctcaaaaaaaacctcagaatttaaaaaattgtgataaaatagacatgacatgatattatcattttaaccactattaagcatacagttcagtggcactaaatacatacacaatgctgtgtgtccattacactatttccaaaacagtttcatcttcccaaactggaattctgtgtccattaaacactaactcccccttcttccttaccctaagtccctggtaacttctgttctgctttctgtctttgtaaatctgactactctagggacttcatataaggggagtcatgcaggactgatcctgtgtgcagtctctttcactcagcaccaggttttcaaggttcacctgtgttgtagcgtggagcgtgttagtgtttcactcctttctgtggcagaatcatattccatagcatggatagactacatttggtttctctattcatcagtcggtgggcatttgagttgtttctgcattttggctattatgaagaatgctgctacgaacattcttgtacaaggatttgtgtggatgtgtgtttttaattattcatgtattatgcataggagtggaatagctgggtcatatatggtaactgtttaacctcttgaggaatttctagactgttttccaaagtggttgtcccattttacattctgaagagcaatacacgaaggttctggtttttccgtatcttcaccaccacttgttatcgtctttctgataatagccattgtggtttaatttgcatttccttaacaactagtgagactgaacaactttttatgtacttaatgtgcttattgtcaatttcatattgttggtgaaatgtctgttttaatcttttgcccgttatttatttgagttattattataagagattaaaaaaagtctgctcacctgggcaacatagtgcgacctcatctctacaaaaataaaaataaaaaattagccggtgtagtggtgcatgcctgtattctcagcttacttgggaggctgaggtgggaggatcacttgagtccgcaggggagtcgaggctgcagtaagccatgtttgtgccattgcactccagcctgggcaccagacttggtctcaaggaaaaaaaaaaaaaaaaaagagtgaaacttcttgcatgcttactgttttatgaaactatttggaccccaaggctaagggctcttgcgtggctctctcctctcttggtcagaacataacgcacgggtctggcttccacgtggtcctggacaccatccccgccatgatgagtgccctgcggatggtgtggatcatctcccgacactacaacaaagacgagaggatgattccgctcatggagcgcatcgcctgggaaatcgctgagagagtctgccgagtggtcaacctgcggactttgttcaagtaagaagccatggcgttcatttttttgttttgttttgtttcactttttactttttagatcttaaacagctctattgagctataattcacatataattctcttacttaaaatgtacaattcactggctcttatggctgggcacagtggtgcacacctgtaatcccagcactttgggaggccgaggtggcggattgcttgaggccagaagttcgagaccagcctggccaacatggtgaaaccccatgcgtggtgggctgtaatcccagcttcatggaagtctgaagcatgagaattgcttgaacctgggaggcggaggttgcagtgagtggagatcacaccattacattccaacctgggcgacacagcgagattctgtctcaaaaaaaaaaaaagtacaattcattttttttttttttagtatattcacagaattgtgcagccgtaaccactatcaatgttagaacatgttcttcatccctcaaaagaaaacgtgtgccttttagcagtcagtcctcgcctctccccaattgcccaagtcctgggaaccatacagcgtgctgtcttttgcatataaatggaatcagacactatgtgacttttatcactgacttctttcacttagcagcatgttttcaaggttcatccacatcgtagtatggatcagtgcttcattcctttttatggctaaatcatattccattgtatggagatatattttgtttcagatacatatatgtgtgtgtgcacacacatatatctacatgaaattttgttttaactgcaatgttcttccccagttgtacctggagagactgaggctgaggtggaaccacctttgagggtgtagggagatgatggaggatgctaagggagacagataacttttttcactttcttaaaaaatatctatatagatgaggccgggtgcggtggctcacgcctgtaattccagcactttgggaggccaaggcaggcggatcacttgaggtcaggagttcaagaccagcctggccaacatggtgaaatcctgtctcaactgaaagtacacagaattagccgggtgtggtggtgggcgcctgtaatcccagccactcaggaggctgaggcaggagaatcgcttgaacccaggaagtggaggttgcagtgagccgagattgcacctgtctatatctgtatctatatcatcatctagcgatctatctagatagacagatctatctggatatctatgtagatctatctatatgtatctagatagatatctatatttatccatatctatacataggtatctatgtctatatccatctatacagataggtatctatgtctatctatgtatatgtatttatatagatagcatataaatggaatcagacactatatgactttttgttatctatagatagatatctatatctatatgtatccatatctatttatatacatctctctctctctctctatctacctgcatagctagatctccatttctgtctatttgcataggtgaagtaggtacccaaatggaggcattgtcctgcgccgtgttgcagctgccgctgttgacctctggcctggggccaaggccacctgccccttctggtgtagggagcgaggtcaccaggtagccccagccctgcacgcaggttggcggctgcaacggaaacctcgcagcttgggactcccgcccttgcacatgggacagggcagccgcttgcccgctctgccttttccgatgaggccgtgaaaccagggggggcgcccgggtcagagcttcacgggacactggctccccagccggggagtgcggctcggacccggagctccgccctcctcccatcacggcatctcttggcttcgcagagaaaatcgagcgagtgcccaaagcaaaaccttggaagccaggaacaccctcaggctgtggaaaaaggcctattttgacacccgggccaagatagaggcttcggggagggaagatcggtgggagtttgaccggaagcggctgttcgagaggacggattatatggccaccatctgccaggacctctccgacgttctgcaggtaggggctgggcgaaggccggcggaatttgccccgaagaaggcagttggcttttgacagtggccccctccgtgtcaggtaggagctgggcgtcagaaagggcctggcagggagaagcccttcaaagaaagaacctacggaatatactagaatgtaccagaatggaccagagtacaccagagctttgcgactttttgttgctttctctgacattcttccctctccctgctttttggctttcctttgacctctttggccactccttctctgtgtcttttgcaaagctcccttcctctgccttccccttaagtattggaatccctcaagaggccagtctgagacctctcttcactctccctcagccaggcccagtcttcccagagctccacggatggacaaagtgcctagtggctgattgaattagccacagcacttgtctcctaaaggttcacccaccccttcattctaaatgcattcacggagaactcacggtgtgccgggtactcagatgtcttaatgctagaggaaccatagtgagtacaaagcaggtccggctgcggtgtggcagtgcccagcccgagagggaggtgatgccctgtgctcaaagacaggaaaaaaaaatgctgtaaaaagaattcaaacaggccaggcatgatggctcacacctgtaatcccagcactttttgaggctggggtgggaggatcccttgaacccaggaatttgagactggcctgggcaacatagcaagaccctgtctattgaaaatacaaaaattagccaggtgtggtggtgcacacgtgtagtcccagccactcagaaggctgaggtggcacgttggcttgagcctgggaggttgaggcgcagtgagccgtggtcacgccagtgtaccccagcctgggcgacagagtgagaccttgcttcaaaaaaaaaaaaaaaaaaagaattaaaaatataaagctttttcggctagatgcggtggctcacgcctgtaatcccagcactttgggaggccaaggtgggcggatcacgaggtcaggagttcaagactagactgaccaacatggtgaaaccctgtctctatgaaaaatacaaaaattagctgggcgtggtggcgggcgcctgtaatcccagctatttgggaggctgaggcaggagaattgcttgaacctgggaggtggaggttgcagtgagctattgtgccactgcactccagcctgggtgacagagcaagactctgtcccaaaacaaaaacaaaaaatatttaacttctatgtggaatcaccgtagctagtgtgtgcatgggtatttcattgttaccagaacagtggaaacgctgcatagaactacctcagtggtttatcatctcacctctttgtgtgtgtgtgtgtgtgtgcatgtgagacagagtctcgctctgtcacccaggctggagtgcagtggtgcgatcttggctaactgcaacctctgccttccgggttgaagtgattctcctgcctcagcctcctgagtagctgggattacaggcatgcaccaccacacccggctaatttttgtatttttagcagagacagggtttcgccatgtttgccaggcttgtcttgaactcctggcctcaagtgatccgcccccctcagcctccctgaagcactttcaactgcaagtgcaaaggtcctgaggcagaaagggacatggccttggaggagggtgggggtggctgcaatgtggggaggaacaggcaggtgcagacctggatcttatcctatgtgccttgggcatcgtaccgaagggcttagtccgggaggaggttactgtgtgacatgattcttgcccccaggtcagtctcgatatgctatccatttgtagttctaatattcacaggaaaacccaaatgtaatctcctcattgttccgtttgattggacagattttggaggaattttataacatatttggtccagaactaaaggcagtgacgggggaccccaagcgcattgatgatgtcctatgcagagtggacggcctagtcacccccatggaaaacctgacctttgaccccttcagcatcaagtcctcccagttctggaaatatgtgatggatgaattcaagattgaagttctggcaagtgacacgtccattgagtccatcttgggagtcgacaccatgttttctctgtgttaaatttgttgggttatttagtgatgcttagtctttttttttaaatcacaagtaatacctgcttattaattataaaaaacaaaaacaatgcagaagtgcataaggtaaaaatgaacattcctccatcttctttgtcctcacacccattctccaggtgggataagtttaagttgagctagacacagtagcatttctacaaagttttgtccaatataagttcacctatctaggagtgaagttaaaagtaaaccagatatggcaagagaatcacaaagcgccctgtgagtttttgagaattgcgttttgtcagaaggcgggggcatggagagctgattggaaacaacctttgggattgaggaagatttggatgggggaaatggggacgaggaaggaggctgagacagcggagggggtttcaggtgggaagaacagtgtgaatgaaggtgacagacatgagaaaaacaggaattgtctgaggcagagcaaacagaggggtttggcataacacatatgggtagtagagggaaatcaagctagaaaggtgggttgggtaaataattggtgatgaacaaagaggacaggagtgaggaaggagacttacttcagtaggcaagagggtgccattgaaggtggttgaccaaggaatgatatagccagaattataggtcgggtgtagcggctcatgcctgtcatgccaacactttgggaggccgaggagagaggactgcttgaacccaggagtttgagaccagcctgggcaacctagtgagatgcccatctctacaaaaaactttaaaaaattagccaggcatggtggcttcttcctgtagtcccagctactcaggagctgaggtgggaggatcccttcaacctgggaggctgaggtcacagtgagctggctgagatcacaccactgtactgcagcctgggggacagagtaagactctgtctcaaaaaaaacccaaaaaacaaaaacgtgaaaaaaaatcaaggtttatacttcaggaagatttttctggctacagtataggctgctttggactggggaacaacagagagtggggagatgatacaggaggtgatagcctgaggtgcggggaggcagagtccatcagagagaggctgcagctgagaatcagatttcacttcccacagtatgaagagtgacccattgcgctcaccttttcagtctcatgcaggaagcgtaattaggagcatccccatttatgtcttacacagttgtttttataacctcacagcatctttttatatgcacaaccctagacagttctacttggttatatagacattgccatgttaactatatctaatttattattagctgctattttaagtgttacttgctttttcagttgaacctttttttggttttcttttattattttttattttttagggacagggtcttgctctgttgctcaggctaaagtgcagtggtgtgatcctggctcactgcagcttcaaccttctgggctcaagtgatccttccgcctcagcctaccgagtagttgggaccacaagcatgtgtctggctaatttttaaaatttttaagtagagatgaggtctcactctgttgcccaggttggtcttgaactcctggcctcaagtgatcctcctacctcagcttcccaaataaattgaacttttcatcaaagtcacttaatcaagtgatactaaaggattcataataagaaaaaacagctccatgcttaactccttcctcattcttgctgtcattttccacaattttagatgtttcttttgttgttaacccctatatttttttaagaacaagccgatgtggttattttctgatttattaatttagacttctgttaacttctcagagtagatacaggctggactgtcccattcctaatcccatttgcctctctgtcatctaacacagtttcttcataacttttagttaaattaatgactagtgtttacttattatgtctatgcaaatattgttcattgctgagctgggaagaccatcataactacaatacctttcttggccaaccttcagttttcctggagttaataattgcttttgttttttatttgcctggttatttatgtacccattgttaattttttccaacttctctaatatctctgccacatacctatcaacaatagcctctaaatacttaaacatatcagtgccattatttacctagaggccttcctcccagagctcattgtcctcctactctagcttgtttaccttttttttcctttgtcctttttttttttttttttttttttttgagacagagtttcgctcttgttgcccaggctggagtgtaatggcgtgatcttggctgactgcaacctctgcctcctgggttcaagcaattctcttgccttggccttctgagtagctggggttacaggtgtgtgccaccacacccagctaatttttgtgttttttagtagagacagagtttcgccatgttggccaggctggtcttgaacttctgacttcaagtgatccgcctgcctcagcctctgaaagtgctgggattacaggcatgagccaccacacccggccagcttgtttgctttttgagcctgttacaaagcagtctaggaccctaggacttcctatcttctctcatctgtgttggattttcaattttctagatctcacctcttcctctttccttgtttactccttcgttttgctggagcacatttagtagcttcctaagtaaggtttcatgagacatatattttgtgagtcttatatgtatgaattctgaaataacaggtatagaatccaaggttgaaaatcacctttctttagaaatttgaagtttttaaaattgatttctagcttccaatattagaagtctgatgttattcttgagttaatttttctagaactaaccttccactcttttatagaatggagtgggggtgggagggattgaggctgcagagtggcctggctgtgcaaggtgagaaagggattccctgtttgcccctcaccttcatgcacactgactcccttcctgggcccagtgcctccaaatgctaagccttctggagtttcttcaaggaacaaacagggactcacttgcgccccctattttcagcattaggttgtaactacctgccttagttactgtctttttttttttttttggaatggagtctcgctctgtcgcccaggctggagtgcagtggcgccatctcggctcactacagtctccacctcctgggttcacaccgttctcctgactcagcctccagagtacctgggactacaggcgcccaccaccatgcccggctaattttttgtattgttagtagagacggggtttcaccgtgttagccaggatggtctcgatctcctgacctcgtgatctgcccgtctcggcctcccaaagtactgggattacaggtgtgaggcactgcgcctggccctgccttcattactttcttactaaaaattcctgaactatttcctctgttgttgtgtcctctcctgcattttttgtttatatgagttaatactttaaaaaattcctttacctttgaactggttggggagagagatcaggaaatcaacatagccaatctcccactttaaattggataccagtttccattacttatgccatagaaatctgtcccaaaccactgattttttttttcttatttcttgccactttattttggcaggataattacaggggcatgagggttgttttgttgatttttttgcaggttattgagaaagaagcaaaacattttattgatgaatcttttaagacgcttcgatctgctgaagcagcatttgacatgcttttaaaatttaagcacattcgttcacgggaggctgttaatcgacaaatgatgatgaaatttaatgatattcttgcacagtactgtaaagaggtaattgaaaaatcgatagctgccatagcattaaaaatacacttggcaaaatgtgaacaattgaatcccactattgtctgtctttcccatctgaattcagagaaactagaattttcccaaattagcatgttacgtaatacacgtaacccgaacaaagtgggtttgtttatttagtggagaaattcaataagaattaagtatattatgatttactcacattgtggtgggccctgtgtgggttagtaataatcatggtagtaatagtaatcatagttaaccatgtccaaggatcatatatgtatttataattaactcagaacaatttatctggtgctcacatatctcaagtatggtgttaggcacagagatagagagatgaacaaaacgtggattctgcttttaaagaagtcagtatctagttggagaaatagaccaaaaaatgcttataatctgctgggcacagtgactcatgcctgtaatcctagcactttgggaggccgaggccagcggattgcttgagttcaggagtttgagaccagcctaggcaacatagcaaaactccatctctacaaaaaatatgaaaattatcctggtgtggtggcgcacacctatggtctcagctacttgggaggcagaggtgggagaatcacctgggccaatggaggttgaggctgcagtgagccatgatcttgccactgtactccagcctgggcaacagagtgaaaccctgtctaaaaaaaaaaaaaaaatgctggccagtcgctgtgactcatgcctgtaatctcagcacttggggaggccgaggcaggtggatcacctgaggtcaggagttcgagaccagcctttgccaacatggtgaaaccccctctttactaaaaatacaaaaattagccaggcgtggtggtggtgtctgtaatcccagctactcaggaggctgaggcaggtgagtcgcttgaacccgggaagtggaggttgcagtgagctgagatcgcgcgattgcactccagcctgggcgacgagtgaaacttcgtctcaaaaaaaaaaaaaaaagaaaaaagaaaaaaatgcttataatcttatgtagaagacaaaatgagaatatgtggaatgattaggtgagcataaggtagtataaaaaaaggcctaaggtggtctcctgatgtcttagtttcccaatgctgctggaactaatgaccacagatgcagtgacttagaacaacacagatttattctcttatggtactggaggtcagaagtttgccacgggtgtccctgggtttaaatcgaggtgtgagcagggctgtgttcccttcgggagtctctagggatgattcagtgctttgctttccccaaattctagaagttcctggttccctttcatcttcaaagccagtggtggccactttcacttcagatcactctgacctccttttctgcctcctccttcctgttttaggacccttgtgattacatagaacctccccagaaaattcaggataatttatctattttaagatcagctgactgacaacattaattccatctgcaaccataattcccctttgtcatgtaacattacatattttcagcttctggggattaggacgtggacatctttgggaggcgaggccatcattgtgcctgccacacctaattacccccacgagagctcagacatgcttcttttaaaaacacagttctggtgactgtagtcaataacctaattatacatctaaaagtaactaaaagagtataattggattgtttttataacacaaaggataagtgcttgaggggatggacaccccattctccatgatgtggttattatgcatagcatgtttatatcaaaacgtgccctatagcccatgaatatgtatactttacctgcaaaaactaaaaactaaaaattaaaaaaaaaccaaaggtctgccactgtggtcatgtctagaacagatttccggatttctgataattggatcaagccaatatacacagtgtgcatgctctgtaattgtaaggcaatttggagcattgcatatgttgaagaaaagattactacagccgggctcggtggctcacgcctgtcctcgcagcactttgggaccctgaggtgggcagatcacctgaggtcaggagtttgatacctgcctggacaacatggggaaacaccatttctaccaaaaatacaaaaattagctgggcatagtggtgggcgcctgtaatcccagctacttgggaggctgaggcaagagaatcacttgagcctgggaggcggagttttcagtgagccgagatcatgccactgcactccagcctgggcaacagcgcaagactctgcctcaacaacaacaacaacaaaaagattactacagagcataagaaaaagtagtaaataataagtaaacagtgaaaacactattctgcatcttagaatattttttgacattccacttttggtttccttaaagattcaaatctcatctttcttggctaacctggcgatgtttatcacttacagaagctgtttgattgcttttcagattgacatcattaataaaatctttgtccagaaccttgaaaatccaccactgtataagaatcaccctccagtagcaggtgcaatatactgggaacgatctctgttctttcggattaagcataccatcctccgatttcaagaggtacaagagatactggacagtgatcgaggacaggaggtatgttgctcttgctagaattggctccttttgtatttgattttttttttttttttgagatggagtctcgctctgtcgcccaggctggagtgcagtggcgcaatctcggctcactgcaacctccgcctcccaggttcaagcgattctcttgcctcagcctcccaagtagctgggactacaggcatgtgccaccacgtccggctaatttttttgtatttttagtagaggtgggattttaccgtgttagccaggatggtctggatttcctgacctcgtgatctgcccacctgggcctcccaaagtgctgggattacaggcgtaagccatagcacccggccctgtatttaatgttttaatcctagactggctgccctccccgatcccatccaggagaagcattagatcaggctgctgccgccatgcagcacgctatgtagagtggcccatttgagaagcagctcaatttcagacccatgcctgtgagttagagggtctttctgttgtccttgcattcatgctcatagtaaactgccttttgcgttccttctttttcttttctttttcttttttttttttttaagacaaggtcttgctgtgttgcccaggctggagtgcagtggcacaatcacagctcactgcagccttgaccttctgggtttaagcgatcctcctgcctcagcctcccgagtagcggggcctacaggtgtgggccaccacgcctggcccatttttgtattttttgtagagatgaggttgcaccatgttgcctgcccaggctggtctcaaactcctgagctcaagcaatctgtccacctcggcctcccaaagtgttgggcttacaggcgtgagccactgcacctggcctgtgttctttctctttggcatcttaatacagaagacatcttccagaatgtggtcatgtgggcttcttcctgtattgaattttcagcttctttggaggatgcctaccatcttttcgatatgatctcaccccccacccatggatttttatatgttatatagcagaggctggtaagccatttctttgaagatcccgatagtaaatattttaggggtttggacaatttctctgcaacgactcaacctgtcgttgctgcaataaagtatcccccagataatacgttttgaacaggcgtggctgtgtccaataaaactttatttatggatgctgaatttgaatttcatatctttttcttgagttacaaagcattattattcttttgatttctttttaatcatctaaatcatttccttctcttcatgtaaaagctgttcttagttcatgggtagagaccaaggcagttcatggactgtggtttgcagaaggctgccagtcaacctagatttcaagttatcaactatattagtccattttgctataaagaaactgggtaatttataagaaaagaggtttaattggctcacagttctgcaggctgtacaggtagcatagccttcctgggaggtcccaggaaactcccaatcatggtggaaggcaaagtgggggcaggtacctcacacagtgggagcaggagcaagagagagtgaaggggcaggtgctgcccactttcacttgagcagatctcccaagaactcactcagcatcaccaggacagtcccaagagaggtggtgcaaaccattcacgagaattccgccttcgtgatccagttgcctcccagcaggccccacctccaacactggggattacaatgcagtatgagatttgggaggacagagatctgtgctatatcaccatcgcagaccaactctccaagctttgggaaaatctattgacttcctttttcaaaatgtgtttatatctaatactattttatattatattatttaatattatataactatatattatttattatattaacatttttatttattatatttataatgtatgtatacaaaattatgtagaaagatatgaaaaaatgtttatatataattatataaaaatgaccaggtgcagtggctcacacctgtaatcccagcactttgaaaggccgaggtgggcagatcacctgaggtcaggagttcaagaccagcctggccaacatggtgaaaccctgtctctactaaaatacaaaaattagctgggtgtggtggcatgtgcctgtaatcctagctacttgggaggctgaggcaggagaatcgcttgagcccgggaggcgaaggatgtagtgagctgagatcgcgctactacactccagcctgggcgacagagtgagactccgtctccaaaaaaaaaaaaaaaaaattatataatgtttataataatttatatattatatttataatttgtataaattatctgtgtagagcgagatgaaaaatgttattttcaaggacaaaatgacggttgcttgaattctttgataggtcaaacaaaaatatttggaagtaggtaggacaatgaaggagtatgaagacagaaagtatgagcagtggatggaggtgacggagcaggtgctgccagctctcatgaagaagagccttttgaccaaggtgcgctgcccacgccctcattcccgattgccgcgtgagacgatggcgtctgccacattttctcaaggcttgatttgttgacattcatgaagttgggtcagtttccagaatcaaagacaaggaagggctaggggaggaggagaaaggaaagagtggagatggcacgatgccatggctaggacgcgggctggaaacgggcagccctactgacttcttgggcaagtggctgaataccaagcctccgtttccccatttatgaaatgcgttttataaatcagatgatgtagacaagcaaagggttggttgaatcatatatgaaacagagctgacagctggccatctttaacctgcagaaaaatgccattccacctgattcatcctcttcttcagctctgggccccgcacttggtgaatgctcgataaacgaacacctgccgttagggaggaaagatgcagcctggcagttttaggtctttggttcctgaaatcctgacgtagggaccaaagcaagtggagagggccaggtgggacccctagggaacaggtgggctcagatccgaccaaagaggcaactgctccatgtcagattttccagtgtttcaagggaaggcagaaggaatttttaggtgaaattgctccattttcaaatgccggcaactgaattgattcttcaaaatctccgttcaccaaacaaaatacatattccagccagttccagccagcacccccgtctggtgaagggcccagtgttgatctttttcatgttcacttttggtgtgggttgtgttgatccaactgtctcttggactgccctggccgcgctgatggaatgtctcttccacagtcttccatcgccacagaggagccttcgactttagaaaggggagctgtttttgcaatcaacttttcaccggctctcagagagattattaatgaaacaaagtacttagagcagctggggttcactgtccctgaattagcaagaaatgttgctctccaggaagacaaattccttaggtaaaaaaattcttcttttaaattagcagtaagctttttgttcttgggacccctttacgctcttaaaaattattgaggacccctccaaaagctttcatttttgtggattttataattatgaattcttaccacattagaaattgaagctaaggcctgggcgttgtggtgctacctgtagtctcagctacttgggaggcttaggtgggaggattccttgaacctgggagattgaggctgcagtgaaccgtgattgctctatctccagcctgggagacagagcgagagcctgtatccaaaaaaaaaaaaagaagaaaaaaaaattgaagctaagaaaagtttaaaatatggggttgggtgtggtggctcacgcctgtaatcccagtactttgggaggccgaggcgggcagatcatgaggtcaggagttcaagaccagcctggccagcatggtgaaaccccatctctactaaaactacaaaaattagctgggcatggtggctcatgcctgtagtctcagctacttgggaggctgaggcaggagaattgcctgaacctggcaggcagaggttgcagtgagccgagatcgtgccactgcactccagcctaggcgacagagcgagactccatctcaaaaaaaaaaagaaaagtttaaaatagggatcaacaatagtaaacctatttcatgtaatataaataacatctttaatgagaagtaaccaatattttccaaaaaagaaagttaatgagaagagtgatgttttaaatttctgcaaatctcttgatcaaggttggtcttgattgagaccacggtcttttgtaatctcttgaccgcaaaagcttttgatgagcttaaaggtgctctcctcaggtttatgacattcctgtcatgtgcaggtacacagctgggatacagcgcatgttggatcattatcacatgctcataggaacgttaaacgatgcggagtctgtgcttctcaaagatcattcccaggaactgctccgagtgtttaggtcgggatataagaggttgaactggaactcactaggtaacgtcattcatctattgattgccttttagacttgggatgcaaagtaattcttttaggttgttttatttgaattaccattttcatatgtttatagagacaattaacaatttttgagggttaagaaatacaagttgcggaacttagaactgatctccaggctgtcgttgggatgaagataagaggggtgatattttcacactctgcagacccaaagcacatttctcccaaaagaaaatcacctttacttttatttttttaattaaaaatgtaatttggaggtaattatagattcacatgcagttgttaagaattacgacagagggagccttcgtaccctttagtcattttccctaagtagtaacttcttgcaaaactagttaagatcacaaccaagatattgacattgatacagtcgagatagagagcattttcaacaccacagcgagtactgtcaagtccacttccctcccatccttgccctctccttaatccctggcaaccatgaatctttattcaatttctgtaatgttgtcatttcagagtgttatataaatgagataacacatagcccttttttgatttggctcttcttgctcagcctaagtcttcaaagatctgcccttgttggatgtgtcaacagtctgtggattttcgaagcataccccacggtatcaatgtaccatagtttgttcagcctttcaccttttgaaggacaactaggttgtttccggttttggctcttaggaataaagctgctataaacatttgtgtacagggttttgtgtgacaggagtcttcactttttctgggataaatgcccaggagtgcagttgctgagttgcacggtagttgcatgtttagtttaaggttgttgttgttgttgttttgagatggagtttcgctcttgttgtccaggctggagtgcagtggggcaatctcagctcactgcaatctccacctcctgggttcaagcgattctcctgcctcagcctcccgagtagcttggattataggcacctgccaccacttctggctcacttttgtatttttagtagagatggggttttgccatgttggccaggctgatcttgaactcctggcctcaagtgatccatccgccttggcctttcaaagtgctgggattacaggcgtgagccaccacgtgtggcctttttttgtttttgtttttgttttactgtcatgctgtcttacagggcggctgtgccattttacatttccatcatcaatatatgagtgactcggtttctctgcatcctggccagttttgctgtcactttttttttttttttttaattttggccatctgatagctgtgtaatgatatctcatggttctgatttgacttctgtaatggctaatggtgttgagcatcttttcatgtgctaataagcacaaatatgtcatgtgtatggcctcttcagcaacacgtctttttatgtcttttgcctattttctaattagattgtttgttttctttactgttgagttttgagcatccttggtatactctagatactcgtcttttattggatgtgtggtttgcagctattttctcccactctgtcgcttgtcttttctttctcgtaggagggcctctggtagagcaaaaactgtaaatttcaactaagtccagtgtatcaatttttcctttaatgggttctacttttgctgtcaagtcgaagaatcataagtttttttctctccttgtgttttgtttctaaaaatgttatagtatgatgtttcccagtatagtctgtgatccactttggggtttttattttcataaagtgagaccgatcgtaagtacttagcccgagtttactgttcatgttcttgctgttcgtctaagctccaggccagaggaggctgcgggcaggtggtgcagagtggaggttcagggagctccagcagtgagaagacagctaggcttgatagtccctttctccccatggtgctccagccaggaccgtgctaacatttgaatagaagagatgcattgcttggttgattctgggctcaggactccttgtcccagtcccttagggttcaaagtggatctttgccagcccaaagacccaaggggttggaatgagcagggtctttcctgcaaagggatgccagtattaacatcacagacgttggtggggggatgtggaaagacagagttggaagccaaatgtctttctttctttctttcttcaaaggtatcggtgactatataactggttgcaaacaggccattgggaaatttgagtctctcgtccaccagattcataagaatgcagatgacatttcttccaggctgacattaatagaggccataaatctctttaaatatccagccgctaaaagtgaggaagaactcccaggtagatctgacttctgggttctccagttatggaattaatgagaacatatattgtatatacatacatgtgtatatatgtacctataaatatacatatgtatttgtatgttccatgaatggcatcaaaccatttctaatgctctcagtcatttacttgaaagaatcacgggtagctattactttttgtcatgttttatatattgcttagtttaacaaattcatgtttatttgtttttgttttgtttttttctgagacgagggctcactatgttgcccaggctggtcttggactcctggcctcaagtgatcctcccacctcatctgcgaaagcctgtggtactttgttgataactttgtaacagtaaagctagttgtattttttatgggctcacatttacttgctaaagaaagatactttaggcagggctcggtggctcacgcctataatcccagcactttgggaggctgaggcaggcagatcacaaggtcaggaaatcgagaccatcctggctaacacggtgaaaccctgtctctactaaaaatacaaaaaattagctgggcgtggtggtgggcacctgtagtcccagctactcgggaggctgaggcaggagaatggcgtgaacctgggaggcggagcttgcagtgagcccagatcgcaccactgcagcactccagcctgggtgacagagtgagactccgtctcaaaaaaaaaaaaaaagatactttaagtggtcttagactagtcaacaaggaattcaagatatgtcaacaatgaattgaagaaaaacaagattgcccaaaggtataaaagccactagatgtgcgtaactggttgtcatttatttgttgcttagtgtgtgttctgatattgacttatgttctgctttgggctgaggttggaggctggttttggtttttttaagacacacagctcatgtttggattgccttttgagtgctgtccttccctgtgttcgtggacagctctaacagacatctttctctccaggcgtgaaggaattttttgaacacattgagcgagaaagggccagcgacgtggaccacatggtccggtggtatcttgccattggaccactgctgaccaaagttgagggcctggtcgtccacaccaacacaggcaaggcccccaagctggcctcctactacaaatactgggaaaagaaaatttatgaggtcctgacaaagctcatcctgaagtaagttcatcttgttgcatgctttaaaatggtgtgtgtagattaaaacagttgacaaatatggacagttagagggggtggcaaggtagagaatgaaaatcagttggatggtcagaggctttctggcagaagggcactcacagaatggggggatgaccttcatgatcttgttaggcccctcaacattccaaaaaagaaaggatccctctccccacttcaactgtctgaaagccatcgtgagcctgtgttcagctggcagcagagaatcgctgtcactcaatattggctagaatcccagaggacttccttgttcatgttgagagtgacagacgtgaaggacacatggcctattccttgctgatttcaagtcagcccctagttagcgcggtctgtgcgtgttgaatgcctgtttcatgtgccagcctctgacacgccagactctgtcccttccctcctgggcctcaccctcagcagctcagccagaccagctggaagctgagtgcctggaccccatcgcattggtggcccacagactgttctggggtgtgaggctgacagtttaggatcattctaggaaaccagcctgtgaaatccatcaccgttaccgtcacgtctatattgtcaagagtagtgttcattttatcatgcagtgtcttccttatgaaggggaactccagaagaaatgactctagttccttctttgaccccagcctcacatttttctcttcttttctttttttttttttttttgtttgagacagagtctcgctctgtcgcccaggttggagtgcagtggcatgatctcggctcactgcaagctccgcctcccgggttcatgccattctcctgcctcagcctcctgagtagctgggactacaggcgcccaccactacgcctggctagttttttgtatttttagtagagatggggtttcaccgtgttagccagggtggtcttgatctcctgacctcatgatccgcccgcgttggcctcccaaagtgctgggattacaggcgtgagccactgcgcccggccaccccgcctgacatttttctttttcgttttttgctttcattttcttgtttggtttttaagtgatacggactctatggattgttaacttcatagctttccctttcacgttggctgctaggaagcttagaaccaaatttgtggcctaaatgcagcaagtgtgtaggtatctatgattcacattttagtctcatctgaacacataggaaagctcaccttgcaccatgttctgtgctggactctttccaattctcatccctgttttacagaggaggatacagaatcttggcaggttaagtgactcgtccgggaccacacagccagtaagagaaagggctgggatttgaacctgggcagtctgactccagtatcatttcctgaaatggtgtctgattagtgtcttcttcgttccttactttacctcactttgattttaggatctcttactgcagttaaagtatctttgtgagctgctaaaaatctcttttggaataatacactgaaaaataaaacaaaaacctttggtcttcttgttttctggacccagtttcgcaaacttctctaagttgatcctttaaataactctgttttctgtgtatttcatttattctctgttactacttttaatttagattcctaaagcagtcccttacatggagctacctcctatagtgtttcccttactaatatgctatgtttttttttttttttttgagacggagtcttgctctgttgcccaggctggagtgcagtggcgcaatcttggctcgctgcaacctccgccttctgggttcacaccattctcctgcctcagcctcctgagtagctgggactacaggtgcccaccatcacgcccagctaattcttttgtatttttagtagagacggagttccactgtgttagccaggatggtttcaatgtcctgacctcgtgatctgcctgccttggcctcccaaagttctgggattacaggcgtgagccaccgcgcctggccctgctatgttttcttttgatccatttattaactcattcattcatttgttcatccatccatccatcatccatccatccatccatctgttcattcactcatccatccacacattcatccccacatccatccatccatccatccatccatccatccatccatccatccatccaaggttgagtaaagcctgccctgtgctgcctgttggattagactctggtcacagacaaggcccctgtatccttgcagtttctctaacctcatagagaaggcaggacacagggaaacagacataaaagagatgagttctgtaaaagaaacaaagcagcctagtgttctggggagagaatggagatgctgctgtaattgggtggtcaagaaagaccccggaaattccacattttagtagagacctgaagatgaggagtgagctgaaacggggaagagctttctgggggaagccaaaaactgctgtgaagacccacaggtgggcctttggtcagtggaagaaacagaaagaaggaaagatgagattgaaggaggggatgaagctggagagggtggcaggggtggatcaggtcacagggagcctgggaagccacggcagggagcttgcattttatctgacagccatgggaggctgctggagtgttttcaactggagaaagaggaggagagggagggagagagaaacagggagagggatcgagagagagaggtggagagagaggcagagggggagagagagagagataaggaggggggaagagggagagaggaagggagaagcctggagagggagagagaaacaggaagagggagagagaggtgaagagagaggggagagagaggagagagaaggggagggaaaaggagaaggagggagggagagggtgagagagggaggtggagtgagagggagagggagagagagacgggaggagggagagggaggagttagatgtttttgttttgttttgttttttgagacagggtctcactctgtcaccaaggctggagtgcagtggcatgttcatggctcactgcagcctcaacctccctgtctcaagcaattctcccacttcagcctcctgaatatctgggaccacaggcgtgtgccactatgcccagctaatttatttttattttagagacagggtcttgctgtgttgcccaggctggtctcaaactcctgggctcaaatgatcctcccacctcagcctcccaaagtactgggattacagatgtgagccactgcgccccgctagatgttttaaaatagtgtctctggctgccatgtgaattactggatggggttgggccggcagggggaagcagggagactgggctggaggctgatgaagttccatccctgggtgtcacatctactttcatcctggaaaggatggagccagtagggcaggctgggtggggatgtgagtgctcctttttccttaccagagttgagcaggttttggaagtcattattgtttaactattttccaaccaaaaggtcttcagttttccaaaagtggaaatgaactgtttgtataaatttagtgcaaaaaaagagtattttaagtaagactcaccccagcctgtctaggacagcctcacagtgtgccattgcctgtacctgtgatttttgtggccctggtcatttccatcaattgcttggtgtatttcactctagtgagatacactctgagtctttctcatcaacccctcttaggaacttgcagtcttttaattctttgatccttggaaatgtccctctgttccacactgaaaccattctgacggcacctgagatcatccttcatcccaacacaaatgagatcgacaagatgtgcttccattgtgtccggaattgcgtggagatcaccaaggtgagagcggaggtgcttgtgtccttgctcagacggcatctcaggatgcctccgcctcccaaagtgctgggactataggcgtgagccactgcccaaggtggaattcttgaccttctgccttgtgactcagtcatcccccagttttccccacttcaggaaatggcaccaacatcaaaccaactgcttgacccagaaactcgtccttgtttcttcttctctcacccagccctgcccggctcacatcagtaagtcctccaaacatacttcccatctgtcctcttctctcctgtccccccagtaccttcctatcccaagtggccatcacccctctcctggactgttgcagtgacgttccatcaatccattctccaccaccggtggtcagaattaccttaaacaaatacaaatcaggccaggtgcagtggctcacgcctgttatcctagcactttgggaggctgaggtgggaggattgcttaagcccaggagttccagaccagcctgtgcaacatggtgagacccccccatctctaccaaaactaaaattaattagctaggcgtggtggtgcacacctgtgttcctagctacttgggaggctgaggcagaggattgcttgagcccaggagttcaagggtacagtgaggtatggttgcaccactgcactccagcctgggcaacagagcaagaccgtgtctctaaaacaacaacaacaacaacaacaacaacatatcatttcgtgtcatccctgttgtaaactgcccccacccaccccatgacttaattacacttggaacataatccagatatctttgtgtgctctgtgaggccgccatgctctagcccctggctgcctttctgatctcagtcctacgaggatcatgctccctcatgctgcagcttgactggctgcctggttgtgcctccagcaggcaccatgggttcctcttgcaaggatctccatagctgttccctcacctggaacattctgctcccctgaccttcttgtcctctctctcccgtcacccccctcccatcttcctaccacgtaccactctccgaccttttcttatttttttccttgcttatttatctattgatcctttcaggccactagaatgtaagatccatgggaatacagaccttgagtgttttgttccctttagaatccccagcaccaagaacatctggcacatagttggttctcagtaaatgtttgttgaatgaacatctgctggcagaaaacccaaggtttatgtcttaccccaaattggaaaatagagctgtctttgtgggtatggggcatcaccccccagcacactggcatcttcctcttcacttggcttgttcagcaagtcagacatgtttccggcatttttaggggcataaaaataagtttagaaatcagaatagggaatttcatttcacagtacttaaaaattgatgaataaggccaggcgcggtggctcacgcctgtaatcccagcactttgggaggccgaggtgggtggatcatgaggtcaggagattgagaccatcctggctaacatggtgaaccctgtctctactaaaaatacacacacatacacacaaaattagctgggcgtggtggcgggcgcctgtggtcccagctgcttgggaggctgaggcaggagaatggtgtgaacccaggaggcagagcttgcagcgagccgagatcgcaccactgcactccagcctgggcgacagggtgagactccgtctcaaaaaaaaaaaatgttgaataaacggtacatgttttataatccatgctaagacagttatttattaagtctctgttacataaattctcttataggtgctgtatgttataggtgctatgtatgtttcctttgtaagggaaacagcaatttttaagaggtaaataaataggaaagttggcctataaaacattatgaatattaatcacaatattccatgccaacttaactttcctccttactaatagatggatttgaggctcttggtgaagcctgtattattttagcttcataagttttttcttttaaatgaaaataatttttacttattctcttagataaggttaaaaatgtatttcattaaaaagatcttggcaaatgaacatgcatggctaggccacttaatatggttgaactctttgatcttcaggattcctatttcgtggcaaaaaataatgagccaaagttttaactagtttctgaattttacctcctctactaagtggaaatgataataccattcaccttctagtgcgtgctgttgggaggattaaattatataacacgtgtatacagcttagtgcagtgtttggcaatcagtagctctgaataaatgttagctattagtattagtattactttttttttttttttgagatggagtcttgctctttcaccaggctgaagtgcagtgttgtgatctcagctcactgcaacctccacctcccgggtgtgagtgattctcctgcctcagcctcccgagtagctgggactacaggcatgtgccatcacacccagataatttttgtatttttatttatttttttttttgagatagagtcttgctgtttcgcctaggctggagtgcagtggtgcaatctcagctcactgcaagctccgccttccgggttcatgccattctcctgcctcagcctcccgagtagctgggactataggagcccaccaccacgcctggctaattctttgtattttttttagtggagttggggtttcaccatgttagccaggatggtctcaatctcctgaccttgtgatccgcccacctcggcctcccaaagtgctgggattacaggcgtgagccactgcgcctggcctaatttttgtatttttagtagagacagggtttcgctattttggccaggatggttttgatctcttgatgtcgtgatctgcctgcctctgcctcccaaagtgctgggattacaggtgcgagccaacgcgccccgcctagtgttagtattactgttattagtaatattggaagcagaagtattaggtcagtgcaaaagtagctgtggtttttaccattaaaagtattggcaaaactgcaactacttttgcaccaacctatagtagttgttattcacattttacagatggtgagcatattgttcagagaactaatgtgtcacatacctatggtttgctgttatgactcacgcttgattaaaacagagccttggccgggcgcagtggctcacgcctgtaatcccagtactttgggaggccgaggtgggcggatcacgaggtcaggagatcgaggccatcctggctaacacggtgaaaccccatctctactaaaaataccaaaaattatctggatgtgggggtgggtgcctatagtcccagctactcgggaggctgaggcaggagaatggtgtgaacccaggaggcagagcttgcagtgagctgagattgcgccactgcactccagcctaggcgacagagcgaaactccgtctcaaaaaaaacaacaaaacaaacaaacaaacaaaaaacagagccttaactctacagcagggagatgtcaaattagcagatttgttctgggacactaagcagtcaatttgcctgaatgtgtgttttttcctctgtaaatatggaaataaaagtttttttaattcatccatggtgtagttggcctttatgttataacaagccacttcaaaacttactggcataaaacaataatcatttagctctgggttctgtgggctgagttctgctgaacagttcttctggtcttggctgggctcactcgtgtctagcagttgatgacctcaagcacagctctgatgggtggcggctggggttctcttgtgtatggcctttcgtggtgtagtagaccagctcgagctggtggttgcaaggttctgagagcatgagagcagaagctgcagggctttcttgactccttggtttgaatttgcataataccatgtccgcccctttccattggtcaagttaagtcacaaggcttgctccggaagggaaataggctccatctcttgatgagaggaacaaaggattatggtaatttttgaatctcaaataatttattaataataaagtgattttccattactggcaagacttattactgaatactaatatgtacgttggaggcaaaatagatactaaaatactgtcttttctcctaattcttactttgccagcattttgttcgttggatgaatggcagctgcatagaatgcccacctcagaagggggaggaagaggaagttgttataataaacttttacaatgatatctctctgaaccctcagataattgaacaagctgttatgatcccccaaaatgtccacaggattctgatcaatcttatgaagtatctacaaaaatggaagcggtatcgacctctctggaaattggacaaagctattgtgatggagaaatttgctgccaagaaacctccttgtgtagcatatgatgaaaagttgcagttctattccaagatagcttatgaggttatgcgccaccctctaattaaggatgagcattgcatcagacttcagctcaggcatctggcaaacacagtgcaggaaaatgccaagtcctgggtgatttcgcttggaaaacttctcaatgagtcagcaaaagaggagctctataatctccatgaagagatggaggtactcaatcgctgtgtgtaattgaaactacttttcgtgtaagttgggtcttcatttgcgccattactgttttttctgtgtttgcttagtgttctttgtactttctgttatagcacctggccaaaaaccttaggaagatccccaatacccttgaagatctcaagtttgtccttgcaacaattgcagaaattagaagtaaatctctagtcatggaactcagatatagggacgtccaggagcgataccgtaccatggcaatgtataacctctttgtaagtcaacttgtattttcttattcatttaacaattggattgaccactaacgacccttttcagaaatgcttctcaagtatactgccattgatttgttttcaaataagtgactttaagtaatacattgtaaatgtaaagcaatgccactgttatttagaataatgaaaatatagagtatttttcaatctgtatggctcaaatggattgatctgtaactataccatttccattctcccttttcttttcttcttttttttgtgttaatttcctttaatagataaagagctcttgcaaaaatgataagaagagagtgaaagatttaagataataaaagaaactggtagaagataattcaattagtcttgctttgtttagggttgttaaatttgggttctcaggatctttcaaagtcatggatgagttttagggggtctgggttccccctgaagttgtatggaaattttacatactgtacatttttctgatgatgaaagaaagtcaagtttttggcccaggtctactgctcagcaagggcatttgtgagctccacatcctaaccactaggctgcaagggtcctggtgtttgaagcagtcaagcaatagaaatgctgaaagacaaacttcatgcaaatcctgatttattcatagcaatttgtttctcttctctagtttgtatttctcccttggccaggtagatttttttttttttttttttttttgagacggagtctcgctctgtcgcccaggctggagtgcagtggcatgatctcggctcactgcaagctccgcctcccaggttcacgccattctcctgcctcagcctcccgagtacctgggactacaggcacccgccaccacacccggctaattattttttgtatttttagtagagacagggttttactatgttagccaggatggtctcgatctcctgaccttgtgatccacccaccttggcctcccaaagtgctgggattacaggcatgagccaccgcgcccggcctagccaggtagatttttgtcagactttgcttccctggtttacgtcacagaaataatagaagaatcactgtaacaaaggattttgcactaagtgtgcaatgggtcacacacaaaaaatgaatcagaatgtcaaattccaacaacaacaacaacaaaacaacaacagttgagattttgattgtgattgcattgatcctttagattaatctgcacaaatggacatcctgtagtattgagttttcctatccatgaacatgttctctctctctttatttaggtctttaatgtctccccgtaaagatttataattttccccatagaggccttacctattttttgccagatttattcctaggtacttggtatttttagatgctcttgtaattggtatctttaatttttattttaattattttattttttattgttatatagaaagacaattgatatttgcattctacttttttatgatcagtaattatgaattttaatcatttatccacagattattttggattttctaggcacaccattttataaactgtgaatattgacagtttcattttaatttttaaatattttgtttctttttctcaccttatgactctagctaggaattcctgtacgaggctggatgaaaggggaggtaggggaaatccgtgtcttgttcttgatctcagaggaaaagcttttggcactgtatcattaaatatggtaattgctgtgtggtttattagattaactccaatacaataagagaaatatacagttgtgtatatttaacacaatggggatatattctgagaatgtgtcaatgggcaattccataattgtgcaaacatcatggaatgtacttatacaaatctagatgatatagctactacacacctaggccatatggtagaacctattgctcctaggctacaatcctgtccagcatgtactgtactgaatactataagcaatgtaatataacagtaagtatttgtgtatctaaacatagaaaaggtacagtaaaaatacagtattgtaatcttatgggaatactgtcatatatgcaatcaatttttggcccaaaacatcattttgttgctctttgatctttgacaaaagaccaatgactgtctttggtcattgtccctggttcctgacacaaagctttcaaaacacttgtaatttcctgagtgataggggtcacaggaacatcttttgttacaatattgttctttgtccctggttcctggcgcacagcctctcaaatccttggactctggagtgacaagagtgtcttttgtatgcaagtgaaatgactggtggctgggagccctaggcagcttcagcatgggggctggttgccagaaagatcaagccataaattatttagaggtttggaactttcaggcgcccatctttgccacccttggggagggaagaggggctggagattggagatcaacaaaggccagtgatctaatcagtcatgcctgtataatgaaacctccatgaacatccctaaatgatgggatttggagagcttccaggttgttaaccacaccaaggtgctgggagagtggtgtgctcagagaaggcgtggaggctctgtgcaccccccaaccccataccttagcttatgcgtctctttcgtttggctgttcctgagttgtgtcttttataataaatcagtgatgggaagtaaagtgtccttctgagttctgtgagccatttcagcaaatggtcaaatgtgaaggagacgtgtgtgggggaacccctgattttgtagccaggttggacagaagtctgtgtaccctgggcacctaatacttgcaactggcatctgaagtgaggacaaccttatgggacttacgcctgcatttctattgagtataggcctagacgtgaagttgctgggttacaggaatccacgtgttcagcttcactagattctgctaattttccaaagtgatggtacccctttacatccataccagcacgaataagggtttcagttgctccgtctccttacaaatacttagtttgttgatcttttggaaacaccaactttgggttttttttatcccttctatgtgtggatattattccatcatcttctggcctctattgttttgacggaggagttgactgttaatctttttgttgctccctttcaaggtagtccagtctaactttttttttttttttttttttggtctgcttttaagaatttttttttggtctttggttttcagcagttgtaatatgatgtaactaggttcttttgttttgttttgttcttcttttttttttcctgattgagatttgtagtacattcaaaatctgcaggctgatgtctttacctagttttggaaaattaacagtttttgccttattttttttcccttctgggactccaattccacatatgttggacctttctacaataccctgtacatcttacattcctttctgccttttctttctgtggtttattctaatactttgtcctaaactttaagttcattaattttctatttatttatgtctgatctgcttttcccggttccttaaacaatcctttgagtgcttgatttcaggtattgtcattatccattccagaatttccattttaaaaacaatttcctgtgctctaccaaaattctcaattttttgtcttttgtttccttgactctattaaataaaattattttaaattgtgtgtcttataactctgtcgtgatcatttatgttgtgtgtgaatctcttggttttgtttaagttctttcgtgtctttatatggctggcatttctaactgagttcttaacagcctgtgtgataaattggagagagaggattggaggcgttgggtgatgttatattttatcagaggagatttatttttgcttctaacagacaccataactgggtacattagcaagctaagctaaacttattctaatcagagattaagttgatttgaagctgggctttagtttatgaagggcttatctctctgtaatatctctatttctttttctctttttttttttttttttgagatggagtttcactcttgttgcctaggctgagtgcaatggcacaatcttggctcactgcaacctccgactcctgggttcaagtgattctcttgcctcggcctcctgagtagctgcaattataggcatgcgccaccaccccagctaattttgtatttttagtagatacagcatttctccacgttggtcaggctggtcttgaacgcctgacctcaggtgatccgcctgtctcagcctcccaaagtgctgggattacagacgtgagctactgcacccagcctctatctctttatttttaaaaatgattttatactgattttattttaattataaaattcaactttaatatttatttttattttactttatttttttgagatagaatcttgctctgtcaccgaggttggagtgcagtggtgtgatctcgactcactgcaacctctgcctcccaggttcaagcgattctgccacctcagcctcctgagtagctggaactacaggctcctgccaccacgcctggctaatttttgtatttttagtagagaagggatttcaccatgttgtccaggctggtctcgaactcctgacctcaggtgacccacccgcctcagcctccaaaagttctgggattataggcgtgagccactgtgcccagcctaatatttctttttaaaatttctttttctttttatatttacagagatacagtctcactgtgttgcccaggctggtctcaaactcctgagctcaagggatcctcctgcctcagccccccaaagtactgggattacagccatgagccatgtaatcccagtctggccatgtctggccttaatatttcaatcagcttttgagttggtttgaattacctagcctcctgttgccacaagcagaagtccctgggaggtaactttgaccatcaatttcaattccaaattgctcatcatttgttgtttattctgttttttgtttctcctaattagcctcctgatgcagagaaagaactggttgataagattgagagcatatggtccaatctgtttaatgattcagtgaatgtggagcatgctcttggggacataaagagaactttcacagaggtaccttttaaatttcacttcctgagtaaagacattgaaaaacgtatttgggctaaattaatgtaacctcgtttttctcagcttactcgaggcgaaataatgaactacagagttcagatagaggagtttgcaaagcgtttttacagtgaaggccctggttctgttggtgatgatcttgataaaggtaagaatgttcctgttggtcttactgagcgatctgagtagcaaatgtttgagtatgttttgcttaagagttttatggcaagtgatgatggtgccgtgattaaaatatttatttcttcctcaaatacttttttcttggctcattttagtggtcacattaaaaaaaaaaaaagctggattaatgcgactcattgattgttgagtgcctgctacccgaaggtgttgagagaagtgccaaggagcagcctccactcctgtgggggatacagaggtttctgccgcagctcagaaatcttaaacaccagcgactgcctttacaaaggcagcgtcttatccatccatctgcctctctaatgcctgttacatttattctttggattcagatgcttgtcctctgcccttcacatcacataggctaaaatggtgacaagttaaaaatactaaaattctgttttttttttttttttttttttgagacagagtctcgctctgtcacccagactggagtgcagtggcacaatctcagctcaccgcaacctccacctcctgggttcaagtgattctcctgcctcagcctcctgagtagctgagactacaggcacatgccaccatgccttgctaatttttgtatttttagtagagacagggtttcaccatgttggccaggctggtcttgaactcctgacctcaagtgatcctcccgcctcagcctcccaaagtgctgggattacaggcctgagccactgagccgagtcctaaaattcttattctaaagagaatttggtaaataccatgagacaaaaaaaataccatgagacaaaccaaagactgctgtggcttccaaagaaatgggtgacgtttatttaaggatgctcaaaaaaggcatctgggaaatgtggcatttgagtagatgattgtgagcagggacgtagtgacctagagtggtagtggtcattggaattgggggagaagcatagaactgggaagttagagtggtaagggagttatcagtaggatgatgatgttctcaagggggcggcaaaggatggtgatgtcgaccacaacatagaccacctcagattcccttaaaatagtctcctttctgaatgacctggttgtgagaattaggcacaattttctaactggaggagactgcagatgtcattggtcttttggttttacttagaatggtgccatgattctaaatttgtcttcccgtgtggtttatgaggatgaaattataattgagatacattatgcatgatttcttattcaattttgtacaccttaaaattgtatttattcactcatcggtgtatttatttactaggagtagagcttttaggtgtttatgaaagagagctggcaagacatgaaaagagccgtcaggaactggctaacgctgagaaacttttcgatcttcctattacaatgtacccagagctgctgaaagtgcagaaggaaatgagtgggctgaggatgatttacgagctctatgaaggactaaaggtgagcatctccctgaaagcgaaggactcaggctcactgaaggggatgtaggaattacttaagccctgcagactttgatgccaccataataatgagcttgggtctgacgttgtggaaacgctcattttggccgcagggaagggggatggggagtgattgcttatgggtacagggtttccatttggggtgttgaaaaagttctggaaataggctgggtgcggtggctcacgcctgtaatcccagcactttgggaggccaaggcgggtgcatcacctgcggtcaggagttcgaggtcagtctggccaacgtggtgaaaccctgtctctactaaaaatccaaaagtcagccaggtatagtggcaggtgcctgtaatcccagctactcaggaggctgaggcaggagaatcacttgaacctgggaggtggaggttgcagtgagtccagattgcgccattgcactccagcctgggcgacaagagcgaaactccatctcaaaaaaaaaaaaagttctggaaatagatagtggcgctggctgtgtgacattgtgaaagtacttgatgccacggaattgtacattttatttttatttttgagacaaagtctcgctctaacacccaagctggggtgcagtggtgtgataataactcactgcagcctcgaagtcctgggtcgaagtgatccttctgcctcagcctgcaaagcagttgggactacagaggtgcaccaccatgcccagctattctttttttagttttagtagaggcaatgtctcactgtgttacccaggctggtctggaactcctgatctcaagcgatcctcctgccttgacctcccaaagtgctgggattacaggcatgagccattgcacccagcctggaattacatattttaaaatgattaaaatgacaattttttttttatgtattttactgtcatcatagaaaagaactctctttggaggtcaagggcttggttaaggcatggggtaaactgtttagttgcaagcggagattaaaagttgccgtgtcagcctggtgtggtggctcatgcttgtaatcccagcactttgggaggctgagatgggcagattacttgaggccaggagttcgagactagcctgggcaacaaggcgaaaccccgtttctactaaaaaatacaaaaaaaagttccgggcacagtggctcacacctgtaatcccagcactttgggaggcaaggcgggtggatcacttgaggccaggagttcgagactagcctggccaacatggcaaaactccatttctactaagaaatacaaaacttagccagatatggtggcacatgcctgtgatcccagctgcttgggaggctaaggcacaagaatcgcttgaacccaggaggtggaggttgcggtgagctgagattgcgccactgcactccagcctgggtgacagagtgagactctgtctcaaaaaataaaaataaaaaagttgcaaatgtcatgtcatttgggtgcctctcattggtatgtttcccatgcaaattcatgctattcattcatttatctattgacttagttctttatagctcagtgctgtgctggttggagtgtggggtccagaaaaggagtcatgtttgcccgttcctgcccttcttgagtccccaagggagactgactatgttagtctgggttcttgagaaacagaatcaataggagatatgtgtatctatatctatatctgtctatatctaatctgtatctataacctgtatctatacctgtatctatatctaatctacatctgtattacattatctaatctatatctatctgtatctaatctacatatctatttctaatctatatctaatgtatatctatatatctgtgtctaatctatacctatatctatgagatttgtgatgaggaattggctcctgtgattatggaggctgagaaatcccatggtctgcagttggcaagctagagaccctggagagctgatggtatagattctagtctgagtccaagtccgaatgcgggagaacactgacgtcccagcttgaagacagtcaggcacagaggttgcattccaccttcctcagccttttgttcgattcaggcctgcagtggattgagtgaggccatccatgttggggagggccacctgctttactcagtcccccaatgcaaacgctcatctcactcagtatctctcacaaaacaccagcgtccacttgacacacaggattcacctttgcaccgatatgtgaacaaataaccacgcccccaagatatgtgctggaaatgaggtggacagagtcctgagcttgcagaggaggaaggagagtggcccactggcccagggaatgctgctgaggaggtggcctgggagtgaggctcagaaccagagcaggcttttgcctggtgcagaacaaggctttccaggcagagcgctgggcaggagcagagacaggagatttgaagttgtgtcttgtgtccataacctttcatccagactggtggctttaccaaccatggatgcaccaggaaatggggttgggatgtgcgaagcggccggtggagatgaagccgtgagaagggactccggaggcagccgggggattgcaggcagggggtcctttaggaggtcactgccccagtgctggcagaagggatgggagcttgcattttaggacaattatagagggaatagagaggagagaagattccagagatggggtggaaagtgatgagacctggtgcctgcaccaggcaaaaaattcataaagttaaaaacataccgtcagcttttaaaaggaaaggtatcatgagaactgagaacaaccacacacatgtcaaaataagtggttttaaaatgtttaatttttctgggttcatagtaggtgtctatatgggatacatagatgttttgacacgggcatgcaatgtgtaataatcacatcacggggaatgggatgtccatcccctcaagcttttatcctttgtgttacaaacaatccaattatgctcctttagttatttaaaaatatacaatttttattgactatagtcaccctgccatgctatcaaatactaggtcttattcattctttctggtttttttttctgtagcaaaataagcatttttaaaaatccaatattgagacatagcttggtccccccagcctactctggtctgtggatgttaagggacatttcatcacctagagtgacttccactctccttgaaatttattttttcctagcaattgcttttcaaagttgtgtgctgagaagagtctcagtgacacactgggtggcttctgggaggctgggcaggggactgtcatcataatcccaggggatcctggggtggcagcggtgcaggttgggaagcatgggtggattctggatctggtttgcaggtagagtcagtgggacctcctggaggtgtggatgtgggatgtaagagcaagagaacaaggaagactccaaggtttttggcctgaggagccggaagagtggagtcactcttaagggaagactccaggaaaagaaggtttggggacgatggtgaacatctggaattcagggcaaggtgatgtctgctggacgttcctgtggtgatgttgaggaagcagcacttggatgtatttgtctggagctcagaggagagctggaggtgtgaattgggagtgtccaggtgcggaaggtactgagccaccagttcagatgggctcacctggtgccttcgtttcctggggctgccagaacaaatgattatgaatacatggttgtgaatacagaccaggaggctgaaaacaacagaaatgtatctcctcacggttctggaggccaggagtgcaaaatcaaggtgtctgcagggccacgatcactctggaggctgcagaagaggcttcttcttgcctcttccagctcctggtggcttttgactgtccctggcgttccgtggcttgcggctgtgttgctcctgtctctgcctccctcatcacattgctgtcttccctctgtgcctctgtgtctgttttctcttcttatacggacaccagtcactggatttagggcccactctaatccagtatgacctcaccctaactacctctgcaaagaccctctttccaagtgaggcttcattctgaggttctgggtggacgtgcatttttgggggacgctattcagcccggtacacttgggagtggggttggtggaggagaggagcgaggtctgagcctgggtctctccaacattaaatgccatgagaatacgtccctaaaaaaggaaagacgaggaagaggaggagtggcccaggtggtaggagaacaaacaggtgagtgtgacatcttggaaacgtgtttccaggaggtaggactggccaactgcaccagatgctgctgatagatcaggtgagaagaggatggaagattgatcacagtattgcatattgtggaggccactggtgactgcaacaagaaaaaaatcaatggagtgtggccgtggaagcctaaatggagcgagtccaaggtgtttacctgagagaagagaaagcatggtccttgcagagacttctgcatgaatgttcataaacagcattgttggtaatagcccaatactagaaacaacccaaatgcccattaagtgaatggataaataagctgtggctcatccacaccacggaatactactactcagcaaggtagaggattgaaccagttctcagcgcatccacgcaacaacatgggcgactctcagaatcgtcatgctgagcgaaagaagccagatacagaggaatgcatattgtattattccattcataaaaaaccctggaaaatgcaaacgaatttatggtggcagtacacagatctgtggttaactgggggtagggacaggaggagagagatgggaggggttatgacacagggaaatggggcagcttttgagggtgatgaatgagtttgctatcttgattgtggtggtgctttcacaggcatgcacacctgtcaaaactttgcagattgtacctttagttatggacagcttattatataccagttaatcctcaataaagctgttagaaaaacaggccaggtgtggtggctcatgcctgtaatcccagcacttggaggctaaggcaggaggattgcttgagcccaggagtttgaggccagcctaggcaacctagcaagaccccctgtctctgcaaaataaaataaaaaatatccaggcctggtggtgcatgtctgtcgtctcagctactcaggaggctgagatgggaggatcacttgaggccaggaggttgaggctgcaatgaactgtgatcacaccattgcactacagcctgggtggcagcgagaccctgtctccaaaaaaaataaaaataataatttttacattaaatctcaggaaaatataacacagaaaatcttctctttacaatcatcaagtaggaacatgtttttcctcacttcttagcctcaacctgatggtttgtaaacagattcttggattagtgatctagagtgtaaatattttgtaaccttagctgctttcatcagggaaaagaagcaagctatgacagcacctgaatgaagtacatcctttaagacccacgcaactccctgatttaaaaaacacctgttaattactttatacctctcacttttgtctttagaaagggaagatgtatttctggatcccacacatcctcagatacagcattatttttgcaaaagcttacaaaaagtggaattcttttcttgttgttttagatccttgtagtcaacctcttgtttgtgaatttcaggtagttgtagatagatgggtaatactttaaaatatctgaacgtgactaagagtcaagaacttgctctccttgttgcatttccaaaggggtctttgttgatggagctgttccttgcacgtttccaggttgcaaaagaagaatggtctcagaccctttggatcaacctgaatgtgcagattctccaggaaggaattgaaggttttctcagggctctcagaaagctacctcggccagtccgtggcttatcagtgacctactacttggaagcaaaaatgaaggcattcaaagactcgattcctttacttcttgacttgaaaaacgaggcactaagagacaggtttgttttgtcctctgtccgcagatgtaaaagtgtgggaggagcttttagttaaaattgtttccctcagtacattatctttggtctgatgatgaagcacacaatttcaacaatgccgcagggctatacatgggcacgacacagttctataatgttgtttctatgtaaagtgtctgtaaaactgtcaaccacaggattcttttaaaaaagaaagatcccagcaggtgcaaagtgggcgtttgcagttgcttttctcgaagatttaaaaaactatagtaagtgaccttgatcagccccatccagcagacatcaaacggaactcacatatgtaatttacagttttttagctgctacagtaaaagagtaaaaacaggtgaaattaattttaatagtatattttaattaactcaatatatcccaaacattatttcaacatgtaatcaacatgaaacatttattcatgagatattttacattcttcttaaaaaatatgtcaaagtgcaatgtgtattttatatctatagcctatttcaacctgggcttgccccgtttcaagtgctccatagacacgcgtggcttgtggccaccatactgatgggatagccagccctgtgggtgggacagagggggcatgggtctgtgtttatttggtgatggcaccacacagacacgaattaggagttacagtcctcatttgtgagttatgcttctgctcgtgttcctctattcctcggtcatgttttccaaagtgtggtcatctagtcatgccatgacatcaagtgacttcattttccctagtgagaaagtcatcccttctttggttcccttcctatccttgagttcacactgagaaagtctctcgtaagtgctggcttgttttcaacacctgttacatctgtctctccctctcaacaaggagcaggcagccctcaggccctggtgacgtggagtcttagccctcttttcactgtctgctggcttccctggagcactcacctttacctttgcaggcttcagtttcctcatctgtaaaactaggtagaagtaggcattttctagctaaagttctcggttttataatcccataacccagtgtttctcaaactttggtcctgtctcatcatttttgtcagatctgagtatcatctatgctgtcatggctttatatttttcttcctatcagtttcttttttatggaaatgaatgttattctaaaaataaacttccaccaccactgtaaagagaaaaccaaaagctcttgccagaaatagaaagtaattattaaaaaaaaaaaaactagctcaaaacagtcgcctgtctctgagccagagaccttcgctctaagaaaggtgaatgaccctggggagggactgaggacacagcgtaagaattaaagaaagaggaaagaaacacaaaaggtggcttgccagtcaaaacaggtttattttagagaaaacaaacctgagaggggattctggccaagttaggtcagagccacactctcttagagactaagagtttttaaggatttagggtgggagagcttatctgaggcttggactgcttctgtgtctctctgttgtgcttatctgggagggagagttgtgtgtctattcccattcatttttctgcagcagcaggcatactcgccgagtctgcttttagctcccctatcttagtgcacctgaagggaaaggaatgttcttattaaggtccactgttttactgggacccattgtataagggtgaagtttggcagttacccaagagacttcctcctctcctccctctgtgcctgagctgtcttgtctatgttttcctgtctgctctttctggtggcttgtagttagaagataagtgatttccttaaaatgcatgggctggaaagggagctggaccttaaagtggtggtgtttgtccaagatgaggttgctcctgctctgtcacacagaagcacaaagaggagactttcccttcgatgtaatttactgtaattgaaaggactgggcgggaactggagagggaatcactctctcccagtgactcagggctgagttatgttgagtgtggaccctctaatccaccaccagggttatgtcacaggctggccccaggtccgctctgcccacatgcagtccatcaatcgccgtgacatgggttttgcgaaacagatttatttgcaaggccgccaagcaaggaggcaggtgagcagccctcacatctgccttcctgaagataaggcttagggatgtttaggcattaggggagtggggtggtcgaagttgagggggaaggtggttggtggtgggaaaaaggaagtaacaggttcattctgagcaagtgtagctggggttcacagcatttcacaggacataggcacagaaagtgggggcatcggcatggcctgagggtagagtgtttggccttccaacgtcaaaaaggccacctctggggcacttgcacaggcccagttgaaaggtcagtggtctcaaccagttggaactggacagaggagttggttcaacttcctgaaaaacaaccaaagtcaccatcgccatcgtggcctgtgaatgttatccatagtagccagtgaaggttaagtttcagcgttcagtggtgagaccttcagcttcatgggaaaagggggaaaaaaataaaaagcaagtgaccataagccacagagcaggcactgatgacccttacccttcagtttcagttctgacaccctccttcctgtccgtgctgtgctaggccagggggttcagagaccgatgaaccagtagggcctcctttctgaccatttccatggccgtgtgtgtgtgtgtgtgtttacaacactcagtgattcaacacttgctgctcacgtgctgggtacgtggcgttctgctgtctagcgtcatgcttagctgccttactcacacccattccatatacacagaactaaaacatgggcaaattcacaggccaaatgcaaaaccttaaaggaaggccagtcaggtgaagagcagagctgcccccgttgtgtctgtgtgcacaggagtctgccccgactgtcccgtctgaatgggccccttcatacctcctctggcacactgcagttttctcatagtactcaaaaccctatgtcattatttaatttatagatttgttgattgtttgttgtttgtctccccaagtaagtggcaggttctctgaagctaggagccttgcccttgataactctgtaccccagtccactgcctggcacggagtcagcactgaaatatttatcaaatgcacgagagctcataatttacatgaggctctcaaaaaggctgagtgattcaacagaggttgaggtcattggttgagagactatgacagaagccgttcccaataattaaaagttgtgtattttatgagaaggccgtgaagactagtgtatagtgtatacagtattttgcaagatgttgttttccggtttaactctggaggccagtgggattttggagaactttgggaatatatttctaatgatgtcctcatgttgcagaatttcattataagaagtttacaaaatgagatttgtcctgtgatttaaatgggagtaattgaactcctcactaaattcagtaagcataaagatttgaatgctgatgtgctttcaggcattggaaagaacttatggaaaaaacgtctgtcttttttgaaatgaccgaaacgttcaccttggaaaatatgtttgctatggaactgcacaaacacacagatgttctcaatgagattgtcacagcagcaatcaaggaggttgccattgagaaggtaagacttcagttaaaaacaggctggagaaaacagtctttttttaattcaaagagaaaatagggagaactcatctatactaaaaaaaaaaaaaaattagctgagcgtggtggtatgccattactcccagcttcttgggaggctgaggtgggaggatcacttgaacctggaaggtggaggctgcagtgaactgtgatcgcaccatggcactccagcctgggtgacagggtgagaccttgtctcaaagaagaaaaacaaacaaaaaagagaaaacatatttgctctagtacctgctgtacttcagtaataaagaattatttgttgtagaaatagaatttccttaattaaattttttgttgttcccaattgtagtttcattttccattgtttaaaaaaattttttcttattgtttcttatttatttattttgccattgatttttaaatagatgtaatggatgttcatggtagaaaattgaaaaaaaattcataatcccactacctgaaaataattattaactttttagtgtatttctttgcctacttaaaaatgcatgcacacatgtatacatatgcatacacacatactactcatatatgtgcacatacacccatgcatttgtatgcactaacatacacgtacacaggtacacacatacacatatccctacacatatatgtatatagtcaggtgtcacctaatggcagggacacattctgagaaatgtgtcctgagttgattcgtgattgtgcaaacaaacctagctgggatgactactgcacacctaggctattgggtagaatctattgctctagactgcaagcctgtacagcaaggaactacattgagtacggccagccattgtaacctaatagtacgtgtgtatctaaacatagaaaaggtacagccaaggccgggcatggtggctcacgcctgtaatcccagcactttgggaggccgaggagggtggatcacgaggtcaggagatcgagaccatcctggctaacacggtgaaaccccgtctctactaaaaatacaaaaaaaattagccgggtgtggtgccgggtgtggtggcgggtgcctgtagtcccagctactcgggaggctgaggcaggagaatggtgtgaacccaggaggcagagctgcagtgagccgagatcgcaccactgcactccagcctgggtgacagagcaagactctgtctcaaaaaaaaaaaaaaaggaaaggtacggccaaaatatggtctaataatcctatgggaccaccattatatatgaaattcatcactgaatgaaacatccttatgcagtacatgactgtacatagtacaccacacatgtatacacacgtatatgcatgtagacacatatgcatgcaaacacacaaaatatacatacagtgtgcacacagtgtacctaacatatacacataatgtatacacacatgtacatatgcacataatgtacatacagtgtacctaatatacacacgtacacataatatatatacatgtatacatatacacataatgtacacacagtgtacctaatatatacatgtacacataatgtacactatgtattcgtatacacacgatgtgcacacagtgtacctagtatgcacacgtacatataatgtacacacatatacatatacacacaatgttcagtgtacccaatatacacaggtacacatagtatatacacatgtatacatatacacacagtgtacacaatataccaaagatacgcataatatacatataatgtacacatgtacgtatgtatacacatatacatatgtatcaatacagatttttttttttttgagacagggtctccctatgttgccaaggctggtcatgaactcctgggctcaagcagtctgctcaccttgacctcctaaagtattaggattacaggcatgagccaccgcacccggcctcaatatagattttttgttttgaatatggaatcataagaggcatatcattttgtaatttggtttttgtgacagtagagtaagcacaggggcagaatctcataactgtgcagacttcgggggcagactgtggggtttagaccctgtttctggggctcagtagctgagcttcatgtctgagccccagttgccatctctgtaaaatgtgggtgataataatccctaccaatatactttgaggtatttgctttgaggactgaatgagatcgtgtatgtgacatgcttacctgccacatagcgaatgcttgataagtggcaattattaccatgacagaatcccaacttttcaggaaacagacccaggactccgattgcattgttggccaaaagcaagctaaggaaggtgtttttgggttggggctcggtcctttcagttcgtgtgcctgaatcattctttttctattcctgaacaggctgtgaaggaaatcctagacacgtgggaaaatatgaaattcactgtagtcaagtattgcaaaggcacacaggagcgaggctacatcctgggttctgttgacgaaattattcagtctcttgatgacaacactttcaacctgcagagcatctcaggaagcagatttgtggggccttttctgcaaactgttcacaaatgggaaaaaacgctttctctaataggggaagtcattgaggtgagagaaaagatgaacaaaagatggattagagccagtgcatagcagtggcttttatatgaggatattttgtgcttagaacttttatatgaggatattttgtgcttagaaacaaatgatcctctttcatacttttttgtcttgatttattttgaggacaagagtgcatgatcaaaggaattgatctgaatttttattttagtgaatgattttcatttccaagattcctaattgcttctttttcatatatctctgtttttctttgatactgtcctgttcttgttgcaaggatgcttttgcctccttgatgacactgaaaattagaaacatacttattttacattccttttcgatttctctacactttttaaaaaaatgtctgttgactctctcttgtggtggtggattttcctctgtgtgattttgatttttttttctagctcatctcacatgtagtttttttcttgtgtttgcttcactttgtcatctgtttttgcagcctctttaacctgaggcctgtcacactgggaagtagcaaggtcttatagtaggtggtttggggctttcttccttttgggcaatacttatccagacctctgtgagcaacccaggctcactgcaccatttttgtgcagttgcctttttttcctccccagaccacaggcaagcaccttgtttttggccacaatccaagccttgggtgggatgaagccaggcctggttcactggccaactgtgtgatcaggcctccatcatgcctgggcttcctttccttgcttttttgtttgtttgttttgtctatgactttgtgttagtggaagctcttatgtgggatatagcactgttttttaatttgtgagtaaaaaacaatttttttttagatggagtcttgctctgtcacccaggctggagtgcagtggtgccatctcggctcattgcaacctctgccagccggattcaagtgattctcctgcctcagcctcccgagtggctgggattacaggcatgtgccactatgcctggctagtttttgtatttttagtagagatagggtttcaccatgttggccaggctggtcttgaactcctgacctcaagtgacctgcccacctcgggctcccaaagtgttgtgattataggcatgagccactgtgttcagtcaaaaaaaattttctattgaggtaaaatttaaataacataaaactagtgattgtaaagtgcacaattcagtgacatttagtacattcacagtgttgtgcaaccaccacctctaattccagattttcatcaaaccaaaagacaagccagtaccccttaagcagtcattccctaccatctcctcccccagcacctggcaacctccagtctgttttctgtgtcaatggatttacctattttggataattcatataagcggaatgacacaatatatgatcctttacgtctggcttttgtcacttagcgtgatgttttccaggttcttccatgttgtagcatgtgtcagtgcttccgtcctttttatggcccaataatattaaatcatgtggattgatcacatgttgtttttctatccattggctgatagacatttgggttgtttccaccttttggctattgtgaacagtgctgccgtcagcattcatgtacaactacttgagtccctgttttcaattcttttgggtcaatacctaggagcggaattgctgggcacatggtacttggctcactttttgagtgtctggcatggcctgtccttcgctgttgtgggtcacaggcttcaccctcttctcataactagaagttttcctacctgtgctgggctgcatggagagctttcttttgcttttgagtgtggccgttagttatgctttccccagcattcccattcatttggagtggaggggagctggccatgcagatgctcactctgtcaccttgcctggaaggtcctcccacctgagttgatttggttctgtctcatgtcaggatggggctttgccatccacttttggaggtatctgataacccctgctgacactgaccttttgtacatttacagatttggatgttggttcagagaaaatggatgtatcttgaaagtatttttattggtggagatataagatcacaacttccggaagaggcaaaaaagtttgacaacatcgataaagtatttaaaagggcaagtgactcgcttctattttagtaatgaaagaagggcagcgatttgagatatttgtacctttttatttgcacattgtattttctccattagtagcttctctctcattttttagagacagggttttgctctgttgcccaggctggagtgcagtgatgtgatcgtggctccctgtagccttgaacttatgggctaaagagatcctcctaactcagcctcccaagcagctgggactacaggcatgtgctgccatgctcagctaattaaaacattttttatagggataggatcttgctatgttgtccaggctggtctcaaactcctagcctcaactgactctcccacattggcctcccaaagcactgggattacaggagtgggtcaccttgcctggcccactagtagcttctgaatttttcgtgtcattatttatgaccctaatctgtctagtaaaaattcccatttgatttttagctgctggcatatgacactgaatcttttttacatttattataaaagcaatatttgcttgtttaaaatattttgaaagtgtagaacagtggaaaaatgtatctctcatggttctgtcactttaatgggaccactttaacatgtcaatatattccttttatctttttcctatgtgtataagtttaaaaagcataattgtaatcatattgtgtacaactttatatcataattttctcttaatattatgagaaacagttcatattaggaagtcatctgagaaaataatttcatggctctctatattccagggagtgggctgacattagtttagttgattactctccagtaatttgacattttgtttgaacagagttctttgctttcataaataatgtacaggttcttgcctaatgctttttccatagttagagtgaatgtcttaagatagattgttagaaagcaaattgcccgtgaaagggtgtgtgtattttaaagtcatttccaaaaagggttggactggtcatcacagtgactgtagttagtgtggctgggattttaacccagctctcctgctctcaaagcccgggtattttgctacttagctttgctgctgtgttctttaattataggtggccagttcatgttttgatctcttttatccactagagtttataactgtttcatataattgttgcataagctctttttttaaacttaaaagaattgtacaacacatatcaggctggacggtgactcacgcctgtaatcccaggactttgggaggccgaggtgggcgatcacttgaagtcaggatttcgagaccagcctggccaatatgatgaaactctgtctctctctcttttttttttttgagacagagtctcgctctgtcgcccaggctggagtgcagtggcacaatcttgactctctgtaagctccacatcctgggttccggctgttctcctgcctcagcctccgagtagctgggactacaggtgcccaacaccacgcccggctaattttttgtatttttagtagagacggggtttcaccgtgttagccaggatggtctcaatctcctgacctcatgatctgcccaccttggcctccaaaagtgctgggattacagatgtgagccactgtgcccagccggtgaaactccgtctctactaaaaatacaaaaaaaaaaaaaaaattagccaggcatggtggtgcatgcctgtaatcccagctactcgggaggctgaggtgggaggatcgcttgaacccaggaggtgaaggttgcagtgaactgagatcgtgacaccactctagcctgggtgacagagtgagactctgtctcaaaaaaaaaagaaaaaagaaaaagaagaattatacaacaaatatcaattcattacagaatactttagaaattacaaaaagccaagaaaaaaaagaaaggaagaaaaaaatacctataatccccttgcccagggtaaccattttaatagttgagcatatatctttccagaacatttattcctgcataaacatacaaatagatataaataaataaataacattctacaaaatatgattgttcttttttttttttagagacgaggtcttgccttgttgcccaagctggagtgcagtggtgtgatcatagctcactgcagcctccaactcctgggctcatatgatcctcgccttggcctcccaggtagctgggactgcaggtatgcaccaccacacccggctaacttaaaaaaaaaaaaattttttttttttttttttagtagagatggagtcttgttctgttgcccagtctggtctcaaactcctggtctcaaacaatcctcctaatcctcctgtcttagtctcccaaagcactgggattacaggcttgaaaatagaatcattcttaccaatgtcactggctatttttattgaacagtttgacctatttcaataaataaacattgaaattatcactcacagcagatgattgacctgttgctggacattgaggctatttctttctttttctgctatgatgaagaatgctgcagtgaatattctgtatatacaaattgctcacagtggaattgccagcttcctttactcagcaagtgttgaatgggcgcctactgtgtgtaagcacttctgtagggtggggtggggctcatcagtgaacaaaacaaaaaaatcctttccctgcgcagctggccttcttacgggataacgaaaagaaaaaccagaaaccagttagttacatgtagtacattagaaggtgctaaggatatgcatgtttaaaaatgataaatggatcccctgaaagccaatggcactgggcagcttgtcagttttgtctcggccgtgcctgggctctggtgagtgcctgttctgggctcaagaacagtgtctccgctctccctgctcaccctgcttgacggctgtcctctgttctggtccagatcatgggtgagaccttaaaagaccccgtgatcaagaggtgctgtgaagccccaaaccgcctcagtgacctacagaacgtcagcgagggcctggagaaatgccagaaaagcctcaacgactacttagattcgaagagaaatgctttcccaaggttcttcttcatttctgacgatgagttgcttagcattctggggagcagcgacccactctgcgtccaggagcacatgatcaaggtcagccctctgggtgtgcaggggctccccgtgtaagccttagaaccgccttcggtcctccctggttccctttgccatgaggttcaacccagagggttaagactgaaatgctgctggagttggttttttggtttgttttttgagacagggtctggctctgttgcccaggctggagcgcagtggtacaatcatggctcattgcagcctccacctccccgactcaagtgatctgccacctcagctgcctgagtggctgggaccacaggtgcacaccaccatgcctggctaatttttatatattttttggagagatgaggtctcactgtgttacctgggctggtctctaactcctgagctcaagcaatgctcccacctcggcctcccaaagtgggattacaggtgtgagccaccacactcagccctcgagttttaatttgaagtgtaagcctgatgatattcactgagtctgaaatcacaccagattcagctatttttccacagtccaaaacctttctttttataaactaaaaaaaaaaaaaaaacaaaaaaaccagaaatatatgaagactaatatattaaatagggaggcattagaggatagtggtttagcacatggactctagaaccagattgctggggttcaaatctttgctctattctgagtttctgtgtgatcttcggcaagttccttgatctctctggacatcagtttcctcatctgtgaatggacataaccccaatggttacctgtttcagtggagctgttgtaaaaatgaaatgagttactatttataaagtactttgaacagtgcctacctttcaatgttggctaaataaccctctccactacccagaattggcacttgttaccatttagtcatatttggtttgtctcttttttttgtaaagttgtacaaatttgcaatactttttgtccccatccccattcatacttcctctattttcttttctattttttttttttttttttgagacagagtctcactctgtcgcccaggccggagtgcagtggcgcgatctccactcactgcaagctccacctcccaggttcacgccattctcctgcctcagcctcccgagtagctgggactacaggcgccagccactgtcatgaatttgttatgattccttccagaccacaatttcacactttttaaataaatgtatatgtatccatgaaccatttcctgaatggcgggaaacaacagagaacactgtcccttgtgatagagaacagaggctggccagacatgatctttggcctgctaatcaaagctctttatctagcgtcagcctgggcaggggctctgagcctcggcgctgctggcatttggggctggatgactctttgctgtggctgctgtcctgtgcattacaggacattacgtagcatccctgaccacaacctactagatgccagtagcaccccctccctagttatgacaaccagaaacatctccagacattgccaatgtcccctggtggcaaaatcatccccggctgagaatgagtgttgcacggtaattcctccattccaaattaacagagcacttaggaacgagtgctttctcctattactttccctttaatcaatgctaacttccttcttaaagtaagattcatattttcgactgcatatttttcctttctcaaaggggaggcttcttcagtattctgtttccagttttttttttttttttttttttttttttcagacagggcgttgctttgttgcccaggttggagtgcagtggtgtgatcacagctcattgcagcctctacctcctgggctcaagcaatccacccgcctcagcctcccaaagtggtgggattacaggcatgagctattgtgcctggccttctgcttccactttgtaaacacatattttactgttgtagaaaaatacagtgttaggaatacttcatttactgttcgcctcttttgcaaacctctgtttttattctttaaagcctgtttgttgccttcctctcctctctgatttgtgagtgccttgtatatggtgggccctaaaggactcattgtcctaaatgttattctgattaataacaatgataatagtcaacaaatgccaagtgtttaacaacatgccagcatttgactcagattgtttcatttgattctcccaagcccaccttgttaagtgccatgattgtgtttattccaggcagagagaggaggagcaactcacccatagttgcgcaattggatagtggggaatctgggattccatcacaggtctctgttccccagcctggggtgttaatcacccttccgcctcctccacgttccactggctcctatgtccagatacctccccactccagcagggttagggacagagtctgctttttctttctcttttcaatcctccacagatctttgcacagtacagagtaaatgaaaatccccaataagtgtctttgggatgaccacacaggtgggtgaacgacatccatcttgcctgcgatctcggctcaccggttgccattgcttgcatcgtggcagctctgctggatggagcaccgctggctggtctttgattccagaactccgtgcaggtcttacagggctgcctctccctgtttgcagatgtacgacaacatagcatcactgaggtttaatgacggcgatagtggagaaaaactggtgtccgcgatgatttcagcagaaggagaagtcatggagtttcggaagatcttgcgggctgaagggcgcgtggaggactggatgacggcagttttgaatgagatgagaagaactaatagactaattaccaaagaggctatttttagatactgtgaagacagaagcaggtaaggctgcgaatgtggacatgcattgctctatccaattcatagtcataatggattaattttaaaggcttggagtagattggctgacattccaaatgaggttttgtttttttgcaataggtcattagtggacagatagatgtctttatttttatttttttgagacaggatcttgctctgtcacccaggctggaatacagtggtacaatggctcactgcagccttgacctccctggttcaagagattctcccacctcagtcttcagtgtagctgggactacagttgtgcactaccatgcctggctaattttgtacttttttgtagagagggagtctcactgtgttgcccaggttggtctcaaactcctgggctcaagtgatcctcccaccttggcctcccaaagtgctgggattacaggtgtgagccactgagcccgggcagtctttagcatatgtgctgccaaagcgagcacaagatagcagtctttcaatgatcacccgatgcagtactctcaaagtgtgccccctggtggcagcacagggcccctgggattgttagaaatgctgattcttgggtcttaccctgcacctgcccatcagaactctgggggtggggcctgaggatttgtgtttttgcaagctctcaggggattcccagcacccttagcgtgtgaacccctgacttagtgaaccaccagaaactaggcgtttagtgggattatgtgtatgtaacgttgtttctaaaatatttactgaatttccaacattctttgatttttgtggctagagaggcttcaggatatcatgctgagccctgcctgctcctagcagctgagtgcagtccaactagaaatacagaaagcctctttggctaacttattctattagattagacaggatcccccgtaaagttggagaatatttggcagggccttcgtgcagacatagaatctttcttgttattatgagaacaccattctcttgattttgtacactgcctttttgattttacaaagtgaaaacatctacttaaaaattattagcgaatagcataatatttatttgattatgatcctgctgtttccgaggtactgaggcatatcaaaaatttgtttgcatctttatgtggatatgttcagtggataaactggtaaaactggatgtctggaaaaaatttttttaaagctttgatttaaagcagttgccaatttccatggtgcaaatattcctgccatggctgatttcaaagctaaatgaaataagtggtttaacaaccagcttgcaaaattccagaatattcgacagttagtcttgtgacaggaggtggccctagcattcatttaactaatatttcttcaacccctgctctgggcgatttattatgctagatgctatttcaaaactgaactagacagaaatctctgccttctgtatgtattaatcactgaatgttttaaattatcttttctgctccaaaatactgtgaagtttacaccagcatcagttgattttattttcacgatagctaccactttgctagggcattgctatgtttggtagtgctgagttggtggaagagagtaagggaatgcagcctgatggactgaaaaagatctttttctcatccagatgctcctttgagcacgtgaacttgttgcttccaacagggagaatagttgacatgagcatgtggttttatttgagctgataggtgtggcatcactgagaagttagggccagctgtatctagtcccaggaagcacctttgccctggtcatttaatcttctctgatcctatggcctcagctgccacctctccgtttctgattctaggtttgtcgcgtcctttacaaggcccgtctttgttcatcatttcggtgtcgtcctctgggccttcgtaatctttgttgtctctctcctgatgtgtaggaatcatggatataagtgatctttaggttttcgctgcaccacacaattttaaaataaaacaacaaaggtcaatgttatttttattgcttttcctacttatttatttatttatttatttattgagacagagtctcgctctgtcacccaggctggagtgcaatggcgctatctcggcttactacaacctccgccttccaggttcaagcgattctcctgccttagacttctgagtagttgggattacaggtgcacatcaccacacccggctaacttttgtatttttagtagagacagggtttcgccatgttggccaggctggtctcgaactcccgacctcaggtgatctgccggcctcggcctcccaaagcgctgggattacaggcgtgagccaaagcattcggcctcctactcttttaaatttattttgccattaactgtaggtcatcaagataatgactatagtaatccgcagtcacttttccagtattggcattgtattactgtgttttcacactgctatacagaaatactcaagactgggtaatttataaagaaaaaggtttaattgactcacagtcacgcatggctggggaggcctcaggaaacttacagtcatggcggaagacaaaggaaaagcaagtacctttttcacaaggtggcgggaaagagagagagagaaggaggaactaacaaccacttataaaaccgtcagatctcatgagaactcactcagtatcacgagaacagcatggggaaaccgcccccatgatccagtcacctcccaccaggtccttccctcaacacctggggattatggggattacaatttgagacgagacgtgggtggggacacagagccaaaccatatcaggcatttacagctctgagtccattattttttaagtgcagtttagaaaaaaagctttgtctaaatgtgtctcaaggcaatcacaagctttgtaagttagtgcctctggagaggacatccaagtggccaataaacatgaaaagaggagaaaccccacgactcagcaggatctgtacattaagggaggatgagatgttttgtttcacttttcagactggcaaaaattcaaaagcgtgttacaacctggcctgcaaacctgggcagtgtggtcagagattatgaaattctttgttggaattttaattttctttcttgagacagggtcttgctctgttgccctggccggagtacagtgatgcgagctcggctcactgaagccttgagttcctaggttcaagcaatcctcccacctcagcctcctgaatagctgggaccacaggcatgtaccaccacatctggctaatttttgtatttttggtagagacaaggtttcgctgtgttgcccaggctggtctcaaactcctgagctcaagcaatctgccccagcttggcctcccataatgctgggattacaggtgtgagccaccgtgcccagcctggaatattgttttacttcttacataaacctcaaatactaagtaagtttgaaaacctataatcaaatattttattttattttattttttagagacagggccttgctctgtcactcaggttggagtacagtgcacaattgtagttggctgcggcctccaactcctgggctccagcgcccctggagtagctgggactacaggcatgcgtcattatgcctggctagtttttaatttattttttgtagagatagggttttgctatgttgcccaggctagtcttgaactcctggcttcaagtgatcctcttccttggcctcccaaagtgttgggtttacaggcgtgagctaccacgactggccccaaacatttaaaaagtgatctggcatctttctgtgcagtcaggtacctgcaacattttttgtggagagaggcaccctcggcctggaattttactacctagtcggagataggtaacatcttactctcacctaagtcttactcctctgacttacttaggtaaacaaatacaggcacttgcttacctaaaacctttactttgccctccctattccagatcaaagaaataaattcctgaagggactgttttgggtaccagtccccggattgatcagagcctcttacaggtgtgcgttttctgcagagtcgactggatgctcctgtaccagggcatggtggtgctggccgctagccaggtgtggtggacctgggaggtggaagacgtcttccacaaagcgcaaaaaggggagaagcaggccatgaagaactatggcaggaaaatgcaccggcagatcgatgagttggtaacgcgcatcaccatgccgctaagcaaaaacgacaggaaaaaatacaacactgttctcatcattgatgtgcatgccagagacatagttgattctttcataagaggcaggtgagcattttccggggtcactggcatttcaaaagggaccctttgtggtccgctgatctgtctcaacggtttccacttcctccacctttcttgccgtccagtatcctggaggcccgagagtttgactgggaaagtcagttgcggttttattgggaccgggagccggatgagctgaacatccgccagtgcacgggaacctttggctacggctacgagtacatgggcctgaacggcaggctggtcatcacgcccctcaccgatcggatttacctgacgctcacccaggtgactgccagcctggcacttgtggttaccacttaccttggggcggggcattttctctaagcttgaggtgtgatgactgcagtgattgaaatagcaggggagatcattgctttgaaatctcgaaaagcttttccatttgggatgtgaccagattgtcaccatttgggattggcatgtaagtgtggccgtgcttagccactggtacactggtccctaggtaatggtgtgtcaggggtattggtagaggccaatgcgaaaatgcaggaatgtcaaaggtggtgactgttagggcaagtgtgatgtggttttgcacgtcttgtgacagcttttattccagaatatatccgttcaagtgaacggccttggatgatagagatagtgtctccctccaggacagagggtaaacttgtttgttgtacaggaaatgaagataacacttccatccaggcagagcttgggaaggtttgcaagcaacccccaagactgtttgtcagatgcttgctagttttctttttttaaattagagatgaggtcttgatatgttgcccaggcttgccttgaactcctggcctcaagtgatcctcccaccttggcctcctgagtagctaggactatagcattcactgctgcacctggctacattggtggtctcttaggctcacagtttctcagctgtgactcatacccactgtggatgtggcatgcacctgggcccgtctccacatcacaccatgggatttggggggacaaggataaagggaatgagtgagaacaggaagcccctgctgcctcctgtgctgtgagtgataaagtcctttgtttttgagaaaaagagtgtcatcttatctgtattggttagggttccacagagaaatagaaccaataggacatagctagctagctggatggctgtctgtctgtctgtgtatctatctatctatctaatctatctatcttatccatccatccgtgcatccatccatctacatatccatccatccatccatccatccatccatccatccatccatccatccatgtatctatccatccatccatcctattatctatctatctatctatctatctatctatctatctatctatctatccatccatccatcctgtctatttatcatctcgatcatctattttatctatctatctatctatctatctatctatctatctatctatctggatatttaggaggagatttattatgaggtattgactcatgtgatgatagggtctgattactctcacaatctgccatctgcaagctggaggaccaggaaggccagtagcatttgaagttctgacagtgagagagccaatagtgtagactcgtgtctgggtctgagggcctgagaacccgaagtgccaagggtagaagcccagtgccctggctcagtcagtcaggcagcaccagtgtaacctccctccatccttctgttctgttcagtcttcaatggattagatgatcaggcagcaccaatgtaacctccctccatccttctgttctgttcagtctttaatggattagatgaggcccacccactttggggagggtcatctgcttttctcaaatgctaatctcttcctgaaacacactcatggacactcccagaaataatgtttagccagctacctgggcatcctgtggcccagtcaagttgacacatgaaagcaaacaccacattctttctctattctgcacctatagtcacagtgatgaatttggaaatgacacccacttccttctgtgcaccagaaaacatatgttttgcatttggcttataacaggcgctgtccatgtatctaggtggggcccccgccggcccagcaggaaccggcaaaaccgagaccaccaaggacctggcgaaagccttgggcttgctctgtgttgtcaccaactgtggcgaaggcatggattacagggtaaggcctggctgtcacctttggtactggctcattaggcagagagcttaaagcaggacatggcatttcacctcctagtctttgacatggcgacagtggaagaagctagtagaaaaccttccaccaccacagccccagaacctaagtgtgtctgcttaaagaccctgctttgttagcaggatgtagagcaagagtcccggattcactaccctagtagggtcaggttgataatgtacgtgagtaaagcggccagcagacaagagagtggtgggatctgtggctaactggagagcaaaagtccatctaaagagggtgcccgtccagctttggttcataatcaccatttgggaaagtggacccagcattgctagattttcccacatttcaagagaagagaagagaaatggagttttacacaaaaatctggatttgtaaaatcccaagtaggagccagcccatgaggggccttggaagtcctgccagaaaaatccactagtcaagtggctggtcacctgcttctctgccaatcagtgatctcattgtttgctttaatttagaaaatatatccataaatgtgttgcttgcagttttaaagatgaaaattgcccttgtcctgacatgtctttcttcctaggccgtggggaagattttctctggcctggcacagtgcggggcttggggctgctttgatgagtttaatcgaatcgatgcttctgtgctctccgtgatctcctcccagatccagacgatccgaaatgctctgatccatcagttaaccacgttccaggtgagacacatgaagcccccgggaccatgtccctaggatggaagtttgccaagtatggtaagcttcctctgtagcgtcagtttctgggccgttgacactccagaccaggcttcctgtagaagatctgttggtttttccaattgagatgattgggtttccaaaattatcatcattgatgataaggtttgtaatagtccaaggacttcacactgactccagacacagaaccaatagttatgaatgggcgtggggcagagttctcaaataagtgatgtgcagggtcccctagaaaggaaacaatattcttggcgacttcccaagtttgagaaaacctgacttagaaagcgaatgttccttgcaatcattatcacagtgaacaagaaattttgccttcataccttgtgaagttacggcatcataacaagcaggatttgcaaggttatcaaagtgagaaggcagaattttaaaacaattgttgagaattcaccaatttctctctgccaaagaatatgtttgcagacttgagtttgagaagtctgcattaaattacaccagattaagctggatccaaatttggagaaacatgatcttattatgtaatctaggtggcccagaaggggattctctgaaaacacaggaccagcgtgggtgggccatttccctacaccggggtcttctgggtcccttgctgtccttctgcctctgtcctcccccctccatgccctgcacacttgtcactaagccacttgctccacagtcataccatgccttgtgacaccacatgtgtccccatctgagtggaattgtcccttcttcccttcactggaaaactcctatacatcctttagagccccattccaggatgaaaattcagcttgagctggtggccctgtcatctcacatgcgtcctcctcagatcttggcagggctcactgttaagagattgtgtcagctggagactgttcaatattttcaggattccagtaaagggtctggatagatttccctttgatgagttcttttgagggatttttggggctgagctgactgctcccgagagagggaattaacctgcaatgtatatagatttccagaagctgtgtttctcagagccaggaggcagcagctatctgctcttccccctgggccatctgggccatctgggcctcttgtgggatactgaggctagggatggtctcagggccgacctatgagtcaaggcagtggccttgttttgggggaggctggctgtcttccgggctgccctctcgttggtgatgcagactgtgcctcctaacaacaaaaattttctgtcctctgcctggctggtggacaatcaaaaaaaataaaatagaaaacttcaccgagagacgaccggactcaaccttcagctaaaaaggctaagaatatagggatttccgtggtttgttggtacctggggcaaccagaggaatgaagactggtttcttgaggggtttgaggtgggattctttaggcaggagtgactgcatgaagtccaggcacccgcagaaggtgcaaagccaggtgagaggaatggaagccggcgctgtgtgaggtggtgggctgggcgctcccaacctgggctgtctcctttcatcgccacagccgtgccacgaggtgggttgcatttctgttgtgcagaaaaataaactgagactcagagaggttaagtgacctgctgagggtcacacagcttcttgtatcagccccagactctgtgcttcgccaacctgggccccttctccaaggtagtgccctgggttcaggtctgagtttggggttccactgagacctgccctccccaaggccttcagcgaggggggccctgcattgaacaccggggagggaaaaagagacaagtggtgttgtcagcctcataccatgaaaatgaatcgccacgcagctcgccgcaggccccctttccaaggggctggccggccgggccacctaactgcttctttctttcttccttcttgccctccagtttgaagggcaggagatttccctggactcccgcatgggcatcttcatcaccatgaaccccggctacgcaggccgcacggagctgcccgagtcggtgaaggcgctgttcaggcctgtggtcgtgatcgtgcccgacctgcagcagatctgtgagatcatgctcttctctgagggcttcctggaggccaaggtggggggccttggcagcgccaggtcgtgcagtgcagacttcacccgggtctgcttccagactggggacctaggacgcgttagctccgtgtggctcttccagacgggacctaggatgtgtcagctccatgtggctcttccagatgggacctaggatgtgttagctccgtgtggctcttccagacgggacctaggatgtgttagttccatgtgggtcttccagactggggacctaggatgtgttagctccatgtggctcttccagactggggacctaggatgtgtcagctccatgtggctcttccagactggggacctaggatgtgtcagctccgtgtggctctttgatttttgttttttttttctgctgtgtctctcttcttcctcccccacctctttttaaattataacttttaattttggaataatgtaagatgcacaagaggttgcaacaatagtagcacggactttccaggtgccccttccccatgagaacatctcacatagccacagtccattgcccaaaccagggagttggtgttggcacaagtgccattaactcaggtgtagacgttgtgtggatttcaccaggtttcacattctctctatggcgtgtgcgtgtagttagttctatgacgttttatcacatgtggatgggagtggccgtcaccacatcaggatacagaactattccatcaccacgaccacaaagaagagagacagggtcttactctgtcacccaggctggagtgcagtggtgggatcacagctcactgcagcctcaaactcctgggctcaagtgatcttcctgcctcagcctcctgagtatttgggaccacaggcagatgccatcacacctggctaatcttgcttattttttgtagagacagggtctctacagcccaggctggtctcgaacttctgggctccagtaatcctcccacctcagcctcccgagtagctgggactacaggttgtgccactgcacccagcctcatgttactgcttactagacacattctcccctcaaccctaactcctgcaacccctgatctattcttcagtcagtgtaattttgtcactttgagaatgttctctacctggagacatgtagtatggaaccctttgagacgggcttctttcactcagcacaatgcctttgagaatatgtagattcaaaaacaactttatggataacttttatcctcttttaagctatctataaaatgtacatacgtaagatctttccagaagctctggaaaagttacaaaatagagaatacttttaacatagagggttgtcacattgcgtttctgcaatatgtcttttattgaaagctcttggtgcctattaccgtgtcaggattttgagttggcacgatgagatctcttgttcctagttttcacgactaaaattgccacacttgccttagagacctgtgggttttgaacccttgccatagatgaggtggctgacttgtcctcaaagacatttacagccttttttttttttttgagatggaatcttgctctgtcacccaggttggagtgcagtggtgtgatctcagctcactgcaacctctgtctcccaggttcaagcggattctcctgcctcagcctcccaagtagctgggattataggcatgcgccaccacgcctggctaatttttatatttttagtagagacagggtttcaccatgttggctaggctggtcttgaactcttgacctcaggtgatccacccaccttggcgtcccaaagtgctgggattacaggcatgaacaactatgcttggcccagttacagccttaataataggtttaggtcaaaataaagaagcaatgtatttctggagtgtgattcctacagatggttctgttctttaaattaagatagtgaagattttggtaacacagatgtttcttcaaattagttcccaatttgccatatttaaaaatgaaggacccaccctggtatttctggaagttagagatggaatttgcttatttgtagagcagctgcactggaacacctgcccccgttttcttgcatttgtagaatgatgctccattgcttttgaatcattttcttttttctttttttttgtattattatcttctatcaaaaagactctggcgaaaaagatgacggttctgtataagctggcccgggagcagctgtccaagcagtatcactatgattttggactcagagccctgaaatcggtgctggtcatggctggtgagctgaagagaggctcctctgaccttagggaggtaggggccacgtgctggaacattctctggtttcagctgcttcaggcatttactacgtgccattggggaggtgatgggcacagtatggtatcacctgaaaggtttaagtcttagctgcctcttcaccccgcggtctggccttactttggcctcttacctgttgtatcgtttgcttgtaattacacttagtaccttaaggtcaagtgcaatgtcttcgctccaatagcaacatttatgatgcttccatagtaataatctgtagtctcaggatgggtgtggcggaagggtggggactaacaaaattctcatgaaagcatgaaggtgagttgttattttctctttgaaacaaaagaggggaacaattgtgttttttttacatggactttaaataaaaggtttagtcaatgttctgtgggcaacaggcttacctgtttctctagtgactgtactcaatgttgcacgcacacacgcacgcacacacacgcacacgcacggacacacgcacgcgcacacacacacggatacatgcacgcgcacacacgtacgcacgcacatgtacacatacgcacacgcacgcacacgcacacgcacacacacacacatttgggtagtaaaaaaaaaacagccgtgagtgcagtgatagaagcctgtttgtgtccataggaggagaggctgccacaaatcgcttcattcttttgggattttcacacatttgggttttttttttttttttttttggaggggtcgaaggaagagttatttatgctcttacaaaaaaggaagctgtaaaatgtaaaacactataaagtcagatggagctgcattcgtcatttgtacttcttttttcttaggagaaaggagttatatggaaacttctttcattttctcccctgctcctctatgtccaaagttgaagggcgatcatgctattgagtgggtcatatcttctgaactgaaaaaccaccgatgccactttcagtcttagcaacagggaaaacagtctcaagtgctatctaaggctctacgaagaagagtgaggccgtttgcagcagtctctcctcctagggcggtgaatatggtcccatcactgcactcactactggcttgttttcttttactgccttacactgaacccaagcatgcattcataggctcaactgctgcacaatctggtacttccttagaagaatgaaaacacattgcaaataccgaatatccaaggacttccgagaaagaggtaaaaaacagcctccttttctaggaggaaaatccctcttctcatccagcaatgtggacttacacatgtaaaactgtgtttgtacagagactgcgatggtttcttcacataggaaattaactttgctgtattgtctttgggcttctttatcacattaaaagtttgcaagcttggacctttgttcttattcagtaaatctatgtcacaggatgagtgaggatttagcatcttttgcttcaaattagaaccacatatttggaatttactgctgcagttctcagctgcgcttatcatgacagtggtggaaactggaggacattaaaaagcccatgaagtcagctgtacttgccatttatttagtcttgtttggaataaaaggtaaagaattcacaaataccaccacctcagcacctgtttcaaaggaaacatcaggcttcagcttgcaacatgatgtcgttacaattaagcaaatagcagaagcccccgtcagttgcttccttcttctggagaaggcggggaactgcaatccccggggctcctgtgttgagtctgggaggcagaacaaaaggaaaagtggccttttccactccacatcctggaggtaatgggtagagaagacatacccacatttccagatagtgaacgctgagtagagaagcaggactacctgtcctaggagacaacatagagacgcttgccaggtcctgagttcagaattttgtttttgagatttatataaaagcacctaaggctgggcgcagtggctcatgcctgtaatcctagcactttcggaggctgaggtgggaggattgcttgaggccagaagtttgagaccagcctaggcaacatggcaaaaccccatttctttccaaacaaatacccaaaactaaaaaatttagctggctgtggtggcacacttctatagtcccagctacttaggaggctgaagtaggaggattgcttgaacctgggaggtggaggctgcaatgagccgagatggcactattacactccagcctgggtgacagagcgagaccctgtctcaaaaaaaaaaaaaaaataataataaaaagtatatatatatatatgcgcacctaaaggtcaaagtaaatgttcttcctgtaataaggaacctttgctttagcgtagatggccatacccctctgtaaggtggggaggaggaagtttctgctccttccctctggccgagatctgttttcttctccttgcacggcccaccaggacactcagcctcctaggagcaggcccaccctggcctcactcctctgcctgtgctcctattttatattttatttaatttttacatttatatacaattttgtattgtatatttcacttttatatattttattttacatttttattttcatatgaaactttgaaaaatgcatatttacatttatattatttatatgatcattattaaatatgaaatatgaaatttcatatattcatattacacataatatcttatacatattttatactatataatatacataacattttatatacatttataaatttatataatttataaataatacaaatataattaatttatatgaatgatataaaatatataaattttataaaatttaatttatataaaattgtaatatatgtatataatttatatataattttatatttcattttaaattttatatttcatttaaatatatatgtatgtgtatatatatgtgtgtgtgtgtgtatatctatctatctatctatctttttttcgagacagagtttcactcttgtcacgccaggagtacgatggcgcaatctcagttcactgcaacctccacctcctgggttcaagcgattctcctgcctcagcctcccgagtagctgggattacaggcacctgccgccacacccagctaatttttgtgtttttagtagagatgtgatttcaccatgtcggccaggctgatctcgaactcctcaggttatccacccacctcagcctcccaaagtgctggaattacaggcatgagccactgcacccggccatatatgtgtatattatataatatgaagtacatattatatgaaatatatgaaatatatattttatattttatgtttaatctcatgtaaactattttatataatttatatttatttacatattaatataaaataaaaaataaaattatataatttctgtatataaaaatatataatacatatattcagaaattatataattttaaattaatttctgtaatttaaatttaaattaatttaaattaatttctgtaatttaaaattatgtaattttaaatgtgtataaaattgttaaaaataataaaatgtttatataaaaattatattttatatttcataagagtgttaccactgggttggaaacacagtccaaagcactgggttcctttggaaatctcttggaaacatgtgtttcatttcctgcaggacgtggtgctgatgagggccttgcgagacatgaacttgcccaaatttgtgtttgaagatgttcctcttttccttggtttgatttcggatctgtttcctgggctggactgccctcgcgtccgctaccctgacttcaacgatgcggtagagcaggtcctggaggagaacggctacgcggtcctacccatccaggtaaagccaggaaaatgacctcactgtggccgtgcatcctttccattggctttttgtttttgcagttctttaaaaatatatgtacagtaaaatacgcataagtttcaccatcttaaccatttttccccatttttaaatcacagtaaaatacacataacaatatttaccatcttacctacttttaaatgtagagtttgttaggccgggcacagtggcttacgcctgtaatcccagcacttcgggaggctgaggcgggtggatcacgaggtcaagagattgagatcatcctggccaacgtggagaaaccccatctctactaaaaatacaaaaattagccgggcgtggtggcgctcgcctgtagtctcagcttcttgggaggctgaggcgagagaattgctggaacgcgcgaggtggaggttgcagtgagccaagatcgtgccactgcactccagcctggtgagagagcgagactccgtctcaaaaaataaaagaaaaaagaaaaaatgtagagtttgttggtgctaagtacattcacattactgtgcaaccatcagcattatccatctctggaacgttttcatattgcaaaactaaaaccctacacccgttaacagcttaccttctcccctccctccgctggcaacctctgctcgacttcctgtctctacaaatttgactactctaggtacctcctgtaagtagaatcatgtaatttttgtccttttgtgtctggcttatttcactaacagtgttttcaacatttatccatgttgtggcatgtgtcagaatttcttcctttttaaggctaaattttatatatatagttttttttcacacaatgtgatcaggtgactcaaatattttgttttgaggcatcaaccatcagaggttctttcctcacctcaccttttttttctcctgagtcacacttaaaaaaaaattaaattagatattgcagggataggatttggatcctctgaagcctgtaagttgtatatgttgtcattaagccaaacacgtattgattggcagagtcctgctgagagtgtaaatgcccagagcctccagacctggggggttgcctcgggtcgggcagcttcagggtgtcaggctaccccggagacctcaggcctgggcagtgggcaccgggtaccggccgtggacgagagctttctgtgcttttcctgaccctgattttctctggagttggttgttgaaaaagatgtgttttctggaaggaatataaaatggtgcagccactttggaaaacagcctggcagttcctcaacaggttaaaccgagagttaccataagacccagcaatttcactgctggggatctacccaagaatgaggacgaacgtccgctcagaattgttcatgaatgtccggagcagcattattcataatagccaaaaagtgggaacaacccaacatccatcagttgatggatccactgctgaaacagaatgtggtctgtccatcccatgggatatattttggccatagaaaggaatgcagcacgcgtgctacaacatggatgagctttgaaaacatgctaagcgaaagaagccagatgtgagagatcacacattctaggatcccatttccatgaaatgcccagaatacgcaaatccgtagagacaggaagtagatgagtggttgccaggggctgggggaaaggggattgggagagatgggtacagggttttttgtggggaggggtgataaaaatgttctaaaattgctcatggggatggttgcacaactctgtgaatatactggaaaccattgacttgtaccctttcaaaggtaaattgtatggcgtgtgtgttgtatcgcaataaaactgcgtcagaaaaaagataatgttttagcccagctgccattgtttgtcccgcaggtggataaagtggttcaaatgttcgagaccatgttaacccgccacacgacgatggtggtggggcccaccagagggggcaagtccgtcgtcattaacactctgtgtcaggcccagaccaagtgagtatgacctccgtagggagggcctggctgccacaggggctcacagtatatgtttggtgccagtattaccaagtcccactttgctctctgatttcctgggagggtaaatttgtaatacacacccctttcgactcagcgtgtttttactgactttattgcagacttagttaagatattttagaatgcaaaatagcaacccgcttgtgcatcagatggtgaataggttcatttgtgaaatgagaatttcacaaactatcttataaggatattttgaaaatgaatgtaagtcatagtttcttggggtccaaattgcttccttaaagtaagtcaggattcaccttatgcagtactgctgtggtttcgcagtggccagaaaacgaatgtcacctccccgggtgccttataatcgctagcccttcgggggcaattcttcacgaaggaaaaagtgatcgtacactcccacattgaagatcgtaaaggagccaggcatggtggctcacgcctgtaatcccagcactttgggaggcctgggtgggaggatcccatagtccaggattttgagaacagcctgggcaacataatgagactccgtctccacattaaaaaaaaattagctgggtgtggtgatgtgcacctgtagtacagctactcaggaggctaaggagggaggattgcttgagcccaagaatttgaggctgcagtgggctaggattgtgccactgcacaccagcctgggcaacagagtgagaccttctctctaaaaaaaaaaaaaaaggagagtatgtcataaaagcctgcagtgaattgaaagccttctactgaaagtggattcctgactcctcacttctcttctaagcaataactagattccagaaagacctccgtggatgctgatagcccggcaaaaatctaaatcaagccaaagtttctgtgacttaaacatttctaggcagtctataaaatctaaagagtaagtgtctgtcatatgttcccattatttcttcatatgtttcatatgagaaaaccagtcgacagtggcttactgactctaagtgggctgtgccgtggccatctgcatttcattctttaattcattcattgtaagtttatagaactatcacacagttgtatgcatgtgtaatatagcatgtacattatgatttactgattcgttggttgtgaactgtggagtgtgtgaagttttgttctctatagatgaattaatcctatagttagtgctgcagggatttacaggcactgtggtgagaaatgccctgtctgcttgattcatgaagtcaacagagcagctgttgttctgtagataaggaggattgaacattagtagtccaaagccttgttattatcgtggatgactgagtgtggtctcctatacgcccttaattctgagatatttacttaaatgtcatatatatgaatatgtaatatgcataaatatgaaatatacatgaaagttagcttcttggtgccctccagaggcaaagctgtgcttctagttcagacttcatttgtgctgtggccacatttttggtgaaatgtggttgctttatatttagaagaaagcactaacagtgaagggaagcccagtgaagagtttgcatgggttgcattttcaattttggattaaagtcaaaacatctaattcctcatagagggaacccagactgttttcctcatgcatttagttgtcttgaaccatggctaaagcctctcttgatttaggcttgggctgacgacaaagttgtacatcctgaaccccaaagccgtgagtgtcatagaactctacggcatcctggacccaaccacccgagactggacagatggggtgttgtcaaacatcttcagggaaatcaacaagccaacagacaagaaggagcgaaagtgagtatctttgtaggtaggaaagagcctgggttagttaatgttaattagctcaacattaaaaacggtggcaggactatacattgtagcttcatgcttggatttcaacagacttagagtccagtcttggaggctgtgcttcggaagtgcgcagtccaatcttagtgctttttatgtgtgacctcagttgtcttagtgatgcaatgtggtaggtaccgggattgttcccagcttaccacagaggaaactgaggcctagaaaaggtcagaaatgtggcccaaggccagggatttggccctgatctgtgtgactctaagttctcaaacacagccgccatcaagctgcctgatcaccacgttctatggcaaggtaagtcaaggaaaggtagcaaagggccatggaaagtgcaggaatgccctcctgagccacggctttccatctgtagacgtggttgatggtgccctgatgacatcaccacatgccatggcaaaggccaagtgaggccaagtacagaaatgctctgagggtgtgtaaggtaaaaagcttttagttggtcctataatatctctttgctaaactcaggaatggttctgattttatgttctaatcaaatcccattaataataaataaaatccttaaataacaagagtccaaagtcccaactcatggcttttaaaacagcttcttagcgcttttcccctgattctggatgaacccaggattccacgctgaattccgttgtcttgtttttggcattctttaattttgagcagttcgtcaggatttctttatcttttatgaccttcctgttctggaggattccaggccaaccgttttagagaatggtctcggtttgggtttgtccgctgcttcttcataattagattcaggccatggctgtttgacaggaaggctgcaggagtgatgctgtgtccttctccgcatctcatcacgggcacatggtgttggttgccctattatgggtggtgttaatcttgattattgggttaaggtgccattttcctctttgcagttgatatgcaactctagggagataacttatgactaagtaaatatcccatttctcatccaaccttcacccattcacccaatggtttggagcatctgttgatggttacttgaatctggtcatcctcctcctcctcctcctccttctccttcttcttctcctcctcctcttcctcttcttgttcttctttcttcttttctttttttttgagaggggtcgtgctctgttgcccaggctaagttcagtcacatgatcacggctcactgcagcctcaaactcctgggctcaagcaatcctcccacctcagccttccaggtggctgggactgcaggtgcatgtcaccatgcccagctaatttttgcttttttttgtagagacagagtctccctgtactgcccaggcttgtcttgaactcctgggcccaaggaatcctcctgcctcagccaactacagtgctgagattacaggtgtgagccaccatgcctggccgttgagtccttttatagtgaatataaatggagactttctatagggacaactggtgaaatttgaatgtggactatacattagataatagtattgtatcaatattacatttcctgagtttgataattctgctgtggttgtgtaagagaaggtgcttattcttaggaaatacttgcttaagtatttaggggaagggggcattttatctgcaattgactctcaaatgattcagagagagagaataagagagagtgcgaatgtggcaaaaaaacgtaacaattggggaatctgactgaaaggcatatgggagttcttcatactgttttattctcataactctgtaagtttgaaattatttaaaaataaaaagctaaaaggaaaaaaatacaggaaggaaataaaccaaaatgttaatcctggaaaaaaaagatctaactgcttatatcagtgagttaaatggaggcactatcaaaccaccatttcagcacagtagaatagcctctgtcctgtggagatgggctttgctgcatgagatgtcacccattatagccacaaaatggaaccatcctgaagcttgaatacctgaggccttggacgtagacgtgctgccaggacacatggtgtgtaacccagggcttgtgaactcagatgctcccagggacccagcaggtagcacaaatgagtgaagtggagcaaattacatggtggtgttagtttcctagggctgccataacaaataactgggtggcttgaaacaacagagatttattatctcatagttctggaggccaaaagtctaaaaagaggtgtgagcaggactgcactccctccgaaggctctagggcaaatcctcacctcttctgcttctggtggttccaggtgttccttggcttgtgaccacatcatttcaaactttgcctctttcttggccttcccctctgtgtgtcttatgtctcctcctgcttttctcttataaggacatttgtcattagattaggactcatctgtataatccagaatggtcacatcttgagatccttaattgcgtttgcaaaggcctttctccaaacaaggtcacagtcacagcttctgggtgaacacatcttttggtggggggtgggtaccattcgacccactacacatggacatccaaaatactttctttattcttgactgtaccacaggaaaccaggggttaaaaccagtgataaatagcaattgatactcagcctcagatgtaagagaagaatgaggtaggagttgtggcaggggcagggactatgacactttctgtcttcatgggcagccactactcagcatcagctgattgttcccacgaaggaatccaggtctgtgtgctcagaacttccagcttgcccaagaagtgagaaattcagatttttgtgtgaagttccctcattcttaaatattggcaaagaactcaaacttttttttcttttttttttttttttttttgagacggggtcttgcactgttgcctgggtgggagtgcaatagtgctatcttggctcactgcaacctgtgcctcctgggttcatgcgattctcctgcctcagcctcctgagtagctgggattacaggcacacaccactatgcctggctaattttttgtatttttagtagagacggggtttcactatgttggccagactggtctcgaactcctgacctcgcgatccgcccaccttggcctcccaaagtgctgggattacagttttttatgtaccatttcagtcaaacctctgggccaactagggtgctctgtctcagatactgggtagaaaaccctgggaaaaagacattcaacatgaatgggcaggttataccaagttccataattggaagctctctaggacccatggctctcctttctttggttgctgcaggtatattttatttgatggtgatgtggatgctctatgggtggaaaacatgaattctgtgatggatgacaacaggttgttgacattggccaacggggaacgcatccggctccaagcacactgtgccctgctctttgaggcaagtagtgattaaaagtaaatttgaacataaatctttcttgtaattaaaaatgcaaatgtttgttaaagtagtagtaaatgtagatgattatttaaaaacaaacaatgcataagggtttataatgaatacaactctttgttctttactcctctcatccctctttatcccagaagtgactacttttactttttatgaattgtttcttctgatgattaccctagtgtctataagtaacaggcttagcatgatattcttcctttatacattttatagtttatacattatctgttgactgactgctacaaaagtgagaattcatctcttataccactaacgtcagaatagtatattgctaagttggttaacagtagataatgtttacattataatgaagatagaaataatttactgaagaaccaactaatatactacgattacatttactttcttttagagccatttcctttgtctagagtttgtaattgccttcctttttttccctcacactatttgcctttattttaatctcatttttttttttaaactttctatcatatcaagtattctgtcgagcccctttatttcctggaggctattctccaaagccctctatctcttaggatatggactgctcgtttcataggtgtggccctgggacttgctttcactctagcttagtattaatgccatttctaactgtaaaatttgtcagtgcatgaaatatttgtacatattattatctgattagctgactgaactatattttttttgtagagagagctaggtttgttaatatatctggtttagctttgtacttatgaagttttatactgcctgatctcaactatgttaaaaaaataataaagaaaaaagattgactggaaaacactccaaaacaacatttgtttctgggtggtgggatttggataacttattttcttctttatatttttctattttttgtcagatattctacaacgtattaattttcacattaattttataatagaaaaaccaaaaagatgttacatcagaagtgtgtaatcttctcatcaaaatcccaggtgttcagttaaaaagctcatggaagctgtgttgattttggtattatttggatttcatgcagttgtaaaaactttccataagagaaggtccttaaacatctagtttatcttgtgtatagctatagccatgattgattttctttatttatccaggttggagatttacagtatgcctcccctgcaactgtctctcgatgtggaatggtttatgtggatcctaaaaacttgaaatatcgaccatactggaaaaaatgggttaatcaaataccaaacaaggtgaaatttttttctaaaatgaacttaaatttattagtattgatggctagttggataacatagtccagagggatgtttgtagttgaaggcgatgactttgtccttgacctgcccatgtccctgagcacaaaataagtgaaaacatggcagacacactttttttttttttttttttttttttttttttggagacggagtctcgctctgtcacccaggctggagtgcagtggcgcaatctcggctcactgcaagctccgcctcccaggttcatgccattctcctgcctcagcctcccgagtagctgggactacaggcgcccgccaccacgaccggctaattttttgtatttttagtagaggcggggtttcaccgtgttagccaggatggtctcgatctcttgagctcgtgatctgcccgcctcagcctcccaaagtgctgggattacaggcgtgagccaccgacacaccgacacacttatttaatttcagatagtttatagccagtgggataggtaatgattggattggttggtctagaccagaggttgacaaactttttctgtagaggggtagatagtaaatgtctgaggctttgtgtgggcaatatgatttctttcacagctactcaactctgctgttgtggcatgaaaacagccagaaatttgtatacaaatgggcatggctgtgtaccaataaacctttatttacaaaacagatgacaggccagagtgtgtgttgtcttaacaaaaggcttctgtgaaaagtgcagagatggatgtgacagtcacgtgcgggttgtggctcaaccacacctaggacgctacgaccaccttctcaaaggaacacaggtgttctgggtgtgtctctagtagggctactaggttggaggtgaatggaaaccaggacataattatgccagaaaagagcagaacaaaggaagaacaaaggaagcatgacagaaccatctgaggcactgtcctgtgggagacagctgtctcaggacccttgcaatccctggtggtgattggtgctttgatagggaggggaccttcactgctttacagtcttttctggatgactgtggtcacttgaactctaagatgatcagcctctttcctgtcaaatgggacctgttatcttccctttttcttccccaagggcatggtagactctgtggcagcgaaatgaaacacttcatgatgagatgaaagcatattgcagaggacaaatctctctgcaaatatagggcactattatcaggatttcctcacctgccaaatgtatcattcatcagaagatgttgctcaaccctctttgggcaagaaaagctttccactaacttccatttaaataaacaaacccttgaaatgctttggaatgctacttttttataggtggagcaatacaatttgaatagtctctttgagaagtatgtgccctatctcatggatgtgatagtggaaggaattgtggatggaagacaagcagaaaagctgaagacaatagttcctcagacagacctcaatatggtaagaaatgatccctgctgttagcaaaaagaaattctttcctaaagacaagctcacggtagggttttaaagggagtgaagatgccagacagggtgaacagtagcattgttggtcagtgccaaggcgggcgccgtgcttgcttttgtgcaagtcaagatactgggttccatctgtctgaaccaacatgttgggtcttatgctcccatcgctctgggacctgggatcccaggatttatgactggaatggactctgtgggggtggactatgtgggctgaaccagatattttcctgtgaaccaggtaacccagttagccaagatgttggatgcgttgctagaaggagaaatagaagaccttgacctgctggagtgctacttcctggaggctttgtactgctctctgggagcctccctgcttgaggatggaaggatgaaatttgacgaatatatcaaacgccttgcttctttgtctactgttgacacagaaggagtttgggccaaccctggggaactgccaggtgggaaccgagtgtcgcctgtttccctgctctgagtgcctttggttaaatttctagaggaagtgaatgagcttttccatatttctgtctgtatgagttttccagattgtttgcttctttagagaaacatgcaatggtcagagcacatggcggaacacccaggagcggttcacatgcattgactgctgtgacagaagcccaggccctctgggtggtctttctggatgagagtcaacttctcttgcctcagcttaggcacttgcttcctttgctctttaaacttttcacattctgcatgactttgagtttcttcttctgtgggcttccctatctgtctttttaatttttatttttaaccatctatctccattttcaccatatcattcatctgctgtattcctgagtatttgcacagtagacaatcaagtgtggatttgtaaatcgttcataggaaatcatacaattaacattttatgtttttgcacaaaaatgtgcatcttcaatgaatcatacatgatgaaaaagatgcattctccaaggtctatatgcaatggtaggacccttctttatccatctcttattgctattcgagcatggcttggaatgtagatggcttttgaagttgtattttatactccttacctggtggtctttttaaagtttaaaatgaaatggcctccggtctttctaatggacagtcatggagcaaatcaaagatgtttttcaggtccctgctttattcggtgggagtctgagtgcacttttccagaactgaaatctccctttggggagtgcttttcagctccgccagccacgctggctgtgcgttgctgccatctgcaattccctcactcggagacaatgttggcctgcttccctggcttgtctccctcatttgccctcatcttgggggcctgaatggccctgtgggcatcccatttccagacacctgctcacagcttcagccctgcaggccctcgagcatacgcttgacggtgatctctggcactgtcatgtctgcatcacaaatcctgctctccacctactctgcctctgagactcgggccacatgtgtttctgtttggcctcatggggatggacactgtgtcgccccagtgtctgctgttgcctcgagcacccatacttgccccttccctgcatcctcacttccttggctggtggccttcacttcagccactcttgcctgagacctccgcatgccttgcctaattgctctgctgaatccctccgagaaaactccaagtctgtcttctctgcctgtctaagggctgacagggagaagaccatgcagccacaaagacagatgtctccataaatcccagtccccagctggcacactcactcctggctccaaaggagcattgggccttttccccaaatatctaccctgccctttccgcgctctccgcagctgatctttctccctgcttcaacaggaacaacggaagctgtctgataggaatctctccttccagctgaaaagcctatagctcctgtctctgactttctccttttacagtggaagaggccacccccactgcaccccagccaaggccaacccagccccttcctccttctcaggctcctcgctccatctgagtttatctctctctctcatgttcagtctccgcctctctaccatcctgtcagctcttagacatgctcaagtaaagccttgcatggcctgagcggaggcgatggtgattactcgggcacctgcagcttccatctctcccctgccccgcctgggttgctgccttcccgcattgtccgttgttcctgcccctctcctgctgcagcacttatggctccacactgaaatggccacttcttgcctgtatctgtcccccacctggccctcgaacaactgcaagggtagggaccagggctctctgcttcactgttgtattcccagggaagtgtatgtccagtgaaagggaagtgttagttgaaaatactcagaaagtgcctgacaagtgcacaagtcacattagtgactgtcccgtgaactagaagcataagctccaaatacttggcatctgtccagtgatgagtagcattagttcaaggtactcggtatctgtccagtgaaggagcagcattgaagtactcactatggcctccgtgcagtacaagcaacattagttcatttcaagcatgtgccagaactgcttttgtatttccgtgtttatgattcaagtgaaatcaaccatgatttcctgcaggtcaacttccaaccttgtatgactttcattttgataacaaacggaatcaatgggtcccatggagtaaattagttccagagtatattcatgcccccgagaggaaattcatcaacatcctgggtaagtcagagtcaaatccttgttcctgggtttaggagtgtgtgatactcgctctaggaggaggcaaagaagatcccatggcttctctggtactctaagtcccacgcagagagctggtagagaagaattgaagagggtgagctgtgggccctcctgggcatggagggtggccgctttggtatttttgtcagctgctggctctgagcatcttccgtggctctgcctctcagctctttccccagcaggccgatccccacaggcagatgagatgccgtttcgcctcccctggcctttccctgggctctcttcagtccacagagctggctgggtggggactagacggcaacgaacgaggcagtgttttataaagggcgctggcttgaaaagctgtgtgccatgggcgtttacctactgaaccacacttagaatgcacccctctggctgttcagataaaatataggctggctattcaggtaaaatatgggctgaataatttcacaaagcatgtgtctgactttggtccattgagcttacggagtgagacatccctgttttctcgggagcccatcagggttgaaacctgccagtgcaagagggagccagacccgatgctgtggcttcactgtctcttcggaggaaggtgttgctcaggaagttaaatcccgcaggggtctgagtgatgtcagcaacaaagaagctgagtttttgatatcctggcataagtcagaattgcatctcaaaaccggcttgggcgttctaaccctggactgtggtgatggtcgcgccgctgcagaactgtgccaaagtcaatcagttatacacttcaatgggtgaatgtttctgaggtcatgtcttggcctttgctcctgttttttatgggatttgtggggttctaggacaactccatgttgcccccagtgctcaccctattggagttgctgagatgcccctgttcctaatgtctactttagttcacacagtggataccactcggactacctggatattggaacaaatggttaaaattaagcaacctgttatttttgttggtgaatctggcacttctaagacagccactacccagaatttcctcaaaaatctgagtgaagaaactaacgtaagtcattattcatatgaattatctattgctgtgtaacaaattattccagtgcatagcagcttcataccacaagcactgtgatctcacagtttccgtgggtcgagaatgtgggagtgacttacctgggagcttctagctcaggctctcatgggattgcagtcaagctgttggccagggctgtagatacctggaggcctgggtagagctggaggatcctcatttgagatgacgtttcacatggctggaggctggaggcctcagttcctcaccatgtggctctctccatggatggcttgggtgtgctcaacatggtagagtgagtgcttaagatagatggcaaagcagatgctatgatgtcttttatgacctggccttggaagtcacataccctcccttctgccctaatctatgggtgagatagaagccaccctgtacaccctgatatagtgtgggagggacctgcaccagggcatggacacctggaggtgagtatgatctggggcccttttggaggctggctgtcacattattcaccatcatttttgggtttctaaaactttgcaagtgtttcctttccttcctccagccagctatgtgtccaatgtgtcgggggtcggatatgtacctggcatagaattcgcagggtgcacaggacaagtgatagtgaacaagctgtcaagatctgttctgtagggatttgcaggcagtggggggataaacatggagatgtgcacagggagcatggcagtgtttacagccagagggacctgcaggtttgtggagtcaggcactaggaagccgcatttgggagcctccttcacaacacccctaccccaggactctgcagctggtgctcatcagcccagccaggtacacctgaacacagtggctttagcaaggtacacattcagcttcaacacgttcagctcatgtgcacctgcactttgggtgccctacgtggagagagttatggaaggcagaggttcgttctcaaagtgtggtccccagaccggcagccttggcatcactggaaacttgttaaaaaaataccctagaccaccaggaatggtggtttgtgcctggtagtcccagctactcaagagactgaggaagaagggtcacttgaggctggtaattcaaggctgcagtgagctatgattgtgcaccactgcactccaacctgggcaacagagcaagaccctgtctcctaaaaatagcaaaacaaaaacaccctgatctaccaaattggaaactctggggaatggagcccagcaaggtgtgtggcacaaaccctgcaggtggagctgatgcataattagttaagtgtgagaaccactaatcaaggagctctcgccagcctaagcatggcaggagggcctgaggacacatgcatgagcatccagggggcttccctcacccttcctgccggcagttagtcccaaagcctgaaccacttgttcatgctctctttgacctatttagatacagccagcatgatagtgatttatgtttgaatattgtcatattgaaaatactgttggatattgcatctcatacgatgcaatagctctatgaagtagtcctaagagatgccattacgatcgtcttacaagtgagaaaaacgaggctctgaaaggttgaatgactttttggaagtcgccttgctagaactgtgcagaaacaagaccctcagtctactttcttgtatgccacattgtccccaaggctcacatgcgacaattcgctattgactcatacaatctgctgaaaggaaagaggaactcttactttagcacttagaaaataatgaagcacagtctcacactgggttattaaaaagttagttcagaggccaatggatttgcaaaatagttgctagcttatttgcaaatgtttactgctgctaccctggggaaaaagctggcttttcacatcatctctttctgcttcagattgtgttaatggtcaacttctcctcccgcaccacgtccatggatatccaaagaaatttagaagcaaatgtggaaaagcgaaccaaagatacttacggcccacccatgggaaaacgcctgctggtgttcatggatgacatgaatatgccaagggtagtttgacgctcaagcaggtggagggatgggtcaagacagtgcttgtgtttgcatgggtgtgtgtgtgtgttagaagtgagtatgagaacattgatctttacctctgtgcaatgtctgcagggtacaggctgcggggagccagcctaaggcagaatgtacctgggatgctcttcttacacagagggacctttccctgactgatcatgttccttagtttcttagaggagggaagcaggcagccagcagcctttgaactaaattcagcatgtatttgaggaagtggtttccaaaggagctcttatttagataataatactgttgttggccccgtgtacatgggaggcatcaggacagacccttcccaagaattccgctggactcttcaaggaagagaaacttcagctgcattatgagtatgtttctgggatctgagcctgagaagtgcaaagttttcttggcatactagaatttaaatttatattatttcattgaaccatttttttctgaaagtctatttccagaaggactgtatgcaaagccagagtccgtccgtccatccatccatccatccatccatccatccatccatccatccatatgttcattcatctatcagtctgttcttccattcatccatccatgtgtctgtttttttcatccacccatctgctatttacctacctatctgttcacccatccaaccatccatctgtccattcattcatagatttgttcatctatccatctattcttctttttgcccatctgtctgtttttccatctacctgtccatttatccatctacccgtccatttatccatctacccatctgttcattcacctgtccatccatctacccatccacccatccatccatccatccatccatctacccatccatccatccatccatccatccatccattcaatggatggtccaatctgtctgtcattatcaatgtatgaattaattacccaatgtctttgcttatgttaaatgaagaaaggacaaatgcttgtcttaaagcttgatgctttgtaagcccctgagttgaaacaggtgaaaccaagagaagcagaagtgtcgatgtgtggacaggcatatcacaccccctgggtggcactgcattgttgaattcttgtctgtccatctgtctgtccatctgcccatccatcaatttgtccattcgtccatctgtccatccatccatccgttcattaattgaattaacatatatttattcagctcttcctatgggactggtgctgtgtagtcaacacctatgcagttcctgccctcatgaagctgtagtatcgtaagggagacaaacttcaaaaaacacaatcacaaatggatatatacagttgcaacctttgagaagccccatgaaactgaaaccgaggtgccctggagagtaacgggaaaaatgagcttgagctgggatggtcagccaacgcctctctgactcctactttgcgatactactgttctcttttcttttttaaaaaaaatcaaggtggatgaatatggcacgcagcagcccattgccttgctgaagctgctgttggaaaaaggctacttatatgaccgtgggaaggagctgaactgtaaaagcattcgagaccttggctttattgctgcaatgggaaaggctggaggaggccgcaatgaagttgacccaagatttatttcgctattcagtgtcttcaatgtgccatttccttcagaggagtctctgcatttaatttattcctccatcctgaaaggccacacctcggtaacttgattttaactagaagtctaaaccggaagaccttgtgttggggggaaacatacacagggctgacttatccatgtaggcacagcagggttagggccctcaatacttttaagggcctatgaaaatgttttaatttcttgcaaaatcagaagaaaaaaatcatctttatacgatgccattataaaatgtaattgtaatgtatttttatggaggaagaggtccatggaggtaaaagtgccttgggcccgtgggagtcctgatgtggccctgaggtgctcatgccacattgagtgacagcgaagaatcaactagcaggctggggccctggagtcagtccccttctgctccgggagcaggtctcttgaactctcctaacctcattctcatttggagcggggagatcatgatggtccccacctcactgggttttgggaggatgaaaggagagaaatgcgtgtaaagggtgcctagtgcacactgcctagtgcatagcagctactcattggttactagttactgctgttattattatgatttacttggctcctccaaatggaacccattcatttaaacaaccatcttctgatctggcgtttccctgctaaagcggagtctgcacactcggaggctccaggggccaggtgggtaagataaaggtgtggagtggccaggcctgatcagtaggaactatgagcacctggcccgttcatgccctacctgaaggcatttgctttcaaaacggtgaggtccgtgctggtcaaataaaactcccaccgagggctggttggggtctttggtttcacatcatgttgacttcacagttaatgtgaaaatctagagcaatacaaaaaaatcaggcccggtgcagtggctcacgcctgtaatcccagcactttgggaggttgaggcaggtggatcacttgaggtcaggagttcaagactagcctggtcaacatagcaaaacctcatctctactaaaaatacaaaaattagccgggtgtggtggcaggcacctgtagtcccagctacttgggaggatgaggcaggaaaattgcttgaacctgggaggtgaaggctttagtgagccaagatcatgccactgcactccagcatgggcaacagagtctcaatctaaaatacataaaaaaataaaaaaattaaaaataagtagtaaaattcacataatggctgggcatggtggctcacacctgtatcccagcacttcgggaggctgaggagagcggatcactcgagcccagcagttcaagaccagcctgggcaatgtggtgaaaccctgtctctacaaaaaatatgaaacattagccaggtatgatggtgtcctgtagtcccagctacaaaggaggctgaggtgggaggatcacttgagcccaagaggtcgaggctgcagtaagccctgatcatgcccctgcactccagtctgggaaacagagcaagaccccatctcaaaaaaaattcacataacacaaaattcgttattatagccattttaaagtatacaattcagtggcacttagtccattcacagcgttgtgcaaccatcagcaacgtctaaccccagaacattttcatcaccctggaaggaaacccacacacattagcacttactcccatcccacctctcattcccaggaaccgtgactctaccttctgtctccatggagttttccatgttgggtatttcatataaatagagtcataaagcacgtggctttctgtgcctggcttgcttcactcctcatcatgttctcaagggtcatccgtgctggagcttgtgtctgtcagtgcttcattcctggtttgttttattttgttttgagatggagtctccctctgtcacccaggctggagtgcaatggcgtgatctcggttcactgcaacctccgcctcctgggttcaggcgattctcctgcctcagcctcctgagtagcaggaattacaggtgcgcaccaccatgcccagctaatgtttatattttattttaatagagatggggtttcaccgtgttggtcaggctggtcttcaactcctgacctcaggtgatctgcccaccttggcctcccaaagtgctgggattacaggcatgagccaccgtgactggccaacttcattcctttctatagcttagtaatagtccattgtacggctctgccacattttgtttattcactcatctactgaaggacatttgtgtgttggggggggtgtctttgcatttttcagacgtttcatgagagcattgtggctgtgagtggcaagctgacattctgcacgctagcactttacaaaaatattgtgcaagacctacctcccactccgtcaaagttccattacatcttcaaccttcgagatctctcacgggtttttaatggtcttgtcctcactaacccggagcggtgagtttgatttatcttactaaaatatgccccacaggtatgatagttttcttattcttttaagacagagggcttatcagtggatttgatgaatcgttgtatgaattaattacccaatgtctttgcttatgttgaagaagagagaccaacacttggcttaaggcttgatgctttgtaagcctttgcattgaaacaggcaaaaccaagagaagcagaagtggggacaagcctatcacaccccttgggcaggctgtgttgttgacttctcgttttcagttctgaagttggaatttgcctgcatggagccttttgctcacataactcagtcgttgccggttggttataggatgtgtgtctttatgagaagtaagcagaggacagaaaggatttaagtcacgatatagggaaattcccgattaaaactaggcttatacctttacatgaatgtctactttagtctatgtggatttgcaagcatagtccaattatgtggattcatattatgaatccagaagatactgaaaaatgaattgagaattttccatgtatcctgcttttgagtgccttgaaacatacagactgtcaggggcggtcaggagagggcagctccaggtgtttcaggtggagtgacggttctttgctagaatgcagggaaagttctggaattggggccagattgagttggctcttagaaaaaggagctgtcggccaggcacagtggctaatgcctatagtctcagcactttgggaggccaagggaggaggatcacttgagcccaggagttttagaccagcatgggcagcatagtgagactccatctctacaaaaaaatttaaaaaattagctgagtgtggtggtatgtacctgtagtcccagccacttgggaggctgaggtgggaggatcacttaagcccaggaatttgaggtggcagtgagctatgattgtgccaatgcaccagcctgggtaacaaagcgagaccccacctcttaaaaaaagaaaaaagagagaaaaagaagttgccagtgaccctgatgctgattttaaattcatgtattccaacaagtagggatgatgtcaggtacttattttacgtcatttatagacaacgctctttttttctttcctacagtaagataagctacggatgatgactttagggggtttacattactttcttagcttctgttggattctctggttagatttcattaacgtgagactaggggggcacgactggagaaatgttgggcctttattgcgctctgtgtgtctgtctgtctgaatgtcacagccgtcagccctggtatccttcaggtgacttcctggctgatttttgtcccttccattctgcagattccagacggtggcccagatggtgagagtctggaggaatgagtgtctgagagtcttccacgaccggctgatcagtgaaacagacaagcagctggtcagtacatccaatgcttcttctcaggaaattcttctcaggaaaataaacaagcgccaaaagtgttttttatattaggacgcgaattgtggaaaaataggcacgaaaggtcaatggggcaaaggagggtgggtgggttattaagcgtcttgcagcaactgaaaaaaaatagaacgcaaattattttagataatagtacgtatcctctgctcctagcaagtttcaggccgtgtactgttgttgagtttgggtccttaagtgggcttctgtttcaaggtacaacagcacataggcagcttggttgtggaacattttaaagatgacgtggaggtggtgatgagggatcccatattgtttggagacttccagatggctctgcacgaaggagaaccacgcatttatgaagacatccaggactacgaggcggccaaggctctgttccaggtggggatgagccccaccctgtccatgggctcactttctcctgagcatgggccaagcgggagctgagcatcgcgcgggtgcccgggagcctatcacctggggctctgtctgagggcttgaaatacgggcttgtgtctggtccggtggttcccacatccagcatgcttgggagtgacgttaggaaattgttagactcctggggccaccccgtgagatttgctgcgctgggcccatggagggtccccagattctggtgcacagccaggtttgggaaccacttgtttgactccctaatattcattttcatttaaattcatgagatgagccttgttaccggctttgggtcgctgctggccaatcaaagcccagcagatggaaatctcgattgtgaaagctagattagtcctggagacccaagcagtttaattattttaactactatagatgttcagaaaaatctctcttccattcttaatctcctctggacaaaaggagggagtctgtctcttaaaatccagtgatcctttaagacattatttatttatttatttattttgagacagggtctctctctgtcacccaggccacagtgcagtggtacgatcacggctctctgcagcctcaacctcctgggctcaagtgatcttcctgcctcagcctctggagtagccgggactatgggcacacatcaccgtgcccagctgatttttttgtttttatttttgtagagacgtagtcttgctctgtggcccaggttggtctcgaactcctgggctcaagtgatcctccctcctcagcctcccaaagtgctgggattataggcatgagccactgtgctgggttttaaattctctttttttttttaatgctttaaattctagggtacatgtgcacaacatgcaggtttgttacatacgtatacatgtgccatgttggtgtagtgcacccattaactcgtcatttacattaggtgtatctcctaatgctatccctcccccctccccccaccccacaacaggccctggtgtgtgatgttccccttcctgtgtccatgtgttctcattgttcaattcccacctatgagtgagaacatgcggtgtttggttttctgtccttgcagtagtttgctgagaatgatggtttccagcttcatccatgtccctacaaaggacatgaactcatcctttttaatggatgcatagtattccatggtgtatatgtgccacattttcttaatccagtctatcattgatgggcatttgggttggttccaagtctttgctattgtgagtagtgccgcaataaacatacgtgtgcatgtgtctttatagcagcatgatttgtaatcctttaggtatatgcccagtaacgggatggctgggtcaaacactatttctagttctagatccttgaggaatcgccacactgacttccacaatggttgaactagtttacagtctcaccaactgtgtaaaactgttcctatttctccacatcctctccagcacctgttgtttcctgactttttaatgattgccattctaagtggtgtgagatggtatctcattgtggttttgatttgcatttctctgatggccagtgatgatgagcattttttcatgtgtcttttggctgcataaatgtcttcttttgagaagtgtctgttcgtatccttcgcccactttttgatgaagttgtttgattttttctcgtaaatttgtttaagttctttgtagattctggatattagccctttgtcagatgggtagattgtaaaacccaccatgctgggttttgaattctttttttttttttaaatgcaggaaattcttgaagagtataatgaaagcaacaccaaaatgaacttggttctcttcgacgatgctctggagcatttaacccgggtgcaccgtatcatccgcatggaccgcggccacgccctgctggtcggggtagggggctcagggaagcagtctctttcgaggctggctgccttcacagccagctgtgaggtcagtccacgtaccctcccagaaataggtttacgatgccagtttctgcagttggtagttcgtgtacatattggaacaatccacagcagatcatagcatgatgttttcatagagtatcgaggtgggtgttttggtttgttttattttttcttgtttttggcttgatattactatattttaactgaatagccagagcatctaagtacaggtgttctttggcttaggatagggttacatcctgataaaataatcataagtcaaaaatattgtcagttgaaaatacatttaatatcccaattaacccatcataaagttgaaaaatcctaagtggaaccatcaaagccggggaccatctgtattgctttgtttttaggatggagaatgtcagatcaagttagaaagtcaaatacaagcacatcctgtgaacggtgatgtgtgttcatatggggagggcttggcccaaacctcagtgcacccatagtatggggctggcaatttgctggctgccatatctgcacagcctgcacacacagatctgggttaatcttagaatcttgtatttttaaacagctttactgagattgaattcaagaccatacaatccacacattcaaagcatacaagccagtgcttgttggcacattcacagatctgtgcaaccagaccacagtctactttagaacacttctgtggcttcggccgggcgtggtggctcataccagtaatcccagcactttgggaggccaaggcgggtggatcacctgaggtcaggagttcatcatcacccttgccaacatggtgaaaccccgtctctactaaaaataaaaaaatgatccaggcatggtggcacgcacctgtaatcccagctactcggaggctgaggcaggagaatcacttgaacctgggaggcagaggttgcagtgagctgaggtcatgccgcagcactccagcctgggagacagagtaagactctgtcaaaaaaaaaaaaaaaaaaaaaaaaaagaacattttgtggtttcaaaaagaaaaagaaatcccatgccctttagtgatcaccaccctgacctctgcaccctcccctcatcaagccctgagcaactaacggactaatctgctttctgtctctatagtcttcctattctagactttcatgtgaatagtgtgtgtgtctattttgtgtctggtatctttcttttagcacagtgctttcaaagttcatgttgtagcatacatcggtacttcattttttttttgccaaataggaggccctcgtgtggctatgccacgtttcctttatccactgctgggcgtgtttgttgtttccacctgttggcttttgtggacagtgctgctgtgagctttcatgcacaagtttctgtgtggacatgtgtttgcattgctcttgagtatgctcctacaagtggaattgcgggatcctatgataactctatgtttaattgtttgaggaacctccagggtgtggctgcaccgttttccattcctaccagcagcgtctgagggttcctgtttgtccacaccattcttagaatcatacaggtacctcctgcaggttccacaggtaactcacctgcaaggggcctctcgaagtggagcagacactatgcattgagatgtaatttgaagaagagtcatgtccctcattcacccttttctccccgactcttcattagttctctggtatctgacttctttcactattagggtctcccgttatccaaaatgcctctgtttttgcctctggttgcatgatacacatgcatgcttataatattttcaatttacaatggatttattgagacgtagccccatcttaagctgaaaagtgtaccctaaaatgcaactagtacctaacagcggctatctttaggtgatgaaattacaaatgatctttattttctttagacgtttctgcattgcttgaattgttgcaatgaggattattccatttagagagagagagaaatgagtgagtccataacaatagtgattcttattccatgcaatggactgaagttttgtccgtgcctgttctgggtgtgtggtgcaggacgggatctgtattcagcctcagttcttctcagatgctcagccacccctcatgtctacctcagaaccttttgataagtccacctttagagaagacacttcttgcagaagggtcattttcatgactcttctcctcctggcaagcaagaggtgttctttttcttcgcccccgagatggagtttcgctctgttgcccaggctggagtgcaatgacgtgatctcggctcactgcaacctctgcctccccgggttcaagcgattctcctgcctcagcctcctgagtagctgggattacaggcatgtgccaccacgcccggctaacttttgtatttttactagagacggggtttcgccatgttggccaggatggtcttgaactcctgacctaagaggtgttcttttgcacagactttcttctttgtcttcagtgtgttttctggaatcagatttaactcagcatcattgccattaccacagagagtcttaggcagttcaggctgttataacaaagtgcgatagactggctggctcgtggacagcaggtgttcgtttctcaccattctggaggctgggaattccaagatcagggtgccagcatggtcgggctccagagagggccctctcccgggctgcagatggctggcttctcatggcattcttacatggatggatgacagcacgaaaagtctttggggtcccttttataagggcactaatcccattcgtgagggctccaccctcatcacctaatcacctcctaaaagcccaacctccaaataccatcacattgggggttatgatttcaacaaaggaattttgtgtgtgtgtgtggggagaacaaacattcagtctattgcacggagtaagaatcactattgttatggactcactcatttctctccctctaaatggaataatcctcactgcaacaattcaaatgatgcagaagcgtctaaaaaaataaggatcacttgtaatttcatcacctaaagattgccactgttaggtaccagtagccttttagtgtatacttttctttttttaaattatttttctgttattttcatttttggtctgggaaccaacggaataatgtacacttttcaacttacaatagggctgtctcaataaacccatcataagttgaaaatattataagctgaaaatgcacttttgatttatatattcaacttacaatgggtttatctggatgtgaccccatcgttaagttgaggagtgtgctgaaagtgtagcacttttgcgccatggcaaagtcaaaaagttctaagttgaaccagaggaagtcagggaccatatgtgcattcatacacaaacgtatttccttcttaccagcaatgggttaaagttatatgtaacttatgtcatttttccccactgtgtcactgcgtctttccaagtcaataaatacatatttacattgtctttggaagcgttggacagtattctattgtttggatatgccacacataacccatttccaatggcgggcatttagctttgtccttgttttcttattactaacagtgcagtgatgaacacctttgtttatgtatctttgaatattgttcatttttttttccctataggatcactttctttagagattggtaagttggcaggttaaagggtatatgctcttttacagctttggttgcctggcaccagatttcgcactgggaaggttggatctaaactcatatggagtttgcctctttggagtggaaaggacctggggatgcaggacagaaggaaaggaaaaaagtgtccttattaacaaccaatcaccccaccacaaaggattatgctaatttatgcaactggcagtgtctgttttcacatattcttgccaatactagatattgtcatgctgatatttgtcaagattataggtggaaaatattgcagtttaaatgatcctttctccaattaatagtaaagtttgaatatccttttatacattttttggacatttaccttttctcttttgtgtattgcccctttatatacttattgagttgtgagaactctttatataggagagcaatcacagttcattcaatgaatccagcttccaaaatttcacaaatattggccttttgtttgaggtatttgtaaaaaagggaaaaactaatatgcttgatctagctttaaatctgatgaaatacataattgaaatcattcattgttaaaatataactgtttgcaattgttttccacatttttctataggacaaggcattccccactggaaagttttattattttttttctgttgatttgtccaggtaaatctgaggcattttcccctaaagtagcgcctcgaggaacagcagagaggatgttgagggacagagatctggaggaggttgaggacacacagggctgtgtctgggccctaggaagtggcgagggttgggtagtggggtcagaacaggtgttcagagagtagtgccaggagctgctggggaggggaggcggctgcactcgggaggggtgaggaaggtttgcaggcgacaggcagaactggagaccagagtctattggccagaaggcatcctggttgcgttgcgcgcgcgcgcgtgtgtgtgcacacgtgtgtgtgtgtgtgtgagcatgtgttctagtgcatgccagggtgcaagtgagtgtgtggctgagtgtgaacatgtgggaatgactgtgtgagtgtgacagtgtgagtgaagcgtgtgtgtcaatgcatagggttgagggaggtagggaacagagagagatctctcagttcctggaaatctgccatgtttctgacagtcgctggttgcaatgaaagttttaatttctgcttctgagctaaaagaaacacttgagcagaaaaagcgtgctttaaacttatgtccttattcacatttacatcgatttcgtgtgtacattgatttcctgtcacgaagttaaagtgcctgcttatttctccctgtgtgcgtcttcccacagggtctgattttctgtaaactgcagtatgtggctggcgttcaccttggggtacattcttcccccctttcctctgttgctgggctcatggggcttccccctcctctgtttcatgacagggagtcccttccagacttttctttcctgacctacttcctcgagcttggacagacccacgccctctgcactctcctccagcgtccccaccccggagcccgcagggaagggaggctggtggtggtgacgcccatgtgctctgtgtctgcatcgcaggtgtttgagatcctgctgagccgaggctactcggagaacagtttccgggaagacctgaagagcctctatttgaaacttgggattgagaacaaagcgatgatctttctgttcacggatgcccatgtggctgaggagggcttcctggagctcatcaacaacatgctgacctcaggtacagccaaggctggcgcccgctgtggccaacaccccgctcagctcttaagggagttcactttcttcagcagttaccacctccagacactgtgggtagccctgtgcgggtgtacctgttcctccctcacggcggcccctgagataggtctcattatcttccttggctcctcctgtcctggagtctcccgagtgtgcccccttctctccgtctgcgatgatggcagtatccttgcagtaagaacaggtggtgtctgggcatctggccgtgccccgggctgtgctaagtgtgcatcatacattcccgtctccacaaaaacttgatgagaggccaggtgtggtgcctcctgcctgtgatcccagcactctgggaggccaaggagggaggatagcttgagcccaggagtttgagaccccgtctttacaaattttttttttcttttttttttttagatagagtctcgttctgtcttccaggctggagtgcagtggcgtgatcttggctcactgcaagctccgcctcctgggttcacaccattctcctgcctcagcctcccgagtagctgggactacaggcacccaccaccatgcccggctaattttttgtattttcagtagagacggggtttcaccgtgttagccaagatggtctcgatctcctgaccttgtgatccacccgcatcggcctcccaaagtgctgggattacaggcgtgagccaccgtgcctggcacaaaaatatttttaagaagttagccaggcatgatggcgtgagcctgtagttccagctactcaggaggggcaggaggattgcttgagcctgggaggttgaggctgcggtaagtcatgatcatgttatggcactccagcctgggcaacagagtgagaccctgtctccaaaaagaaaaaaaaacaaaagcaactgaaaaacaatcaaacctaatagggaaggtaccattaacatcctcatttcacagctgaggaaactgaggcccctgtagagggctgaatggcggccctctaaaagacacatcctaaacccctggatcttgagaacgagacctttgtaagaaaaagagtctttgcagatgtaattaaattaaagatcttgaagtgccttcctggatttagggtgggtcctaaatccagtgacagctgtccttataagagaaggcagagggagatttgagacacagagaataaggtcccataaagattcccacaagtcacgggacacctggagccaccagaagccagaggaggcaaagaaggatttttcccttggagctgttggcaggttaccctgagaccttgatttcaggcctccagaactgcaagagagtcggtgtctgtatttcttgtctgaagccactcgctttggggtaattagtcatggctgccccagaaatctactagagatgccacctaccttatccaagggcaccttgctgggaaggcactgaggtgagactcgaacccaggatttttagcatcttagccacgctcacaaccactttaccgtgttgttatcttgtctaccctggggccctgcaaagatccgtgctgacttcgtctggcctaatggcttacagggacctcctttctttcccagggacctatttcatcgattgcttgtttgtttcagcacctgaccatattcattattgtattgctgtgttattcattgagccccagcctcccagcatttactataaaaaatttctaacataacagtgaggctgaaagaattttttctgtgaacatctgccggcatgccatctagatccctcctttctcgccttgctgcacttgctctgccatgcgtgtaaacagctttccctccctccctgcttccgcccttctcgtttttagatgcgtttcagagtcaattgcaacatcactgctctccccgctaaatgcttctgcgtgccactatctagagttcaagttttgtttagtgttttcttttgatgtaaaatttacatacagggaaacgcacaacattttaagtgtatatttgctgcattttgatcattgcgttttaagttgcgtctgtttcagtgggttgtcggctccttgagaggggggatcgggtcatccacctggatttattccacagtgtttattccagacactgggtttggtagggaataagatggtcatgacctctgccctccttggagcatacatttcagcgtgtgagtggactggttaacgacaacaacaactacacaaagagatacagcaattgcagattgtggtaagtgccgtgagtgcaaaggggagttgctgtgagagagagtgtgggcaggagcatctcagggcagacagggaaggcgtcactgtagagacttttcagctgaggcctgagagatgctgtgtgatcacactccctatggctgctgtagcaaatttccccaaacagcacggatttattcccctatgcgcctggaggtcagaaatcagaaaagggtcttaaggggttaagatcagggtgttggtggggctggttccttccagagcttcctggggacactctgtttccctgtctcttccaactgcttcaggccacccgtttcttggctctttagctcgctggctctcatccttccagtctctacttctgtcatcctgatgcaaactcagctgcttctctcttgtggggacccctgtgatcgtctccagcccacctgggtaattgagagcacgcgctccatcccaccatccttggctgcgtcacatccacagagtcctttttgcaggaaacataaagaaacccattggccggttcctgggcttaggatgccatggacacctttagagggctgttgtgcagggatcaggacgaggtggaggggttctatggcgtggaaccttgtaggtcatttataggagataagattttattctcagtgcaatgacgtagtccagatttatgggttttttaattttttagatttaattaattaattatttcagagacagggtcttactctgttgcccaggccagaatgcagcggcatgatcatagctcattgtagcttccaactcctgggcttacacaatcttcctgtcccagcctttcgagtagctgggactacagatgcatctcaccacaaccagctgattaaaaaaaaaaaaacacacttttttttttaagaggtggagtcttcctgcattgcccaggctggtcttgaactcctgggctctagtgtttttcctgcctcaccttcccaaggtgttgagattacaggcgtgagccactgcacccagccaagatttatgtttctaaaagatccctccagtgcgccgtggggacgagattagaggggaacaggagtgggagaggggcatccagtttggagctacccctgcagtgtaggcaggaagtgacagcgattggaggagggtagggcactggggacagagagaagtgggtggattcacgaggtattcaggaggcagagccaacgggacttcgatcgatttggctgtgggttgggggaggggtatcaagggtgactcccaggtttctggtggagcgagtgatcagtgcttccatttgctgagatgaggaagaccagttctgggcttgtggcattaggagcgtgttgagtttgctgcactagatgagaatctgaatgtgatgtcatatagtgtattagtttgctggggctgccgtcacaaaatgccacaaactgggtggcttaaaacaatagaaatctactctcacagttctggaggccaggagcccaagatcacggtgtcggcagagcccgttccttctgagctctgggtgggggaatctgtgttgctggtggctgctgacagtctttggtgttccttggcttgtaggcacagaactccagtccctgtcttcgttgtcacgtggccttccccttgtgtgctgtctgtctctgtgtccaaatttccctcctttataagggtacctgtcatattgcattagggcccatctcaatgacctcatttcaacttgattatctctgtaaagacaatttccaaataaagtcacaatctgagctactttggggacttcagtatatctttttcagggcgacatgcaacttcaaccgtaatacataggcagtgtgtacatgagtctggttctcagaataggagcctagggtggggacgtcaatttcagagtcactgacatgtggtgggacccgagtgaaccatccagggagagcccagcactgagttcaggtggaagaggaacgagcagagactgagagggcaggcggagcacggggagcgagagactgagagggcaggcagagccccgggaggaagagactgagagggcaggcagagcacagggagcaagttcctctttgtcttttgggagtcttgggctccctgccaagggagggatccctctcccttgttgaatatccccaagaccatccccggctccgtgacttgctaggaggactcgcaggactcagcatgtggtcctgctcatggctgtgagtcattacagcaaaaggacacagagcaacatcagcagagggaaaaagtgcatgggggaccctagggaagaccagtctcaagtctcagagtcctctctccggggagccacacaggacatgcttaatcccccaacattgagttgtggcaactcgtgtgaagtactgcccaccaggggagctagttggagactcagtgctccgggatttccttggggctgctcatgtaggcacctctacctggcatgtgccaaaatcccggatgcccggagggagagcgggtagtcagcatagaatacgttgcatacccaagcagtgtgggcacaatgttaggctgttcttgcattgctataaagaaataccttagactggttttttataaagaaaagaggttcatgtggctcacagtgccgcaagctgtacaggaagcatggtgctgatttctggggaggcctcaggaaacttacagtcatggcagaaggtgaagggggagcaggcgcgtcccatggccagagtgggagcaaggttgggggaggggccacacactttcaaacaaccagatctcacgagaactcactcgcgctcacaagaacagcactaagaggatggtgctaaaccatccatgagagatctgcccccatcatccagtcacctcccaccgggccccacctgtaacactggggatcacaattcaacctgagatttggtgcggacgcagatccaaaccacatcccatattgggccactcttatcagtgaatcggggaggaagctcttaaggaaactaagttcccaggtgcctttcagaggtgagcagccgtggcctgccacgttaactcttccctgcacaggagaacgtcagagatggcataaaatgtattgcataatttgaaacggcgtagatataggaaaaaagaagtccacgtagccagggtttctcgactgcgtgccgttgacatttggggctgggctgttctttgttgtggtggggctctcctgggcactgtgggaggttcagcagcatccctggccttgacctattagatgccagtagcaacctcccttgcaacaagcagaaatatctccagacatggcccagtgtttcctgggggcaaatcccagctgagaatccctgcttcggagttacaggcaagtgaggcctcctcatgctctgcatgctccctgtgatgctcacggtcatcctcccaggcgagctggcggcatctaggatccccgtttgacagacaggagctggaggctctaagggcttgccacgaggtggcagggagcctcgggtctcaggtcaggcccacacgctgctctctggactcagcacctgctgatctttccacaccttccatcactcagtcagcacttagagcggtcatgaccctgggactcagagagatcaccagcatgtcttccttttccaggaattgtacctgcgcttttttctgaagaggagaaagagtctatcctgagtcagattggacaggaagctctgaagcaaggcatggggccggccaaggagtctgtgtggcagtacttcgtgaacaaaagtgcaaataacctgcacattgtcctgggcatgtcgccagtgggggacaccctgaggacctggtgcagaaacttcccaggtacccgcggtggagcctgtgaacccatttcccctgctttggcagagtgtgtggctgagggtctgtccacacctctccaggttcccccagcaaagcaaaacaagacacggccattaggtggaaatgtgggctctgcactgtagcttggggctcactgccccttctaggtgccagtgggcgtgagtgatgtccctctgacaggaggatgtacccatgctcctccatgcgaggcccgcagtgcatggacggtggctccccgcttccttccatttgggaaaattccaccagcctcatgccagcctttagagcagaggttcctaatgggcggggcaggggcgggggaggttgtgttctaggggactcttggcaatgcctggagacatttttggtcatcacagccccggggagcatgcagtgtagtactggcatctagtgggtagaagccagggatgctgtgaagcatcctacagtgcacagccagctgctgccacaaaggattagagcccagatgtcaatagcgccaagggtgagaaactctgcttttgatgaactagatttggacacatctggctcattcaccaacttgttggctattgaagatggcatccatgttcttgagtgtctcagggttgcagaatgagcatccttttttttttttttttttttttttttgagacagaatctcgctctgtcgcccagattagagtgcagtggcaccatcataggtcactgcagcctcgacctcctgggctcaaatgagcctctcacctcagcctccctagtggctgggactataggcgcacaccaccacgctgcctggctgattttttttttctttgagacagggtctcactctgttgcccagactggagtgcagtggtgtgatcttggctcaccacaacctccacctctcgggttcaagcgattctctcacctcagcctcctgagtagctgggattacaggtgtgcaccactactgcccggctaatttttgtatttttagtagagatggagttttgccatgttgtccaggctggtcttgaactcctgacctcaaatgatccacccgccttggcctcccaaagtgctgggattacaggtgtgagccaccacacccggccctgatttttgtattttttgtagagacagggtctcgccacattgcccaggctgggagcatctttttaatctctctttcctttcaaggtatggtaaataacactggtattgactggttcatgccctggcctccccaagccctccatgcggtcgcaaagtcctttctaggtaagtcacagctgttatgggaactgcattattgataaaacaaagcaatttattttcccttttctgactttgaattctggtcttgtagatttcttcactggaaaaccctatggtaacaaatggctttcaattttgttagtatgtttttggtttatatttggtgttttagtccaaagacatttcaggagacttagcaaggacaatttaggataaaaattgattaggtgttctccacagcagcagttggcaaaaccatggtctgctgtctagttggccccttacttgttttagtaaataaagttttattggtacacagactcactcattaattaacatattgtctctggctgcttttatgctacaaccgcaaagctgaataattgcaacagagaccgtatgagtactgttcggctctttgtagaaaacatgtgctggcctctatccaaagaatgctccaaggacaattcagcaaacattctgcattctcattgaatttctagcgtttcaaacacctaaggccttggatattaattttaatgtttgaataagaaaggaagtctgtcttcagggaacatctttttcttttgacctaacttgagcagatttatgatgaatgacactgggtaaccttgaaaatagtttcaaccttctaaatctgtactcaataataaataaataaatgttcctatatgtaagaagaaatcataactttaatcataatgcagttttgggggaaaaggggccaagagaatgactcttttctgatgatatatctcaggtccagatggtaaatatttacagctttttcgcaactactcaattctgccattttatcatgaaagcagtcatagacaatacgtaaatgaatcgctatggctgtgatccaataacactttatttacaaaaacagggggcgggctggatttgtcctttggcccgtagttggccagccccaatatagatgtccccttgttctcagaggcgtatttgccgtttccatgtgtgaagtgcttgtgtttgctttcagtattcagtgattcagcatcataaataatgctgcctagaatttgcttagaacttttttgtccttagaatatactccctggaggccaggcgcagtggctcacacctgtaatcccagcactttgggaggctgaggcgggtggatcacttgagcccaggagttcgagaccagcctgggcaaaatggtgaaaccctgtatttactaaaaatacaaaaattagctgggtgtggtggtgggcacctgtaatcccagctactcaggaggctgagccatgagaattgcttgagcccaggaggcagaggttgcagtgagccgagtttgtgccactgctctccatcctgggaggcacagtgagactttatctcacacacacacacacacacacacacacacacacacacagagagagagagagagagagagagagagagagagagagagagagagaatatattccctggaattgagatgactatgcccaaaggcacagatatttgtgaggcaccgtttttcctgcacactgtaaaatgggccctggggctgtgttttgctaaccccggagtaactcaggaccagctctgcagaatctggattaatcggtactttcaatctgtctttccttcctccattttaatatgagacattctctgctttgagctgaatgcatttaacaacctatcagataatccaggtgatgtgatcttgacactggaagccatcattcattctttcagcgggtgtataggaaggcccacctttgccgatatgtgctgggtgtcatccagcggtgggtaaccgaataagcccacccagtcctcgggcgggcgaggggagcaacagggcagagttagacgtggtgatcgcttctgaaaacccaaggcccttctgccacggtgtcttggcctttagggaagacagggcttcctaacagtagggaaggaattaggtaacagagtgagaccctgtctcaagaaaaaaaaaaaaaaaaaagaaggattagcacggatcactgctgtggccctgaaaagccaccaataagtgatagccattcttttcttgtcctattaaaaactttaacatcatttttttattgtagtaaaatatatgtaacataacattttccattttaagcattttgaaatgtacatgtggcactaatcacattcgtaatgttgtgaaaccaacaccactgtctgttgccaaaacttttcatcatcccaaactgaaactccatacccgttaaacacgaactccccatcgcccctccctccagcccctggcaacctcgaatctgtgttctgtctgtatgaatttgcctgttctagagagggttcgtataagtggaatcatgcaatgtttgtcctttggtgtctggcgtctttcacttagcatcatgtttttgaggctcatccgtgtttcagcatcggaacttcattcctttttacaagtgaatactatccccggtatagataggacacattttgttcatccattcctccgttgctggacgcttgggtctttccaccttttgcttattgtgatagtctacagtaaacattggcatacaagaattcatttgagtccctgcttttcagttctttggggtatatacctaggagtggaattgttgagtcatataatagttctatatttaactctttgaagaatccctgttttcctttcttaacaagcatggctgggtgcggtgagtcacgcctgtaatcccagcactttgtggggctgaggtggaccgattgccttagctcaggagttaagaccagcctgggcaacatgggtgaaacctcacctctacaaaataatacaaaaaattacccaggcatggtggcccatcctgtagtcccagctacttgggaggctgaggtgggaggatcacctgtgcccaggagatggaggctgcagtgagccatgatcacgccactgcactccagcctgggcaacagagtgagaccctgtgtcgaaaaagaaaaagaaagaaaacattttttattccttcctcttcagggtataatccaatgatcccggcagaaaatatagaaaatgtggtgaagcatgttgtcttggttcaccaatccgtggaccactacagccaacagtttctacagaaattgaggcgcagcaactatgtcactcccaagaactaccttgattttattaacacctattcaaaattgctggatgagaaaactcagtgtaatataggtaagccttggggatggggtggttgacaaaagtcattattatttatgggtaaggattcgagcgctgatcttttctttagtaagatggggcatcttcagtattgaggccaaacgaagcacatcttggattttgtgtcttggagcgattctttcatgtgggcaggaccctggcatgtccttatttttgttctcagtgttgagtcttagactttgaagctttacattttgatcacattagcaatttttaaattttattttttatcttagggatagggtctctgtttcccaggctggagtgcagtggtgcaaccatggctcactgcagcctcgacctcctgggttcacgtgctcctcccgcctcagcctcctgagtagctgggaccacaggtgcagccaccatgcctggcgcacattagagacaactatctgctgcagcagcatgcactgccggacagggctttttaaaaagtgctctggctgttggccaagggaagcactgtcttcagaaatacattcattttggctgatgctgtcccaagtatggcagtggaggtactgaaagacatgtgccatcttgtaaaaatgttttgttttgtttttgataagctgaagttaggcaaatctcagtgattgtgttgcgaacagtggccacctcgacgatgaacataggtgccctctttcctcagctcagtgcaagcgtctggatgggggactggacaagctgaaggaggccaccatccagctggacgagctgaaccagaagctggccgagcagaagatcgtgctggcggagaagtccgccgcctgcgaggccttgctggaggagatcgccgtcaacaccgctgtaggtgagtgagggcggggccagggcagcccatccccaacacccaatacccaccgtaggtgagtgagggcggggccagggcagcccatcccgagcaggacagggctctgccaggccgtccctgtgaaactgcttgtaggcactgagcgtgccatctttgaccctgcaattcctgttttctttctgaattcgtgtccagccagtcttgtcccctttcataagcactgagaagctaccatatgtaggcccctgcgctggtagcctgaggatgttcaggggagtggaaaagtcactcgaccctctatgggctggtgaactaagtccgtggggttgaaatgacctaagccttggcaccatcgacgcgggactttcttggttcttgaagctgtttcaaggttctttcttgggccccttccctcggtcttcttggccgagcctctgtgtcacctgcactgtcctgctcttgacgactctaccctctcgcgatgcctggcacaggacggctcctgcagcccacagctctgtgcctggcctctaagcctcctctctaggtctttgggccagtggcttctgatgtgtaccctccccagcttgttcccagattcctgcagatgccgctcaacctgcctgcctcttccttctcctgctggtccgtgttcgtgttgctgctaagtgtcatctcggttcagttcctttgtcattgcacccggccctgtgcacaggatccatttgtcatcactctggcaacagcaccttaacttggtgttggcaaactgcctctccccgactcccagtgcctgccatcaggatgggcttattctaaccctgacagaccaattagatgttctctgggactgcacattttgaatcagccaatataaagactgaagattatttgtgttcattcattgcacagcagcgccgtgaagagactgcattcagtgcccgagcccagatccctgaggcgcctctagtttatgtgtttcagcatcttccatgtctgtgagctaccatatcttcttaaaacaatttcacgtttttcttaactcgaccatcattagcttctgttgcttgcaaccaaagcaacttaatcgatagatatcctttcccaggaatttgtggcatatccctgctgcctgttttgatgctgagtcctcactgtggccgtgaagggtcccatcaatccctctatgtcatcttgcctacctaatttctcatgacaccctgtcgcctgctcacagcatcacttcttcatgcctgtgtgagtcctgcagtaacttgctctttctctccctttggtctgctaagaatatccgtaccacttctttcttcctgtccatgtttctccttccagaactttgatcaaatgcctcattcccacatagctgcactttgctttgatctgtcttttaaaaactatatatttctggccccctaaatgtaaaaaactatatattcctggccccctagatgtaaaactagactggaagtgtcttgaaggatgctggtattccacgtattcatctgtccagtcagcagatactgacttcagcttcatggcagccaccgtggtagggagagtgggggctagaaaccgaatgagactcaacccctgcctcgaagaagctcacaaccaagagagcccctcccccggtgcccaggccacagtttgtactgaggaccgcctatttgccacacctgtgtttagtgcctctcctacctgtgcttgtttttctttccccattgccatcatccttgtccagggtcaccttgctcccacttggaattttggaggaagcttcatctaggaactctgtttccagggttgcaaatggtagaaactgagctcaaagtggcttaatccaaagtggaaacgcattgattccagaggcatgctggcttcaggcacagctggatctaggattcaaatgtatcagtgggaatctttccttccctttcttggctctgctgtcttccgtttgggcttcatctcaggcagccggctctgtccatgctgagactttgggagcctccagcatgaggttggcatcctattagctcagcatccccaggggagagagggctcttctttcccatacattccctcaaagctcccagagttggctgtgattggacagatttgggtcacatgcccatgccgaaaccaatcctggtggccataggaatgggatacattgacacgtcccacagagggtagggtggagtgcaaacaatcctctctcctgagggtggctcttcagcacctgccccagcctccagcccatgcttctgcctggctgaaagagcccacaattttgctcctcagcatgactcaagcacctggcttcgccagccccctttgcaggctgctccccacactgaggttcctgaggcctgtaccagccctcttccttcccagccagctctggtggtgtcctgttacctctgcactccgttcctgctggcaccaccccccacccccgcgcctcagcacgctcacagcttagacagcttcctttctgcttttctgttccgaaggttccacactcgtgatcttgctacccttttctgatgcattcatccccctgctgccccagggacaagtagtgcctgggctggggaccctttacagtgtcaaggcccgtgcacggctttgcacgctgcaagtgccagtgctggcttgttagctgtggagatgggttccgagagaccttatcatgggggaggcagagcctctgcagccagcatctgtttgtagaaggcctgctgcattcatctcccggggctgctctaacaaagcaccatgatctgggggctgaaaacaacagacatttatttttttaaattaattaattaatttatttttttgagacagagtctcgctctgtcacctaggctggagtgcagtggcgcgatctcggctcactgcaacctctgcctcctgggtttaagcgattctcctgcctcagcctcctgagtagctgggattacaggtgcccgtcaccacgcctagctaatttttgtatttttagtagagacggggtttcgccatgttggccaggctgatcccgaactcccaaccttaggtgatctacctgcctcggcctcccaaagtgctgggattacaggtgtgagccaccatgcctggccaacaacagaaatttattctctcacagttctggaggccaaagtctgacatcaaggtgccaggaccatgctccctctgaaagctctaggggaagcctcttccagcttcttggggttgttggcagcccttggtattccttagcttagcttataaatgcaccactccagcgtctgtctccattgccacacgcccctcttccctgtgtgtctgcacatggccttctgatagggaccccaggcattggatttagggcccaccctcaccccgtatgacctaatcttaactaattccatctacaaagacccacttccaaataaggtcacatcctgaggtcccagtgggcacgaatcttggtggggtgacactgttcaaaccactgtgagccaagccctgctctaggttttggggttccggccctcggggaggtgctgacatcctagtgagtgagggcacccaggcagtgaatcagccagtggtgaaatgaaacttccgattgcgattggtgtcatgaagcaagtcagcaaggaagggagagagaggacgacagaggggcaggctccttagagggtggctctggctgggcccgagtgagcgtaggaagaggcgatgagaggcagaaggaggagatcgcagggagccggtaagcaggagggggaccccagcatcctcactgaacaccggcgaggcagggctgggggctatcaggagccatgggatttgtcctggatggagtgggtgggacacaggtgggccagttgaggaaggtcagagtcagggtggctgcctagtgctggaggccccacgcatggtgaggttttctgtcccaccaggatcactgaggctgccacattggccagagccccttagatccccgctagggctcaagccaacctttgaggactgcactctgctcagagccggggccgcgagtgcatctcctctgagcccaagctttactcaccccctgtcctaccctgcagccgaggagaagaagaaactggcagaggaaaaggccatggagatagaggagcagaacaaagtcattgccatggagaaggccgaggccgagacgaccctggcagaggtcatgcccatcctggaggccgccaagctggaactgcagaagctggacaagtcggacgtgactgagattaggtaatgcacctgagccaccattctgggcttccattccacctctgcaagccagtagtctccatgatcgtggcaaccaggagcttacaaaggagccgatgccacatgctgccactgtgcctggctctctccatggtggagactgttgttgccctcattttcggatggggaaaatgaggcccagggagatgaggtgggcgccccaggcatccagatcccccagctagtaggaagcagggcctgctgaccttgaacccaggccaagggaaggatggagtggggtaaaacagtgctcttcacggaacatgcgggggcaagtgtccgccctaagcaggggcaggatgctcaccatggggctgagccctgctgaaaacagctctgcagagatgtgtgcacaccacggccggactggcgatgcctgaatccatttccagccaaggaagctttcaaggagggtgagagtaggtcactattgaggcccccatacatcttgcaaatcaatctgtaagatgaccctgtcccccacaccagagggctcatctgctgtcagcgagggtaacgtggtgtggcgtgggctaacaagctttctcctcgcatggcttggcctccccagggcactgttcctgggctctgatggtcagttgagtcttgtgagtaaagccctgggagggaacactgtcctggtgccagcctccgcccactgcctctgcccctgtgctgcctggccccgcacagacccctcggcgtgggagcctcagctctctccttccccactcttcatccagaaggagatcagtcttcctggccccacacacgggtctcgcagccgagaggctccgttcctgggtcagtaatgggcttccattctgggctcccgctggagcggtgcatgttccctgtgcttcctatttctctgcctctgtgctgcctgtgaaggctgagcagcgctccttgtccaagtccgtgcccttgttttcttattggtgaaacatttgtgaatttgagcatggaattcagctcactccaggacagaatgacctcccggttcattcttgggaggtcacttggaggtgctgctgtggtcagcaagaagtcattagttcagtgttgaggatggtgtcaaggagggtataaggatcgatgtattaaaacttcagcactaggcgttggaagtttaggctgaggtaccaggacacagtggaagtgcacacccagcggaggggtaggagacacggtcagcacacacatcctccagggaaatttctagctaccggtgataggatttgggccactgctcccaggtcagcagcataaaaacatcgtgaaagcagagactaggaaggatttttgaaggggatttatttgaagagaaggaacggtgagtcccttccatcaatccaaggtggaggagtgggggggagcttccatggggccaaatagagggcgtggcatgtgtcccctgcagtgagacaggcattgcagacaggtgccccgctcacccctgagaaagcctaagtacaaaaggaataatttttacacattcatacatggctctgcctctttgctgtgtgacgtttagcaagtcatctaacctctctttgctccagtttcttcatttgtaaaatgtggataagaattgtctcggctgcatcagggtcttcatgaggatcatatgagcctatatgtgaagaactgggctgggcacatggtcagagccatgtaagcattagctgtgattatggctccagcatccaaaaggtatgctgggaaaagcccacggccactgtgtcctctatcagctgtggtcaccttcccacactgcaacaggtagtatgggtatatcatttctcatatacacttcctgaggattttcatgcatgaccaaggcaaccaggtacacaagggtctcttctcttcctgacttcaggttctgagggtttggagagcaggggatgcctgcaaatccttttttccttcttttatatacaaattataacaccctatgcatatctttctgcatcttttctgcttagcagtatattttggagagcttttgcatgttgatgtatgatgaacttccccgatattttagaacattccttcacattccattgtgtggctgtgccgtaatttatttaacaaggccttactgatgagtttgttaaataaattgattgtgtctccagtcttttgcctttacaaacagcgtggcaaagaataaatctgaccatagttcattgtgcacgtgggcgagtccacctgcaggatacatttctggaagtggaattgctgggtcccagggtgtaggcatttatagtgttcatagctgttgcctaatccccgccgtggggatggaacctatttatcctcaccaacaatccaaacgagtagtacctgctttttcctagacttaccaacagggggcgcgatcacatgttgggatttttgcatattttgtagatgagtggtacttgtgtagttttaatttgcatttctcttagtgtgagtgaagctggccttttttttttttcctatgagaaaagtgtgtctaagagttatgtgtatttccttttctgtgaacttggtttgcgtatctattgggtcgtggttattgttgctttttatttcaaaaccatttccaggggctttttatataatggggagctcagctttttatccataaggtgagttgcaaatcttttcctggtttgtcatgggctatttgactttgtttatgaggtttatgtgtgtgtttgtttttgccatctatgtttatttttatgtggcaggttttagcaatattttattttgtggcttttttttttgagacagagtcttgctcagtcacccaggctggagtgcagtggcacgatctcggctcactgcaacctccgcctcccgggttcacgccattctcctgcctcagcctcctgagtagctccagcctcctgagtacctccagacgcccgccacgacgcctggctaatttttttttgtatttttagtggagatggggtttcaccatgttagccaggatggtctcgatctcctgaccttgtgatccacccgcctcggcctcccaaagtgctgggattacaggagtgagccactgcgcccggcctttgtggctttttttaaatttattttttgagacagagtctcattctgtcacctaggctggagtgcagtggcgcgatctcggctcactgcaacccctgccttccaggttcaaacgattctcctgcctcagcctcacaagtagctggggttatagacacccaccaccatgcccggctaatgtttgtatttttagtagagatgggctttcaccatgttggccaagctggtctcaaactcctgacctcaggtgatccacccacctcagcctcccaaagtgttgggattacaggcatgagccaccgcacccgacctattttgtggcttttggatattgtgtcctagttaaaaggcctgatcacactgcaagattgtaaaataatttccccatgatttcttttggtactcttatgttttaattttttatatttaaatcttttatctattgaggatttttttcctggggttctgtgtgagtttggatccaatttgagtttttccagatgagtaaaatctggcttttctcaggtcatttggatgttaagcgcaatgagccggcacttacatcttgacaattttataatcttttaagtccttaaaaagcgcttccttcttatcatactcaatcctctttgtagaaatcattaaatgttaaggcaggaagatgaagagtcatgaagattagaagtagatgtttctctaactataaaactataaaagcctccctttgttgctggctcttgagtttcacttttcttcctttcattcattcagtagtcagtgggtgtctgtcccccaccccacccctgccctgagcaggcactggggcccatcagcagtgaggcaggcagggtcttcactgcgtggcgctgacactctgttttcctataggaatcccatgtgcatggggaaattatgtaggattaggttaggaaggaaaggtccttgctgctctgacagtggatgttgggacctgacctagtcatggtcatggagggcggagggggcaccttctctgagattgcaaggagctcggctggagaaaaagcagagacagctggtgtgtcaggggtagagtactgggaggtggggagtggggtttataaggattattttcctctagggagggtagcatatcattctccctttctcattcctgagtttgttttgtgatagaagaaaggaatcaaattaaacagacatctccctttctcttgacttgcaccctccacatttcacacaccttggtcatccggcattgtggaaagtggtatgttctggataagtgagatcccagagcgtggcctgcaacccaacagcagaaaacgtcactttggtagactcagaggatttgggaactggaaggttccagttctgcgtctctacttcacagatggggaaactgacgccctggctggttcctaacttgcccaagggctcaggaccccgccgcaggcctgggctccttctgtcttgaatctgaaaacatctgccccattctttccccacctgcttgttcacagagcggtggccggggcctggtttccatccaccctgaagggaccttttaaagacacttgacagccccgccgctttcctaagcagccaacaccagcgtgatcgagccttttcccggggactcagggcctttctttcatcactgggctttgtgctgaagtgtgggcgccctccctcctggctgttgccctggcttgtccgtacactatggggccttctctcctctgctgtctgtgtgggagtgtgtgagggttccggggtcaggaggggtgggggatttgctcactgcagaaagcctccaggttgctgtctgctcaggctgtctcctccctgtctctctgtctcctccctgtctccctgtctcctccctgtctctctgtctcctccctgtctctctgtctcctccctgtctccctgtctcctccctgtctctctgtctcctccctgtctctctgtcccctccctgtctcctccctgtcttcctgtctcctccctgtctctctgtctcctccctgtctccctgtctctgttcttgtgcatgtgtctccccctctgtccctccatccccctctttcttctctggctcaccccagcctcctaccagagcacaaatgcctgggcccctgcctggccgcccccacactgcatccatgccctccgggacctctgtctcctgctcttctctcctgcttttccttcctctcctgctttgccttgtctgtgctgttctcttccacttctgtctttccatggcgtggtctgggagactcctgtggctttcactgaccttgcctggcagtgggatgccccggtgagatgggttcggttccttctctggcctttgtaccagcgctgctgttctgtctcctgttccgttggcagttctggttctccagaggaacaagggcagtggacatctgcgttctggaggagcagagtgatgatctagtcttatcaaagccacagaacacaattacggggcaacatagcctggaaagagcccaggatgcggggaccccaggcttcccaggcggtgtcagcacagccagtcatgcaagctcccaggaccctgtttgtccatctagtaaatggggagagataatggttggtggtgatggtgatggtgatgatgatgatgataatgacaataatgacggcagccaccatttagagtctgaggaatcagccgagggtgtaattaaaacataggtgctcaggctgccccctaaccactgatccagacgctccggggacggcctgggtttgtattttaatgctgcccccgcaccattccaggcgcctggtctggaacctgagagggggacccggccctgcccttagggacgctcccgcccaggagtgcggtttgtgttgggacctggcttctttcgtttgcttgcagcagtagctccagggactgtcttttggttgagctcgtttttctggagctctctttcaggccagatcctggccacatcccggggttgtgacccacgtgccttggtttcttgccaggtcgtttgctaagcccccgaagcaggtgcagacggtctgcgaatgcatcctcatcatgaaagggtacaaagagctgaactggaaaacagccaagggcgtgatgtccgacccgaatttcctgcggtctctgatggagattgattttgattcgattacccagagccaagtgaaaaacatcaaaggtgagtgtagccacgtgtgggaatcgccagggtggatctcggtctggcatctcaggctctgggacagggatggagggcaaggaggcttgtcgtgggcaggccctccccttctggtcagatggtatcggatggaacaggcaactgatggtcaccagaggaaaacagcagccccatgacgtgacccagggagagtggctggggatgcgcggcggcagccgtgcccactgagggttcgattcggcactagtcctagctctccgtgtcaggaaacaggatcttctcattggaacctagcccagccttgtcttctgtgcatctcacccagtgctgttcagtgcacatgcagaagcccagagctagtctgaccttgacttcccccctttctcctcttgtcagtgtcaagtcttctggaggtccctggggagtgggcatgggggtgggcagcatcactgatggccagcctctcctccatctttggttataggactgagttccccttgagctcagttcctgaccctgcccagtgctcagccaggcggtgatagtgtaatggtgttagtctttgcgaaaagcaatacaagttaacgctgtgtttgatggtttatttagactcttatcaaatgctttttcttagccccttaaaaacaaaagcaatctcaacacaaatgaccccaaccactacaaaaacccaaggcactccctctgtctgaatcttcattggatggacttccgtttatgtgaaattactcctggggtgagggtgcgggtgaaggtaacaggtgacctgtagtggcctgtgaattccagttagccacctgggtgcccagttgggagtctccgttacgccctgggtctcctgtgtgacacctgcgtcctgggtggcagtaaaccatgtcccttgcccacatctgaaacatccgtttatgcagaacccatcttggtttgacaccacgctgttggccgtaggagagctttgtgcattctgctcacagggccactgaagaataagaaactagttatgcttattttgtctattttatgctcccaagatgaagcttgccactcataaaaattattgcatgtttcacgttaggcctcttgaagactcttaataccacaactgaagaaatggaagctgtcagcaaagccgggctggggatgctgaaatttgttgaagctgtaatgggctactgtgatgttttcagagaaatcaagcccaaaagagagaaggtattgcccgaatgtaagactgccacaccactgccaagggacccattcagagtcagaattcacatgtacatacctttgctgaaaaacttctcccgaggttctgacttcaagctgcataaactttccctccaccacccaataaatggcaatcctgaaacaccactatcacttaggcatagtgtgggtggtggacaagaccgaggtctgaaagagtttcaaacttcctgtgaaagtgtagtataaagatgttcagaccaggcgtggtagctcatgcctgtaatccagcactttggaaggcccagatgggaggatcacttgagcccaggagtttgaaaccagcttgggcaacatagtgagaccctgtctctacaaaaaaaaagttttttaattagccgagcatggtggcacacacctgtactgccagctacttgggaggctgcagtgagctgtgattgtaccactgcactccagcctaggtgacagagtgagaccctgtctcaaaaaaaaaaaaatgacgtaaagatgtttaaagttgtttctctagggtcaaagcagagtttctcagctgcagctgaatgtggcctggtggtggtggggggtctgtcctgggggatctgtcctggggggtctgtcctggggggggtctgtcctggggggtctgtcctggggggggtctgtcctggggggtctgtcctgggtgggtctgtcctgggggagtctgtcctgggggggtctgtcctggggggtctgtcccggggggggtctgtcctgggggggtctgtcccggggggggtctttcccgggggggatctgtcctgggggagtctgtcctaggggggtctgtcctggggggtctgtcctggggggactgtcctgggaggggtctgtcctgggggggtctgtcctggggggggtctgtcctgggggggggtctgtcctggggggtctgtcctggggggggtctgtcctggggggtctgtcctggggggggtctgtcctgggggggggtctgtcctggggggtctgtcctggggggggtctgtcctggggggtctgtcctgggggggggtctgtcctggggggtctgtgctggggggtctgtcctgggggggggtctgtcctggggggtctgtcctgggggggggtctgtcctggggggtctgtcctgggggcatctgtcctgggcggtgtctgtccttggggggggtctgtcccggggggactgtcccggggggtctgtcccggggggtctgtcctggggggggtctgtcctggggggtctgtcctgggggatctgtcccggggggtctgtcctgggggggggtctgtcctgggggggtctgtcctggggggtctgtcctgggggggtctgtcctgggggggtctgtcctgggggggggtctgtcctggggggtctgtcctgggggggggtctgtcctgggggggtctgtcccgggggggtctgtcctggggggggtctgtcctggggggggtctgtcctggggggtctgtcctggggggggtctgtcctgggtgggtctgtcctgggtgggtctgtcctgggggagtctgtcctggggcggtctgtcctggggggggtctgtcccgggggggtctgtcctggggggggtctgtcctggggggtctgtcctgggtgggtctgtcctgggggagtctgtcctgggggggtctgtcctggggggtctgtcccgggggggtctgtcctggggggggtctgtcccggggggggtctttcccgcagggggtctgtcctggggggtctgtcctggggggtctgtcctgggggggggtctgtcctgggggggtctgtcctgggcactataggatgtttagcagcatcttcagcctcaccccactggatgccagcagcaccctccctccaagctgtgacatccagaaatgtctccagacagtaccaaacgtcccctgggggacaaaacctaccgcagttgagagcagcggggccaaagtcacatgaagatcacaaaatacaaagagaataaggttaatttgatcattttgagtcatattgtgaccttgcgctatagctcggaattgtattattcagaaagcttggaaccaatagaaatactgttactgtctatggtatattcttctgagtttttgacttagaaccacagtgtcatcttacggagacctcagtacatgaaagtaaaaccatttgataacttgggtgctgtgtcttctaatgggacatggagtttttgcagcaaacagtcgaagaagaaactaagaagccacgtgtctcaacatagcatatagaggctctgaaaagcacagacaccattagagcagtttagacatgtggcctggtttgaggccatgggatcgcggccccaccacggtccttttccccatctttttgcaaattgtcttcacttaggtggccaggctggagcggaatttttacctcactaaacgggaactggaaaggatccagaatgagttggcagcaattcagaaagagctggaaacattgggtgccaaatatgaggccgccatactggaaaagcagaagctgcaggaagaagccgagatcatggagaggcggctgattgccgcagacaaactcatctcgggtctggggtcagaaaacatcaggttagcgctgctcacgagcccacctgttgcggtttgtaaacggacgtcacccacagagtttctcgccatgttgattctttatctcacgttgtgtttttatgtgaaaaccatgtgaccaggtcttatgttcctattatcatgtttatggcagctaatggctattttataggctcttgtttgtattaggcactgagtgttatttattaattactaagggtcaaggaggcagtgcagctgtggagacgggggaatccataccatttagcagggtgctctaggtttgggaagtgttcacttcttggtgacctctaacccctgggtcttttctagaagagtctgtgggagaagcccatctctgtcaccgcacagatgccttctaagggtcccagtggcttgttcaatcctgggcttcagtcttaagtgatggggctgtttgatatttatgggcaagaccgcttggccacagcttattcaccaaatagggcaacaattttgaatctagcatctgtaagtgtggtgtagaaaacactgaaaaatgttgtttgcgtgtgggaaacaattttcagtatttcttaaacctaagtcttggggcatttactgaaagaggacaaatgaaacagacgctttcttttatcttgggtggaattctgtcattgagtgaggccagaacttgttagctctgccgggctgatttatatgtctttgattaaggcttcagaaacaacgtgattactacttaatatgatccacgcaatgtgattactgcttaataaagaccacaggcctttactgagccccctgcttgatgctggctccaaataccaggttcactagggtgggaagttgcaagataagctgttggtctctgttcctcacaaggaaagaatatctcaaaacatgtttccatctggctagccctgttagcaaggtatcaagctggttcttctggaatgttccttttggttgtggccagaaggtaaactcacggcagcctccctctcctcccgtgccaggtggctgaacgacctggatgagctgatgcaccggcgcgtgaagctgctgggggactgcctgctctgcgcggctttcctcagctacgagggagccttcacctgggagttccgtgacgagatggtcaatcggatttggcaaaatgacatcctggagcgggagatccccctgagccagcctttccggctggaaagcctgctcacggatgatgttgagatcagcaggtgtgtggcaccctgagccagcaggagggaggggacaccttagcacagggggtctacgtgggtgtcaccctggggggaggcaatggcctggggggcatcaccaggaccacagttggctcgactgcatggaagtggccgggcaagctgcaaacccagcacggagcccttctccctggcctctgaggaggcttgtgtggcctggggatgggtagattgttctggaaggccagtcctaccacccttagcccttggctcacaaattggtgagaaaaattcatttcccaatggctgtttcttccagatggggatcccagggccttccccccgatgagctctccgttcagaatggcatcctcaccacccgggccagccgcttccctctgtgtatcgacccccagcagcaggccctcaactggatcaagagaaaagaggagaagaacaatctgcgggtatggtggctcctcccagggcgtcttctgccccctattcctgttctctggagaatgcccctcccgcctcctgtacgtggcagtccctagcctcagcgaggctgggctgaaatgcttccatcctgacccccatgcggagccctcccccggctccgcctccgcctccaccccgtgggtctgccagggcagctcaaaccgccatgaactctgcctctcccctcgcaggctgtgagcaaccttagcttcgtgttcctctgtccagtacggggttcgtggtctgggtgctcagtcactattttttggagctgaggtgggggatggggatgcaggggaggagaggggagagtaatggcttgattgagatgtaattcacataccacacctttcccccactgaaaacatacaattcagtttgagttttagtatatttacagagttgtataccaatcaccagagtcagtcttagaacatttttattatccctggaagaaatgctacatcctttagccatcacccctccagtccttccgtttctccctccccgagcccctggcagccactcatctgctttccgtctgtgaatgtgcctcctctggacatttcttaggaatggactcagacgctgtgtggccttttgtgtctggcgcctttcactcagcctgatgttttcaaggtccgtccttgctgtagtgcatcagggcgtcattccttccttgggctgaatgatattccggtgtatgaacagacacattgtgttcatccatccatttgctgagggacagttgggttgtcctactttttggctgtttgaagaatgccgctgtgaatgttggtgcacacgtttctatgtggccatgtgttttcagttctcttggggcgatacctaggaatggaattgccggggcggcccaatcactttttgctgagctaatgaacaaattaattattttcaatttagcttttcctcatttttttctggtccttgatctcaggtatttgcctgctgttagaggaagcccatttgtactccaaggtcaggggaacagtctgcctccaaaatgcacatggagctatcagggagcaaatactatgagggcaggaacttttctagactccctcttccctcagcctgccagggagcactgaaattgtcagcctacccctagtccaattccaacatctaccctctctcttaaagaggaggggttctagcttacgggagaggggctgaggaatccccttcctttcctctctaccctgtttgagcaagatcctgccctgagcctggacctcatggtgtatatgcgttataccccttgcttctctcttcttttcacctctggccccctccaagttcctggcccatccacttcccacttccaagccattctccccttatatttggcagggccacagttaaacgtgggctttcagcatctgcctcccttctcttccaggtcgcttcctttaatgaccctgacttcctcaagcagctagagatgtccataaagtacgggacccctttcctgttccgcgatgttgatgaatacatcgatcctgtgattgacaacgtcttagaaaaaaatataaaagtctcccaaggacggcagtttattatcctgggagacaaggaagtggactatgattcaaatttcagactgtacctgaacaccaagctggccaatcccagatattccccatccgtgtttgggaaagctatggtgatcaattacactggtaagaatgtgtagaacctccactgctaattcagatggttatgagggagaccgcaacctcagatcaaggcattcatgggacatcatttcactcagtgaccccagatcattctctcataggcacatctggactagtcagctcttaccaattaggtaccacttagaaggtgtgaggccatgagtcacctgtcatgagtcacgctgagacggggccgtgggcttatgtgttcacacatggggtgggatgggacctctgactgtgggggcaggaagttactctatattcgtgtatttaaaatacatgttgtgatgttgaattttttttttcttcctctcagttgaattctgatagaaatgggatgttatctcttacattctctagggctgtcatgctcctgcttaaataggctaatttgatttggatgtactttcttttcttttttctttttctttttttgtacagatggggtttgtctgtgttgtctgggctcaaacttctgggctcaagtgatcctcctgcctctgcctcccaaagtgctgggattacaggcatgagccactgcgcccagtctgggtatactttaaactatggcaccccagtccgtggaagcctgggttttatttcagtgtgttttttcctttttatctgccactctgcaccacagcatcgctgttttgctcctgcctgccaccttgctgctctagagtgactttggtgggcagtgaatcctcgtgcctctggcctgctggctgagacccgcgctaagcttgtcccgtcacagcagggcagcgggagagactgttgttgggggccgcaggtggtgagggcctctcactgtcccccacagtcacgctgaagggcctggaggaccagctgctgagcgtgctggtggcttacgagaggcgggagctggaggagcagcgggagcacctcatccaggagaccagcgagaacaagaacctgctcaaggacctggaagattccctccttcgggagctggccacgtccacggggaacatgctggacaatgtggacctggtgcacaccctggaggagaccaaatccaaggcaacagaggtagcaaccacagtggaagaggccgtgagtcaggcggggcctgcatgcgccgttggagcgtccatttctctgtctgctcaatgagaaaatggggctctgtgatctcagggctaaaaacccacctctattgggatgtgctgtggggaggggagccctaaaggtgttcccagggacccttgggcatcaggtcagtctctttaaatcgagagtgatagaaaatccagccctgcctggcttaagtcaaaagggaagttatcagctgagaaagcagaaaagttcagagatggcctcaggtggggctggatccaggacttcaaaaataccaggaggacctggtttctgtccatttctgggctgggccttctactgggttggcgtcattctctgccagctccccacatggtcataagactggtctggcctcacgtcctctcgggtccaaacccaaaggggtaagtgagaatcttcctgttcctaccgtgaaggtcctgagagtcacttaggtcacgtttctaccccaaagcagccctgggagcttggggatgctaggctcaggttagctggccctgggtcacatctcctggagtcggggtggaaccccatatgggaagaaaagggagagggcagtaccggagacttacaagcagtgttactaggggaaggggccatgggtgcaggggcgtcagccacaaatattcaccccttcctacaagagggtgggtgccctcgctcccctgcagtccctggatactttcaaagccctgaagcattgtacatacctctctgctgtccccctgcccctcctgccctctgcccacatctcagtcttcctgtttccagggtcacctgtgcttttcttcaggtctcagagaaactcaagctggcggagaagacagccttggacatcgacaggctgcgggatggctaccggccagcagccaggaggggggccatcctgttcttcgtcctgtctgagatggccctggtgaactccatgtaccagtactccctgattgccttcttagaggtcttcaggctgtcactgaagaagtcgctgcctgattccatcctcatgaaacgcctgaggaacatcatggacacgctgaccttcagcatctataaccacggctgcacaggtgagctctccccacagaggaggacatgttagtgtagtttggtgtgccagacgtggctttaaggaaacgtgatctgtgaaaatggaaagttaccaaatagcattttttcttttttctttctttctttctttttcttttttttttgagatagggtcttgctccatcacccaggctggaatgcagtggtgcgatcacggctcactgcaacctccacctcccaggctcaggtgatcctcctacctcagcctccagagtagctgggactaaaggcacgccaccacacccagctaagtttttgtatattttgtagagatggggtttcactatgttgcccaggctggtctcgaactcctgagctcaaacgatccacccaccttggcctcctgaagtgctgggattacgaggtgtgagccatcatgcccagctccgaatggcattcttgagtctggcgattcatgttacaagaggaatgtttaaagcactgaattttaagatagcagctttattgagacacaatttacataccataaattcgtcctttaaaaatataccattcggtggtgattcatagcatatacatagagttgtgcagctatcactactctctggctccggaacgtttccaccagccccgaaatgaaatcccatacccattagcagtcaccccctggccccccactcctagtccctggcagtcaccgctctgccttccatctgtaaggatttacttgctctgaacacttcatgtcaatggcatcatacggtgtgtgacttcatgactggtatctttcactccactccgtgacctcacggttcatccgtgttgctgcgtgtgtcagcgcttcattcctgcctgtggctgagtcacattccatgtatggacagaccgcactgtgtttatccacccgtcacctgatgggcatttgggttgtttcgcttgttttgctattaaggcaatgctcctgtgaacatttgtgtgcaggtttttgtgtgaatgtgtgtttttaattctcttgggggtatatctagaaagggaactgctgggtcatagggtaattctatgtctaacttttgaggaactgccaaactgttttccaaagtgactacagtatatttaaacccctaaatcattgattttttcaaaagactttttattatggaaaacatatgcaaaagagaatagtgtcgtgatcgtctgcacagccctcacctggcaatgattagctctggatttgtttatatgtaacacggttccccatcaacccagattatgttgaaaatttgcttcatattcagatcacttatctgtaagtatgttagtttgtatctctaaaacagaggtcagcaaactttttctggaaagggtcagatagtaagtgttttaggctttgaaggctaagtgatttctgccacaactactcacttctgcagttgtgtgccacaggccccactgggcatggtggcaattgtagcacaaaagcagccattggatgatatggaagtgaatggccatggctgtgttccaataaaacttttttagcaaaaacaggcagcaggctggatttggccccttgcttgtggtttgcccatccctgctataaaatagaaggattctatctcaaaacatagacataaggccattatcatatccccaaattaataattcctgaatatcatcatattcaggttttcaaatgttcccaattgtcttatatgtcatgtttcacattattttaaatcaggacctcattaaggtctatacattataattggttgtgtcacttaatttctctcttttcccccttgcatttatttttatttttgtttgtttatttttggagacagggtctggctctgatgcccaggctagggtgcaatggcacaatcacagcttactgcaacctccacctcccaggctcaagtgatcctctcacttcagcctcctcagtagctgggactacaggtgcatgccaccatgcctggctaatttttaaaaaaaatttgtagagatggtggtctcgccatgttgcccaggctgatcttgaactcctgggcttaagggatcctcctgcctcggcctcccaaagtgctgggattagaagcataagccaccgtgtctgccccaccccttgcatttatctgtggaagaaacctacctgattgctgggttgtttcccgtcgtctgaattttgtgctcgcctctctgtagtgtgtcattggaggaactctcaaatgccaatacatgtagttcttttctcatgagactttaggattccccagtgaagagtcttcagccttttcctagagtatgtaatcctggctgccagccttcgtggaaccaagtgagaaaagaaggctgtcgatttcagcattcgtcgtgaaaacgttcactgaaagccatattttcagtacggtttaccctcaactatgcctggtgttcccccgtccagagaccctgctttatcttttccaaagttcacttgggtggggcaggcagttgcctggcagcatggagtgagaggggatctgggatctgacggcttgtcaaacaagctgtccacccatcttcctgtttttagcccatattcacccacacttccaaaggatctggtactgccagttcctgagcttttgatgtgttctgtggtttgcatctcagctttatctcctcctcatgtgagagtcaactttctcagctctgctaaatcagttatcacttgtccatctgtctgtagcttgcagttttttttttttttttttttttttttttttttttttttttgagacagaatgtcactctgttgcccaggctggagtgcagtggtgcgatcttagctcactgcaaccttcgcctcctgggttcaagtgattctcctgcctcagcctcccaagtagctgggattacaggcacctaccaccacactcagctaatttttagtatttttagtagagacagggttttgccatgttggccaggctggtctcgaactcttgatctcaagtgatctgcccaccccggcctcccaaagtgctaggattacagatgtgagccaccacacctggcctagcttgcaaaattttattgctattgtcttttctccaattttctgggagcttatacctttttaaaaaactaaccattaggccaggcgcggtggctcactcctgtaatcccagcactttgggccgccagggcgggcggatcatgaggtcaagagatggagaccatcctggccaacctggtgaaaccccgtctctactaaaaatacaaaaattagctgggcgtgttggcaggcacctgtagtcccagctactgggggggaggctgaggcaggagaatggcttgaacccgggaggcggaggttgcagtgagccgagatcgcgccactgcacaaaaacaacaaacaaacaaaaaaactcaccatttcagttggtttttgaaaaggagttgggataaactcagaatggccatttttaaccaggggcctgtagagtgacctttaggaagcagagggtgggtaggacacactcgtgtccctttccagtcctcttctgctgagacactgtactgacagtgatattttccatgcaccagcgtttggtgtattagtttgccatgcctgccataacaaaataccaccgactgggtggcttaagcaacagaaatttattttctcatagttttggaggtcagaagtccaaaatcaaggttttggtaggtttcgtttctccttaggatgctccccttggcttgtaggaggctgtcttcctgctctgtccacacaaggtctttcttctctgcgtgtgaatccctggtgtctctgtgtgtccaaatttcctcctcttataaggacaccagtgaggttggactgggcccaccttaatggcctcatttgaacttaatcacctatttaaagaccctgtctccaaatactgtcatattctcaggtactggaagttggggcttcaacataggaagtttggagaaatataatttagcccttaacagttgggcagaaaagagattgtttctatagggctcacttaagtagccaaccctcctaacacatataaagtagaattcaaattacaaattttgacttaaacaatttttttttccaggaacacatgtcttctgttaaaaagcaaaaaagaagaacgctggtattttgcatccattaataaagagtctgttgatggagtgtgtgtcctctgcaatagaggttggcaaccccctagccagcatccaaatctggcccactgcctgcttttgtaaataaagttttattggaacagggccatatccatttgtatacatattgtctatggttgcttttgcactacaatggcggagttgagtggttatgacagagaccatctagcttccaaagccaaaaatatttactatctggccctttgtagaaagtttgccaacacctcttctagactctaatggacacaaatgccatggagtcaggcaaacaacctgccttcagtggagagggctgcccctgctgtactgcccctcactggcttttcctcttcccaggttggtgtgattttacctcctgtagacatggccatttccgttacatacaggagcatgtcactacagactggggcatgacctaggaactgagctcatctctcttgaacttagatattcatggacattaggtgcaaagaggggtaaatgcagccatacagttcgagtgtttcatttatcttacgtttaagcacagtgtgcataagaaactcagttttttaaaaatgaattttaagaaatcaatactcatctgatgtttccctccagggctgtttgagaggcacaagctactcttttcttttaatatgaccatcaagatagaacaagcagaagggagagtccctcaagaagaactagatttctttttaaaaggtaatgaatttgcctagcttcattcctcccatctccttgcccacatgatacatgtatataagtttgtctgttgaaacaaacaataacaaaaattctccttaaaacttggcttccaacagcactgcatttttcactattccagttgatcattccagcctcagaaatggctctggttgaaatcggagcagccagcctctgtctcggggccatcctgaggctggaagctggatgctgcactgagcgcctggttggtgtcactggcggtgacgagggcaagcctgggccacttcctgtttccagtctccttcttgaaaagtggacttttcccaaaagtgggagaagtcgaagcagagttgcttgctttgtgttagtggtacaatggctgcttgcttctcttctgttgtgattaggaaacatttccctggagaaaagcaaaagaaaaaagccctgcgcttggttgtctgaccaaggatgggaagatatcattcttttatcagaaatgttttcagacaactttgggcaacttcctgatgatgttgagaataatcagactgtctggcaggaggtgagcccacgttccctttctcctcctctccttccccacatgtcaacaatctccaaacctcaactgtggcccaaccccttaagagaagacactcctttgagtaacccattcagtgtgtaactgatgccctgtaactccctgattggaattctcctttggctaattcagctagttgtatgggagatccaaccatctacctgtccgtccgtccatccatccatccacctacccacccacccatccatccatttacccaccgacccattcatctacccatctgcccacccacccatctactcatccatccatccatccatccatgcacccactcatccatccacctacacacccgtccatccaagaaatagttgttgggcatctgccatgtaccatgtcccttgatgggcactggggactcagtgaataagactcagttgctcctttctcaatgtcatagcctttgggggtagagaatgacagatctgaccaggtggccttcagttagtacacctatggattctcgtccctttccagtggcttttgccaccttcacacataaatggggacctatgtcatttctgagttgacgcacaatgaatattctttgcttttcccagtggtatgacctggattcactggagcagtttcccgtccccttgggttacgataacaacatcacccctttccagaagttgcttattttgcgctgtttccgtgtggatcgggtctatcgggccgtgactgactatgtgactgtaacaatgggagagaagtaagtgtgtcgttttgttgatttgccactttccgtggggtggaatctctagcgtcctcccaccttggactcaaagaaagcagaggctgaccagctcccgagacagctgtcgccaccctgctgtacaatattcgatagccgatattctagaattcttcaatattctagaacagtgctagtcataagaaattcagtgtgagccacatatgcagtttcgaaagttctagtagctacattagaaaagaaatgggcgcaattaattgtaataacattttatttaaatgaatatattaaaattatcatttgaatgtataatcaatatgaacatgattgagacattttacatgcttttttctggtattaagtctacaaaatcctgtgtgaattcacacttacagcacatctcaattggggctagccacattttaagtgctgtgcctcacggccatcgcactggacaatgtagctctagcatggggtacgaagccaggcggagcgtgtggggctgcagctcagatgtgcccttgtagccagcaggccatggcagtgagtgatgaggctgggtggggtcctggtccctgggcagctgcccttagctcctgctgactgataccaggtgccattgggaacccacagtggctggatcctctgactctgaaagaagctaggacttcagattttttcctgaaatatcccaatatctttgtgtttgcaatgaattttaaaacgcacatctgggtcaggtgcggtggctcacacctgtaatcccagcacttcaggaagctgatgtgggaggatcgcttgaggccaggagttcgagacccagcctgggcaacatagtgagatactgcctctaaaaaataaaaaataaaaaagaattagccaggcgtggtggtgcacacctgtagtcaagctactaaggaagctgaggtgggaggattgcttgagcccaagagtttgaggctgcagtgagctgtgatagtaccactgtactccagcctgggcaacagagtgagattatatatttcaatttaaaaaaaaaaaaaaaaaagaaaaagaaaaaacccacacacaaaacacaaaactcaaaactcaagatgtggaccattcaggacacgcctgtggaacctcagggttttgtgccatgggcaggcccacctagagggcaagctgaggtgcccagctcagcacaaaccaactgaatcgagtgtgagggggtacagagaagtccctgccactcaggagttccccatcagggtgggagacgtgcatagaaactagaatctaaaacagggaagactgcaacgagctatcccagaggagtggtcagaaggttctggacaccggaggaggcagcgctgatcagacagaccagcccctggtctggagctgtcctcgcgggagagttttctgactgtgtttctttcaccaggtatgtgcagcccccaatgatcagctttgaagctatttttgagcagagcactccacattcgcccattgtgtttatcctgagtcctggctccgaccctgccactgatcttatgaaattagcagagcgaagtggttttggaggaaatcgcctcaaattccttgcaatgggtcaaggtcaagaaaaggtaatttgtggctgaaaggaacaagctctacgtttaggggaggtccctggtgtctgctaagaaggagctaacctgggtttaagctgagtgccacgccacaaatcagttggatgcatttccgagctaagaagcagtaatgaaacactgggaagatgacaataatagttatgatttcacaacctcatgttgtgatcatggtgctgtgctgttttctttttttttcctttttcttttctttttgagacagggtctcactctgtcacccaggctggagtgcagtggtgcgaacatagctcactgcagcctcgacctcctgattgtgaagtgatcgtcctgcctcagcctccccagtagcagctgagactacaggcatgcgtcaccatgcctggctaatttttttggtattttctgtagagaaaaatacaaacacgtcaccatgttgccctggctggtcttgaactcctgggctcaagcgatccttccacttcggcctcccaaagtgttgggatcacaggcatgagacacgatgctcaggctgtgctgttttcaaagccctttcacacacagtccttaccttccttagtccctgaacagcctcattgtggatcaggattattatggccccaattgcatggccaagggagtgggtggagagaggctgagcccaggaccattcaggacagaactgtggtgcaaatcctcctacctttctgagccagtgagctttctttgctgaggtcttgcctctctgcatcacagtgctccctgctagaacttgctacacaagttcagtacaatgtgggacaaagcttgcaggaaaagtctgtgcgtcagtaagtgtgatggttgcaggcatgcgtgttggggtcagagggagctgactgccagtcctggctttgctatgaactgtgaggctttgggtaagcccctctactgctgaaagcccctgggtgagatgaggatggcaatacccatgctggatggcccaggaggcaagccctgggcaccagcaaggcgggccagctctctcaaccacaacactgaaataagctattgtaacgccagcactcatgtgttttaagccatttcagaaagcaaggcttgatttgggtgtttagcttgtttgtgctttgaattacatttgggaggggacatggtgattgttttccaggcctagggccctgaagatcttacagtggccaggacagtcccgacttcctggtgggctttagctggtctcttgcagccctgctcaggagtcctcaggggacaggagcgactgtgtgggaggagctgggacttccagggccagggaggcagatgagtgcaaaatgctcacccatcttccaggctgggtgtgaccagctcagtgcacccacggggcccatggggtttctcaaagatggtttatttgaaggctccacctgtagctcctggatcctcggcttgcttttggcttctgctggagctgccatcgcccttctgtgggtgtggagtgggtctctggagagcacggggttgggtttggatgccaacccctctcctcttccctctcccccggcgcaggtggccctgcagctgctggagacggcggtggctcgggggcagtggctgatgctgcagaactgccacctcctggtcaagtggctgaaagatctggagaagtccctggagaggatcaccaagccccacccagacttccgcctgtggctcaccacggaccccaccaagggcttccccattgggattctgcagaagtccctaaaggtctggcttcaggatggacatcaacatgccagcacgcagcttctcagaacacctgcatgctgctctggggccggggtgtgcctttgtctgtgtagaaataaaccttaggctgcaggtgaaaccttgcggttgaaacccttctcaatcccacctctctctttagagggagccgctgtcctgggttgggtgtttgtgactcccaggcctatctctaccaattctgcatgtgtccctaacaatatctacgctacttttcataaacttcacggcccccccccccacacacagcctgcagttcgctagtgctgactgcaggagtttcgcgtggtttacatgccccatttaatttattctccgggaaattcttttggaaaggttttgtcattctctgtctctctctctctctctggggaggtggagggaagactttactttcattttatatatagtaaaggatctcatggttcagaggaaggtcaaagactcttgacccttgaccctgagagccagaacatctagtcctttaacttctcagcctgggccctggacaagagactttagctattggaggtctcagacagatggctccgtagagaggaaggaaagcgcagtgcctgcattgtgcacactcttccaagcttgtgggcctgcggtctccatcactgtgtgttttcttctcttctgaaggttgtcaccgagccacccaatgggctgaaactcaacatgagggcaacttacttcaagatctctcacgaaatgctggaccagtgcccgcaccctgccttcaagccgctggtctacgtgctggcgttctttcatgctgtggtgcaggagagaaggaagtttgggaagattggctggaacgtgtactatgacttcaatgagtctgacttccaggtgacagtggctgcttctccttggaaatggcttccttaggcggcccacttcctcccgactttcctccgggttcaaccacagcagggttgcaccgttcccagcagccttttcagaaaagtatcagaatgtgaacagcttggtgggtttcagtataactgagcgtgttctcttctttcaaggtctgcatggaaattctgaacacgtacttaacgaaagccttccagcaacgggacccaaggatcccgtggggcagcctcaagtacctaattggagaggtaggggtgaccggggatccttccgcaggtgcctctggggctacagagctgtggcctcgtgcccctattttcctctgagccctcagaaccagcctcttctgcccctgtgttccccttgggtttctgtgacaattctctctgctctcacctggttgttctttgtcctaagtgagctctgttcacatggaggttccctgagctggatccatggctggggatccaggcaaggcatcctctagccccttgcctcagctgttgctgtatacagagctcacaggaagcatccccggtggtctgcacacggctcaggcagtgacatcaattccaaagacagaagcagctgctggcttcttcagctgtttgtttgatgtgtttgggggactttgcctgctgcacaggagctcccaacacttcctgagggcttcttactgctttgggccctatcccttgggaagccagcaaagccacagatcaattgtgtgaacagtggcccgaaaggttatgcaagtcaacaggttcaagccttgcagcagccaggctgctggagtctcttgaccctgggtgagcctctggccccgggcccccagggtgcacacagtaggttctgagctcctggctggctctcaggccctctaatttcaggtcatgtatggaggacgggccatcgacagctttgatcgccgcatcctgaccatctacatggatgagtacctgggggacttcatttttgatactttccagccattccacttcttccggaacaaggaagtggactacaaaatccctgttggtgatgaaaaggagaaatttgttggtgagatttctcagacatgaaaagatgttttcaaggctttttctaagggagaccatacatttcaaccggctcctctcctggtgggggctcctcggctggtcaggtgtggtctgttaagcctgttaggtggctcggcagacgcttcctggctgcagagctgactgatagagttcagatttcccatcctggaatgatggtaaataaatcaggttccacctggaagggcagaatggccacagtgaagctcactgagccattttcgtaaaagatgaacatacggctggactgggtgtggtagtgtagaatttttacattaaaaacatgtcattggctggtcatggtggctcgcacctgtaatcccttctttggaaggccaagaagggcagatcgcttgagcccagaagttcaagaccagcctgggcaaccaagcaagatcccatctctacaaaaaataaacaaaaaatcaaaacaaaaaaacaaaaaacaaaaatattagctgagtgtggtggtgaatacctgtagtaccagctacttgggaggctgagatgggagaagagcttgagcccaggaggtcgaggctgtagtgatcaatgaccatgtcagtgcacttcagcctgggtgactaagaccctgtctcaaaaaaaaaaaaagtcaccctctaaacagtggaaattagtcttgcatgtcttggagactttgaggctgtgggccctgagaaagcacaggtggctggacagtgccacctccgttgttctctgtgattgcagaagccatcgaggccctcccgcttgccaacacgccagaagtgtttggtctccaccccaacgctgagattggctattacacgcaggcggctcgagacatgtgggctcacctgctggagctgcagcctcagacaggtaaactctactcaggaggacttcattagtttgattggggttttacgattgcttcttgtagccctcccacgttgctgatgcctttcccagaactggaaggctcaggaggctccggttctgcacgtggatgccttgctttctctgaaaagtgtcctggttttaggggaatccagcagtggtatcagccgcgatgattatattggccaagtggccaaagaaatagaaaacaagatgcccaaagtctttgacttggaccaggtgaggaagcgcctcggaacaggactctcccccacttcggtggtgctcctgcaggaactggaacgcttcaacaagcttgtggtccggatgacgaagtctctggctgaacttcaaagggtgagcctgtctctcatgtgcagattactgcctagatacgtggcacctggggttctgatagagtcctgcccgattgctcttgattctaaataggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtgggtaagtggcacgtcaccgcctcctctctgccgattcaggtgtcagcctagactcctcaaaccacctcccaatcccctctttccattgcccagcagtaacctctgttaaagtttattgggtgctctggaaatggtctgagattcttacaagcctatctgtatcttttgtttttccttttcttttgaagactttgaagcatactcttacatacccgattattttatctaagtgtatatcttggcacttgttccatattagtacacagctagctcgttcttttttagagtatgccattgtacaaatgtttcatatcctttctcctccttctgtatcctaaaaatatggtaactgcctacatttcggtggttaccattttttttttttttttgctaatacaaataacattctggtgcacatgtatatgaatatgcataggggtatattccatgggtaaattctgacagtggaagagttggatcaaagagcttgtgcattttaaattttgatagctcttgttggatggttcttagaaaggctgaaaccacagtctatgagagtgcttctttcctcactccgctgcaatgctgcgttcttaacattttggatcactgtctccctgataggtgaaaataatatctcattgttttgcatgtctttaattatggtgagtctgagcgtattttgcatgctttacagacattttgtgtttgtttttctgtgaattgtccttttgtatctggatttcatttttagtgaggtctccatctttctcattgatgtttaagagctctttgcaaatcaaagaaattagcccttggtctgccagtgttgcaggtatttctccaagcttgtcataagtcttgactttgcttacggtattttttccacagaaaagctttacatttttccgtagtcaaacctacaaggcttttcttttttatcctgggctttgtatttcctactccacgatatgaaagcattcattggagatgtggcccagtacttttgtggttttatttatttttatatctaaatctttgatctacctggaatgtggcagtccagattgtttttctcagacaggcggccagttgtgccaacgccatcttttgccacttaggtgaaatatgtcttttatcataaactaaacttccaggccagctttgacctggcattggatggcagccccaggctcccagcacttgtcctctcttctctccaggtgaccgagagcgagcccagcgtgatgtggctctcggggctgcacatccctgagtcctacctcacggcgctggtgcaggccacctgccggaagaacggctggccactggaccgctccaccttgttcacacaagtgaccaagttccaggatgcagatgaagtgaatgagcgggcgggacaaggtaccgtcagctcgttagggatccacagcctctcacttaggatttctctccctgaaccacctccaactcaaagggacaggcatagcgtgggcctaaatgggccaggccatgtttgaaagccagcctgctgcaaatatttcctgtgtctctgcactgcccatgtcttaacacctctgagggtggatacggaagtttctcttccactttctccgttgagacctggggtctatggcaggggagacctgaaccatgttcactctgctagctcatggcaagtgggctcctaggtcagaattagctcttgcaaaaaccatcaggtggctttcttgtaacccctgacggggccaggggcatgggagccacagagcagcatggactaacttggttggaactctttgattatgccagaacttcaggtcccttagacattggttactgactgtgcaaatgagagctggaaactgctgtttccccgggtccatgttgtcttagagttcttttaactgcaaggaacaaaagctcttttgagatggcttaaggactggggacttacggtaaagatgcagggactctccaggtctcagtggcaggggaggtggcaggtgtccgggccaccactctctctggggccacaggagtgtgttcctctctttgcacatctgctgggtcctcctccccggagaccactttctctgtgaggcttcgacttcctgctccccagccacttcggctcacagggtagctggggttgccatggtgcccattctgactctgggaccatgcatctttctagcctgggggcccagggtggtctaagtccgtgggccttgatgccccaggaatgaggattcctgggggagaggccaccgccccacacccatttctctgggccatggggcagggccacagggtctcctgtctgggctgctcctccacagagggaaggtgggcaggacagaaatgctggagaagggcctgggctgtccccaatgcgctggggaggaggccagccagtggcctgtgtgtcgctgtgtgtgcgcctgatagagccactccgtggcaggctgtgcatgctccagttgtatccagtctctgccttgtgtccctaggatgctttgtctcaggactgtacctggaaggtgctgactgggatatagaaaaaggatgtcttatcaagagcaaacccaaggtgctggttgtggacctgccgatcctgaagatcatccccattgaagcccatcgcctcaagctgcaggtgaaggtcccagcccctcctctctgacaccagggcccttcctcttctgactgtagttatggctgaggtggtttccaacagtcctactttttaaaacaggggtgcctaagctttatgggctggggagagtcttggagccgtgataaaagctacggatagctgcttcctggaaaaggcgcggctgtatgtgtgtgtggatgccggtccttccagaggtgtcaggctcaagctgtgatcctgtggtctagactaaccaaggggagactccctcccttcttgcaaaatgctgcagacattgcctgagtcataaagtggttcccgctggtgtggacagcagatgtcttctgctctgcctgggccaggacccacttttaaccagggtgtcagtgtgaagccaggtccccgtgaagctggcggagggtggccctgagcagccccagccttgtgcgtgttctcaggtgcagtcttgcacaggggcccctgcctgtcaagacttacactgcacctctgcctttatccctctgcaccctctctccgtgggggcatctcacctgcctttcccttgcagaatactttccggacccccgtctacaccacctccatgagaaggaacgccatgggagtcggcttggtttttgaagctgatctctttaccacgaggcacatttctcactgggtgctgcaaggagtatgcctcaccctgaattctgattaacctttgggtgaagaaaactgcttaatgaattcggagcctggggttgtcagagtgatcgggtctgctgtcatttcttggggcctctcaagaggcaggagggggactgacactgatttttcatttgaaatcagccacttaaatctctttccatacaaattaacctgaatggttttgtttttaatactactttttaaaaggaatttatataatcaaaaagtaaatattggagagtattttaa

SEQ ID NO: 861 - DNA, 202346 bp, Homo sapiens
acttggttttataatgtatatattttaagtaggacaggtttttttttttttaaacttttggatgttttataaatttgtccaatttagtcatccaactgacaaagcaaagcaaccccgcgcttgatccagtgccgagtaggttggtctgtttttaacaacattgcaatgacaaagttagtagaatgtcccgtagtggaaagagttcctttacgttcacttgtcttgtagaggggacagacataggcatccgactttataatccgagatttttgagcttgaaaaaaaaaaagaaatatattcacttgataaagggaaaaacagccattggtacgaaaagaactatttatcttgtaataaaatggccagaactaaatctaagatcataattgtgatatatgaaggttttacagcatatatatttttttacagtacatatagtattacggttgtgaaacaaggcaagtatttcttttcttttctttttttttttttttttggagactgagtctcactctgtcacctaggctggagtacagtggcacaatctcggctcactgcaacctctgcctcccaggttcaagcgattctcttgtctcagcctcctgagtaggtgggactacaggtgcctgccaccatgccttgctaatttttgtatttttagtagagacggggtttcactatgttggccaggctggtcttgaacccctgacctcgtgatctgcccgcctcagcctcccaaagtgctgggattacaggcgtgagccactgcgcccagcccaaggcaagtatttcgtatggtgcatgattctaggtgtggaagacaggaatagactttaaagttctgaccgcttagcaggcatgagaaaactcaagaggatttgggaggggagaatgagaagggagggaagaaggaataaaatacagtataggtagtgggggagactcaaaagaagaaatacaactgcttagagctctaatccaagaaacccacacattagaagaagctgacgtttctatttgtttttagcaggtaaataataagaaaaacatgtcaactcttaccaattcatgaaaagaaactatatacaatccccaaaaagccagatataagatattaagagtctttccaaactaaggtcacgtttctcatagttataactgaaccacattcgtaatgagaatatttgataggttggatggtgattctgggtgatcagtaaatattttaagaaattgttgttatttaagaattaaaaagttagggaagagaaaacaaaagaatgagacttttttttccagacttgtagaaagatgatgatggcagaagcaggggaggagcaagcagtttcctaaatggggcaaaattggcccccaccccatgtggctagcaacatctatgccttgggggacctggctggctcctaggcctagcagtttcttatagccagaaaatgctagtcactagcgggagactgtgtcaagctaatttgtgcctctgagcaatgtgtaaagggaattcagaatcaaaatatggatgggcagctgttcaatctgtgaacccccttgtagaagtggggggaggggctgaaaagaatgacatatcccataggctacgataaaaaagcagcatggtattcccaaaataatataaatgccatacacacaaagagataataataatttctaatgtaaatgttctattaatgtttattataattgagctagatcctaaaaggtttgagcaaaaacttattttggggagcagtgtataatatccatccttattctccctaaacttcaaataaattttgttgagagaatatttacttggttttatccatatgatgggcatcaggtcaaacagaagtttgggatattgttcagcaagcaatccactgtaacgagaaattgacagaaattattagaaataacatgaaattcacttctgagaacagattgctacttagatattggcttttactaaaagaaaggactagaggcatagagaaaaagaaatgtaaaaaaagaaaatgagaaaatggcaatgaagaattgagagaaacaaaagacaatgatggaaaggcaaagggtaaacagtggacacatatgaatgtctgccaatttttaatgattgtccatgtggccagggctccaagggaaactttgtctccttttctctatcccatatattttaaacaggaatagtattgcttaatttcctgagtgaagcaggaaattcagtatttattgtaaatatttatttattatctcatcaaaatgcaagaaaaggtttcccattcactaacagaaaggtgaacttcattataactaactgtaaaccatttaaaagtgaggtggtcctacacattacaaaatagaaggaaactgttataaaatggaataggcaggaaaataatttcagctaacttttctactaataagactactgaaatattgactaaaaattattcaagacctaaaaataacaactcatcagttgccccagcttgactaataatttatgtgagagttctgatgttattattacttgccttaaaagaggactttttttttaagcaacagattgcttatcttatctatgattcagctacaaatgaagaggtcctggcagctgaatccactgacctttctcggtcccagcgtgcgccatcgagatacagtccgtggatataaacaccatcttctggtgatgtgtcagatgtatcagatgggataacctgaagggataggcacacactagcagtgatcctctccagacaacttcatctcataaagaacacattagcgaaatattcagaacacattcagggaaactctattgtataatagcttgttaaactatacattttttcagccgtagtttgtaaaaaagtataaaagtacttctttttgaagtattttatcagattgtactgtacctcataatttttgctaaagtagaagaacagcgttggattatttaaatcaaatattgcaatatataaaagttctaagggatagcaagacaaatattcttacaacacaaagaatgaagtaaaattgcttacaatgggttacaatacataaactcggtttaaatacatgacttaatgtaatgatatactgttgactttaaggagttactatacctcaaattcatatcctagcaaatcaataggggtggtatattttctggcataattctgcatagctccagttaaaaaggcctgagtgaaaaagaaacctgacagccaaaacacacaaggttttcctgaattataccagtcctacaaagggaaaacaaaacacattatgtcagtttttaaagttatacaagtgccacctgatgtacaattcctgattctggtttttgcttatgttgcccacattttccatcacgaggccctcttccctgacgtcaaacacacagcctaccttggccctctcacctctttccccttctactcttcttggaaaactcagaacaatttgagcattaacgtgaatgaaacatagtttgaagagtcaaatcttctgcaaaagccaaatgtaaattatttgatgctttattatatcatcccactcaaaagcaaccatcattagacatcttacacattgtctaattatagacctcatttgttgattccagttccttaaccctattttttttttttttgagatgaaatcgcgcaccattacccaggctggagtgcagtggcatgatcttagctcactgcagcctctgcctcctgggttcgagtgattctcctgtctcagcctcctgagtagctgggattacaggcgtgcaccaccatgcctggctagtttttgtatttctagtagagatggggtttcagcatgttggccaggctggtctggaactcctgacttcaagtgatctgcctaccttggcctcccaaagtcctgggatcacaggtgtgagccaccgcgcccggcccccagttccttaaccctcttaaaccccttgtctctgtgtccactgccctcactccagttcagctattcatggtcttctttctgtaccagtgcatgttgtcttcttgcttcttccctttctgctcaatctatccagaagaattgccagaatataactcaccgtgcagaatttggatcagacgtagcatcttgcatcagtgtagcatcagtgacctaccaaattgttcagtgatgcaccaaattaaagcttaagcctcttggtctcctattcaagatacttcacacaaacaaacaaaccaaaaacatagatacttcacaatccatccccaatgtattttcagttctattatatctcttttacttcctttcaggcatcctgcattctaatctggactggactaaagggactggactatttgctggtctctttgtgctgggtggacatttgttgttttcctgcctatcttgaagtgataccatccttctcagtccaagcttctcagtccaggcacctctggtggtagaactccacctagccatgcagggtaggctggtgactcacacctggccagtcatacttccagcctgagtgactgattcagaaatggacatgtgacccaatcaaagccagagatgcagaaactcttgctgggactttcggagaaaagactcactctcaactcctcaaagttgggtggatgtgaggccagagttgctgttgctatcttgctaccatcagatgacagcctgagaatggagtttacccaaagggaatggagacaacagatgaagtgcaagaagccaggacaagatatccatgtttgcaccctggtcaaatgttacctgaagccactttagctcctggagtttgcagttacatgagggaacaaacttcatttttgcttatgtcagaatttttgttacttataatggaatcaatccaaagtggtacagtgctttttatcccataagctacatagtgatctctttttcctttctttgcagtatctaaaccattcattctttaaatcccacttaaatgctacctcatccatgaaacaatctctgctttcttgtgccataagaactctctcccttctttgaaatcccagagcattttacatgttggtctcttatggaacatcccttactatagtgtactaattttctttagatacatggcttgtcccctgtaagctcttggcagcttcagggcaggacttttgttgtgattatctttttatcacaggacacacaaggtgctttgaataaaatgaggtctcaattcatatttatggaatgaacagatgaatcaatgaaatggactttgtctctgagcaggcaatacactctgggaagaagccagttttgctccataggaggaagagaacaaactgctgctggagatgctgcaacagtacaagctgtcaggtcaagaagaggcagagaaagagatgaagtctgacaagggtaaaaccagggagagcgagcaccaagcacaagaaagctgtaaagacccacaaggcaaacatttagaaaacccactcgcccgtggcttcctttatcccagagtgtcattagtgtctgtggtcagctacttgtactacctctgaattagctaccatttactaagtgcttagtacatgccaggcactgtgctaaacatttcatatgcattgcctcatttactctataaaataacagtgagttgaatattatttctgtcattttacagatgaagaaactggggtacagaaagatgagtaacttgctaaaagtcacaaagatagttaagtgttagatcaggatttatgctgggattttaggcagtgtgcaaaaagttttttttttaaaaaaaaggcacaggaaggagagaatgtgaagatgctatggactgaatgtttgttttcctccaaaattcatagattgaaaccctcatctccaaggtgatggtatttggagatggagcctttgggaggtaattaggtcataagggtggagccctcatgataggattagcacccttataagaagaaacagaagagacatttttctctttttctctcatcgtgaaccaggagagctgtcaccagtaacctgaccatgatggcatcttgatctcagactttccagcctccagagcttgagaaataaatgtctgttctttaagttatctagtctattttgcttttttatagcagcctgaactgactaaaaaggagatcgatagggtgaacagtgagagagaaatgaggaaagtgtagagtcctgtaacaatgaggaaagggccccacgtgggggagaacaattgttctgaaaaatgtctaattacagacaatccactagcacatcttgtttccaaataccttgctgtgcctgtagcccgagcagcaccaccttgttctgcatagcccctctagtaccaccctacaaaacttccctccagcccctggttctttgcagatagcctcttctctgctgtgctgcccactgcactgtttcaatgtattttcatactttctctaataaatctgcctttctttacctacgattgtcttggtaaattgttttactgaccatgacgctggccccagtcagttgcacccaagacagaaataatagaaaattcagatgactcatttgcttaacttgttaactctaagaaccattaggaggtaaagaagagtccaagagaaagaaagataatgagagaactatagcttctataagggtaagagaacaatggaggaaaccctttcaatattctgttttgtattattccttttgttaaacatataatctacatgaaaagctcctatcaattaataaataatacaaaagaaaaatgggcctaggatatgaattgacagtacacacacacacccacacacaccacaaatggaaatcacacatactaaagaagcataggctcactagtcattaaagaaagtcgaatggaaacagcaagatatggttgacctatcagattggcaaaaattttaaagcgatataggagaaagtctgtctctctacattcttacaagcactggttattttatgattagcttatacagtgaaagaaagcttttgtgcaataaaaaggcaactgaacactgaaagatcatatacctttgagaatttccaaaaaaaaaatagttttgggattctccccaccccatactccttcataaacatcaaccatagaatgggggcaggcagtggagttgagaaggaaaagcagtgttctgtctgatgtttatgctggggggagggcagagggggcattcaaaatacttatcttttccctggttttctgagataagaggcactgatttaaagacaatggccaattattgataaacccaagcctctggcctgtaatcccagtgctttgggaggccaaggtgggaggattgcttgaggtcaggagtgaggcaccagcgtggggtacttggtgagactccatctctacaaaaagtaaaattagccacgtatggtggcacatgcctgtagttccagttattcaagaggatcccaggattttgagattacagtgagctaagatcacaccactgcactccagcctggatgacagagcaagaccctgtctcaaaaaaaaaaaaaaaaaaaaaaaaaaaaaaaaaaaaatccaagcctcaggatttttgacttaccatcagtattaaaatcacaagacaactttaaactgtggtcttacaggaccacaaacttagaatcttggtctcagaaaaccacaaacttcgaattttgaaaaatataaatgtcacatattacattggtttggctgaagtataattttaattttccactcagtactttgaaatgtgtatatttttcaatattctaaaattttcatcagactatcacaaagctactcatcacatttcattcaactcagagacactcaagtgaccacagccaacaactaatatctccccagttaacccaaaaaataaaattttacatgtgtctgtatattttacatatttatacatgtattttacacacacacacacacacacacacacacacacacacacacacacacacacattttacctgtaaaaagttcaaccgggctaggaaatctgtgatgtaacttcccaggggcttaaggcttgggtatgaacgtttggcccatatttctggaacctttccaacaagtaagctaccggagagtgcctccaatgcagaatccatcacaaccacacccttaatagctttttcaaggtcccgtagagtgttacgtatagttataattaaactgcaatgaaagaaattatgtcatcaacatatatgatgatatcaacatacggtctttccagaagaagaacagcaggaatttcattcccagctttatgggattgcttcccaaaatgtgtcacctcccatgtggtggtacgtgagctaatgttaagtgatacatgtatgaacatttttcattttaatcattacatacatattttaaaatatagaaagtaatacaactagcatatcaaaatttttgctttctggctatttttgcttaggacctggctaatttaagcagacaatgatttaaggaaaaatattaggtaagtaatatttcaggtgacaggcaaatatgaaaaagctgtaatgatgtcgtgcaatggctgaaacaaacactgcatgaaaacataaattgtatattcatttatacacttgcaaatactttacttgcacttaggcccaacttgttaagaataccataaatatacttgtagtgagagtttttaggctagaagcctgagcagctgagagatactgtgttattatatatacataaatataacttttgtataagaaatgctgaattaactaaggcatcaggtgtatatatatatatatatatatatatatatatatatgtattttttttttttttttttttttttttgagacagagtttcattctgttgcccaggctggagtgcagcggcatgatctcggctcactgcaacctccccctcccaggttcaagcaattctcctgcctcagcctcctgcgtaactgagattgcaggcatgcaccaccacacccagctaatttctgtatttttagtagagaaggggtttcaccatgttggccaggctggtctcgaactcctgacctcaggtgattcacctgcctcggcctcccaaagtgctgggattacaggcgtgagccactgcgcctggccaggtagcagaaaaatgacaaaagatgtgactacacataggtctagctaatgtttattctgtctctaattcctaagaagaatagttaacagatggatgagaagttatgattaatgaatatttttaaccagtaataacagatctcttttcatcatcatttttacattttaaaaaatacccactcaactgggcgtggtggctcacgcctgtaatcccagcacttggagaggccgacgcgggtgcatcacgaggtcaggagatcgagaccatcctggctaacatggtgaaaccccatctctactaaaaatacaaaaaattagccagtcgtggtggtgggcgcctgtagtcccagctactcaggaggctgagtcaggagaatggcgtgaacccaggaggcagagcttgcagtgagcccagatcttgccactgcactccagcctgggcgacagagcaaagacgccagctcaaaaaaaaaaaaaaaaaaaagataccctctcttctgagacagaagatatggaactttttctttcttttctttttctttttttttttttttgagacaaggtctcactgtgtaacacaggctggagtgcagtgccacgatctctgttcactgcagcctccatctcccaggctcaagcgattctcccaccttggcctcccaagtagctgagactacaggtgcccgctaccacgcctggataatttttaaatttttgttgacggggttttgccatgtttccgaagctgggatttcagggctcaagcgatcctcctgcctcggccttataaagtgttggggttatagtatgagtcactgagcctggccagaactttttaaaaggggaaaattccaatgaaatgacaggatttaatagtcttttcagctcaataccattgtgtgtttttattgactttggatggttgctgtcaggactctgagcccaagctaagccatcatatcccctgtgacctgcacgtatacatccagatggcctgaagtaactgaagaatcacaaaagaagtgaaatttaaatggcctgttcctgccttaactgatgccattccaccccaaaagaagtgaaaatggctggtccatgccttaactgatgacattaccttgtgaaattccttttcctggctcatcctggctcaaaaatctcccccactgagcaccttgtgaccccccactcctgcccgccagagaacaacccccctttgactgtaattttcctttacctacccaaatcttataaaacggccccaccccatctcccttcactgacaaaacctctcttttcggactcagcctgcgtgcacccaggtgattaaaagctttattgctcacagaaagcctgtttggtggtctctccacatggaagcgagtgaaatttggtgccatgactcggatcgggggacctcccttgggagatcactcccctgtcctcctgctctttgctcggtgagaaagatccacctatgacctcgggtcctcagaccgaccagcccaaggaatatctcaccaattttaaatcaggtaagcagccttttttttactctcttctccaacctctcttactatccctcaacctctttctcctttcaatcttggcgccaaacttcaatctctctcttctctcaatttcagttcctttccttttctggtagagacaaaggagatgcattttatccgtgaacccaaaactccggcgctgaacatggacttgggaagacagtcttcccttggtttttaatcacgcaggggacacctgcctgattattcacccacgtttcagaggtgtctgaccacacagggatgcctgccttggtccttcacccttagcagcaagtaccgcttttctggagggccagaaccccccgaccccttttctccgtgtctctacaccttttctgcttttctggagggcaagaactctctgaccccttctctccatgtctctaccccttctccactttcctggggggcaagcaccccccaccccttctcttcgtgtctctactctcttttctctgggcttgcctccttcaccatgggcagccttccaccctccattcctcctttttctcccttagcctgtgttctgaagaacttaaaacctcttcaactcacacctgacctaaacctaaatgcctcattttcttctgcaatgccgcttgaccccaatacaaactcgacagtggttccaaatagccagaaaacggcactttcgatttttccatcctacaagatctaaataattcttattgtaaaataggcaaacagtctgaggtgcctgacgtccaggcattcttttacacattgttccctccctagtctctgttcccgatgcgactcatcccaaaccctccttctttccctctcacctctcccctcaatcccaaccccaagcgtcgctgagtctttctaatcttccttttctacagacccatctgacctctcccctcctccccaggctgctcctcgccaggccgagctaggtcccaattcttcctcagcctccgctcctccaccctataatctttttatcacctcccctcctcacacccggtccagcttacagtttcattccgcgactagccctccccctcctgcccagcaatttactcttaaaaaggtggctggagctaaagacatagtcaaggttaatgctcctttttctttatcccacttctcccaaatcagttagtgtttaggctctttttcatcaaatatgaaaaacccagccagttcatgactcatttggcggcaaccctgagacgctttacagccctagaccctaaaaggtcaaaaggccgtcttattctcaatatacattttattacccaatccgcttctgactttaaataaagctccaaaaattaaattccggccctcaaaccccacaacaggacttaattaaccttgccttcaaggtgtatgataatagaaaaaagttgcaattccttgcctccactgtgagacaaaccccagccacgtctccagcacacaagaacttcaaaacgcctgaaccgcagcaccgaggctttcctccagaacctcctcccccaggagcttgctacaagtgccagaaatctggccactgggccaagaaatgcccgcagcccgggattcctcataagccacgtcccatctgtgcgggaccccactgaaaatcggaccgttcaactcacctggcagccactcccagagcccctggaactctggcccaaggctctctgactgactccttcccagatcttctccgcttagcggctgaagactgacactgcccgatcgcctcagaagcccctaaaccatcacggatgccaagcttcgggtaactctcacagtggaaggtaagtccgtccccttcttaatcaatacagaggctacccacttcacattaccttcttttcaagggtctgtttcccttgccgccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctgggctacagccacacctcattgccgccttttcccccagttcaaagcctgcttcacatcctccccttgtatctccccaccttaacccacaagtataggacactgctactccctccttagcgaccgatcatgcaccccttaccatcccattaaaacctaatcacccttaccccgcataatgccaatatcccatcccacagcacactttaagaggattaaagtctgttatcactcgcctgccacagcatggccttttaaagcctataaactccccttacaattcccccattttacctgtcctaaaaccagacaaggcttacaggttagttcaggatctgtgccttatcaaccaaattgttttgcctatccaccccgtggtgccaaacccatatactctcctatcctcaatacctccctacacaacccattattctgttctggatcttaaacatgctttctttactattctttgcacccttcatcccagcctctcttcgctttcacttggactgaccctgacacccatcaggctcagcaaactacctgggctgtactgccacaaggcttcagacagcccccatttcttcagtcacgcccaaatttcttcctcatctgttacctatctcggcataattctcataaaaacacatgtgctctccctgccgatcgtgtccgactgatctctcaaaccccagcacctacaaaacaacaactcctttccttcctaggcatggttagatacgactttagatacctggttttgccaaaaaacattatataaactcacaaaaggaaacctagctgaccccatagatcctaaatcctttccccactcctctttccattccttgaagacagctttagagactgcccccaccctagctctccctgactcatcccaacccttttcattacccacagcccaaatacggggctgtgcagtcagaattcttacacaagaactgcgactgcgccctgtagcctttttatccaaacaacttgaccttactgttttgcctagccctcaagtctgcgtgcagtggccgccaccaccctaatacttttagaggcccttaaaatcacaaactatgctcaactcactctctatagttctcataatttccaaaatctattttcttcctcacacctgacacatacactttctgctccctggctccttcagctgtactcactctttgttgagtctcccacaattaccattgttcctggcagggactacaatctggcctcccacattattcctgataccacacctgacccccataactgtatctctctgatccacctgacattcaccccattttcccatatttccttctttcctgttcctcaccctgatcacacttggtttactgatggcagttccaccaggcctaattgccacacaccagcaaaggcaggctatgctatagtacaagccactaacctgcctcttagaacctctcatttcctttccatcgtggaactctatcctcaaggaaataacttctcagtgttccatctgctattctactactcttcagggattattcaggccccctcccttccctacacatcaagctcagggatttgcccccgcccaggactggcaaattggctttacttgacatgccctgagtcaggaaactaaaatacctcttggtctgggtagacactttcactggataggtagaggcctttcccacagggtctaagaaggccaccatggtcacttcttcccttctgtcagacataattcctctctctggccttcccacctctatacagtcctataatggaccggactttattagtcaaatcacccaagcagttcctcaggctcttagtattcagtgaactaatggtcttttaaaaacacacctcgccaagctcagccaccaacttaaaaatgactggacaatacttttaccacttgcccttctcagaattcaggcctgtcctcagaatgctacaaggtacagcccatttaagctcctgtatagacactcctttttattaggccccagtctcattccagacaccagatcaacttggactgtgccccaaaaaacttgtcatccctgctatcttgtctagtcatactcctattcaccattctcaactactcataaatgccctgctcttgtttacactgccggtttacactgttttccaagccatcacagctgatatctcctggtgctatccccaaaccgccactcttaactcttaaagtaaataaataatctttgctggcaaggctacgctgaacctcctcaggcactctctaattagatgtcctaggtcctcccaattcttagtcctttaatacctgtttttcttcttctcttattccatttaattttttaattcatacaaaaccgtatccaggccatcaccaataattctgtaagacaaatgtttcttctaacaaccctacaatatcaccccttaccacaaaatctgccttcagcttaatctctcccactctaggttcccacaccgcccctaatcccgcttgaagcagccctgagaaacatcgcccattctctcttcataccaccctcaaaattttcgccgccccaacacttcaacactattttatttttcttattaatataagaagacagttgccttctgaatcactggggatatagatccttacttgttaaatctttccatttcttgtactaacacagtattcatgctttcttcatatctcacaggatacttccgtagtgccatttcaatgtcgaaatcactagggagctaaaagaatagattttgaagatcacaaattattctcagaatggataattagcttaattcagccattatataataatagctaatactagggtgtatatgtacattagctcataacgtacagtaatgtatataagtcctatgtaccttagctcatccacaaccacagttactaagaacttactatatgccaggcattttataagccactttaaattcatgatgtctttaatgttctcaaaaaacttaaaaaaattggtagtattatcaccatttaacggatttggaggctaatgcttagagaggcaaagttcttgctcaagatcataatgctagtacatggagttttcagattgtcatttcagtatcatttttatttatattataagtaacatattttaagctgaacattaccttgttgaggatatctttggtaatttctaacagaatctgatcagtacttcctgaggctcctgtctgtttggagcctccctgggtgaggagcaaggactcaaagagggtttttgtttgttgaagatccttggagatgtcaacgttttcatgtaatccaaatatctcagggtgttgagtaaatggaagtttctaccagaaaacaaattaagcatgcatcatattttccctggatactgaaagggatgatcaggatacgctactccaaaatatgctactttggcataggggttatgtgagttgaagccaattaataattaacagatacagaaagaggtctctgccctccccttatctgtctaaaagtagggcatcaatttccatttttgacttgtagcatacatttcctctttcttgtaccaggatgaagagaatgacccttctcactggagacagaactggcactgagatgagtctgtataaacagacctcagtcaaaataatccttatcttccactagtttcccccatatgtttcctaatcactttcccacaatgtattgcccctagaactctaaaccccctttcctttatctagtcatgtctctacaatttatcaccctctgttaaaatggtaaatatgcccaagtacaactgcatcgtttggttttcactccttttctgcaaagctcatgtgcacagaaaaatgttaatatccatacaaactatactgcctcttctcctgctaatttgttttttgtcagtttgattggcaggcccctggcactgagcctaagagggtaaagtttttcctttcctacaatacatgaattcataaggcagacatgtgcagaccaaaaaagggttaaaaatcaacatcaaataatggaatactcaaacttttctaattttcagtaattactagaaaaagattattaaaagttgattaaaaccataatatttgtctaaacctatacattagagaagaacatttcaccatttgctgttagaaaaatcacacattaatctaaccttatttttggtgacatcattaccttaatgaattcaatgtagtcctcataagtgcctttaggaggtgcaaaatagtttccactgggagaaaacttataatgagggttttcaactatgtacagattataaaagtcagccagcatggttaatagaagacgtctgtcccaatcgtctgtcactcttcctccataattacactccccagtcaggtaagatatagcttcaaatggaattgtatcatattcattgataaataactgaagcaaaggaaaaatgaaacaagaaaaaccttaaagtatttcacttcatttccattttaagtatgtatctatctatctagaaagggggttgaaagaattatcatgagttgtctttcggtagctgagattgttagtttttttttggacagtctcgctctgtcgcccaggctggagtgcagaggcatgatttcagctcactgcaacctccgcctcccaggttcaagcgattctcctgcctcagcctcccaggtagctgggattacaggagtgtgccaccacgcccagctaattttttgtatttttagtagagacagggtttcaccatgttggccagactggtcttgaactcctgacctcaggtgatccacccaactcagcctcccaaagtgctgggattacaggcgtgagccactgcagctggctgatagtattttatcttaaattgcttgtctgtgtctctaattttttctgaaataaagacatattgcttctgtaatgagaaaaacatttaataaaaaaagacgacatggaaattaccaagtatttttcatatgaatgtggataaaccttgttttatggcactagctatcaactggggttttgtcccccaggttacatttggcaatgtctggagataacttagatggtcacaactgtggtgggggctggggtgttactggcatctattgggtagaagcctgggctgctgctagacaatacacaggagagctgcccacagcaaagaactatctggcccaaaatgccaatcatgctaaggctgagaaccaggtgcctggtttaggagacttttcacaatgtgattaaaaacaaagcaatttcaaactttagtgcaacagcataaatcacacactatgacacagttccactggcaatacatatcatttctagtttccttattattgttgtaataatagtaataaaaactatcatttgcatagtttttatattgtcttattcgcctctcaataactctgcagagtaggaaacagtctagtaaatgtgaagtaatatgaaggcctgaatttatttcttccagttccagatcccatacttgttctaatatacaggaatttttgatagtatgtgtattgggatggtataagttgtgggttgagagcttttcctgcccctgaagtttacttaattatgcacagttgagaaaaaaataattctaaattctctagaaccaagttgaaagaaggcttaatcctttaagactcccacgttttgaagaggaagagaggcgtcaagagatatgaaaggggactgagaaagagggaaggtcgtcgttttgggaaatgaattatttgcaaaaagagtaaagtttttccatgtctcttctttgggggaggggaagggtgtgttcaactgggttccttcccctcccaaagctgaaggaagagacttcacgagaatgtaatgttaaatttgtggcatatgcaagaagtggagaccaacagctcattctctggctgtctttccacttagccccatcagttttctgatttgccttttggagagaggcagcctgctcataccaggtgaagatggcttaaggattaatcctcaatcatctttccagtttctgaagaaatgaaacacggatccagccaatgctggcagtttccaatgttggggctagaaaggttgatgacatcagaagctgtaggctggggcttggccagaagatgattgattatatgcagtatgatggttttggcaaaatgttctccaagcttaggctgtaccaactaaattggtctcgaaaaccaatgtttaaaatcaacgtcatttcatcatgcagttacaattccataggcaccaatctcaacaactgttacaaggattttcaaatggacatatttattccagttaaggtttctgccctgatattttttaaagactcgataaaatatcaactatttctatacaaattatgtgttaacaatttttattttaaaggttggtgtaaatatgattaaatgcttatagccttacaaaaacctacctgactgaaatctaatagcaccaattaattagactttatcaatgcttctcttttcacttcattaggtcctatttcaaaaaggcccctcagaacagcaaaagagcagaaaaatattaatattctgtgtttgtgtgaaaggccagctactcactttcccaagctcccttacagctaaagcctacgcctgtgacctgggcttggctactcagatgcgtccaccttaaactaagtaggggattaatgtacagagaagcaagaacagaccacctatggtggctcatgcctgtaacccagcttgagaccaggagtttgacaccagcctggacaacgtagcaagaccctgtctctacaaaatacgtttaaaaaaaacaacaacaaacttacaaggggccgggcatagtggctcacacctgtaatctcagcattttgggaggtgaggcaggtggattgcctgagctcaggagtttgagacaagcctgaacaacaaggtaaaaccccatttctactaaaaaatacaaaaagttagccaagcacagtggcacacaactgtagtccaagctacttgggaggctgaggcataagaatagcttgaactgggaggcacagcttgcagtaagcagagatcatgccactgcactccagcctgggtgacagagtgaaactctgtttccaaacttatctgggcatggtggcatgtgcctgtagtcccagttactccagaggctgaggcaggaggattgcttgaactcaggagttcaaggctgtagtgagctatgattgcatcactgcactgtagcctgggcaacacagcgagaccccatctcaaaaaaaattagtaacagcaaagaatctctttgaatgtggtcacgacagcagaggcctgcaatagactagagtctatgtggcagccatacaagctctggggtctaatattcaacaagggtagagatgctgccttatcagacacagagtgattttggatttgactctggatgcctcttctctgagcttgactctccagctgtcttggtgatactttgagctacccaatatcctttcaataaattatttttctgctgaaagtagacaagctgtttctgttgattgatagagctaagctgtagacttgaccaagtggaggaaagtagaggatagtggggacatatgttaagccaacactgacaatggcactgcacaaagacaaagaaccagggtcctcgatgacaacactgtgatgttgccgaatcaaccaaacccagagtgtgtccttctgcacctctttattatgtgagtaatgagtttcattgtggtttaagccagtttgaatcagatttcccattacttgcagcacaaagaatccagatggagatagtgcttcataagccatagttattaccatctacccacctgttagtgttgggagaagtgaatcagctattccaagcaaaagacttgcctagggcctgataaatagtgatccttcatgaatgttaatttcttgttaattttacctgcagttgtcggatactgatgcgcaagtcagattcattaaatccatatggaatattccaaccaagaggaccaaatttctttctctcttgcacaagggcatgaaaaaaacaaactccaaacagtaacttctcccaggcctttaatataaaaagtacataacaagaaaaaaaattccggtcagattccatcagtaaaatgagaggaatagataaatgatctttctcacaagattctgtgatcacgtatctctacaaacttctattttaaaaaaatcctatctaaaataatacttactataaatagtattcatcttatgatttaattcaaatctccaaatctggacaaaccatagtaatattaagccttgttaaaatgcaaaaacgttatcattttaccaaagtattgactaataatactttggtattactcgcagagatttacaacttcaatacttaaatgttattctgtaaacttgctggcatatgcttgagactgtaagtgcaggggaatgattaaccattatgatatgaataaatcccaatatgtcattcatgactttgtgactttccatttgaaaatcatttttgaaaccattgtttatttgatctgctttgtggcatccccgtgtctgtgatatgcatgtcacatgggcttctcaagaaatctgtgtcagtgttccagaggatggtcgcccaagtctttaaggtcccccccaagtaaatttcaagtatgatacacagcatgtattttaatttagaatatttcaaacatagctccaaatccagtgaaaatccatccagctattttcatataatgcagtagtagacattattcttcaatattaaaatgcaagtacactatgctttactgagtagatacgtttttgaaatgttctaagtacatcaaagcatattttaaacatactagatgaatgctgtggtgaaacatttcataggggaagaacctttagcaataagagcaatgatctaatttacatgtattttctacatatttttaaatagtgggttttcttaaggcaggaaccatccttaaaattctggaaaactgaatgatcacatttgtttctgtctttggactctatctagactgggttcctccaaaagtagaccttgagagaaagatgcgggtgaaggtgggtgtatgggagaagtgatcccaggaagcaggaaaggagtagggaaagggaggcagagaaagaggaaaagtatcaggaagaattatggaagttgttgctgtgatgaggactcagttctgctgggacaagtggtctctgaatagttgaaggttgcccctggggttgataatttctccacatttttggtctatgcttgtgtgtctacaggcgaagaaggctcctgttgcatcagagaaatctcgaggaaagaaaacagaaagatgcatacttgagataaggtgctgtagcctatgaagagtctgaactcacaaagaactatcttctacaattgtggctgaaattagatatggaccgaagagctgtgacaaaggacgtcagagtagtttgccacagtcctgttatctagatattctaaaaactagatattctttaaaaaacttttaaacattaaaacatactttcttaaaaaataaccccttccccttttttttttttgcttgtttttgactaagccaagggggcagtaggatgctgtcttctctgcctaaagatgataccactgacctgccatcagtgagggtatgcattttagtttgttttctatgacatgatgctgttttgtgttgactcattcaaactccttagcaaggcatgtaaagacttccagtcttgacccaatattccttcccattcttatttcctaccagtttagccaaaatgaggtccttattgctctttcaacaaccttgtcataatagttgtgcatattaaacatacttcttgtgcctacttcaaatatcatttcttccatgaagctttttttcaactcagccaagcagagttaatcacacacaaatggaaagagtcagatgtcctgggtgccaaatcccacctccaacactgggctgagctgtacgactgatatcgtttggctctgtgtccccacctaaatctcagctcaatttgtaatccccgcttttcaagggagggacctataatccctgcgtgttgagggagggaggtgactcaatcatgggggcagtttcccccatactgttcttgtgatagtgagttctcacgagatccgatggttttataagtgtttggaagttcttcctttgctgttctctctcctgctgccttgtgaagaaggtgcttgcttccccctcaccttccaccatgattgtaagtttcccgaggcttccccagccatgtggaattgtaagtcaattaaacctctttcctttataaattacccagtctcagatatttctttatagcagtgtaagaacggactaattcaatgacctcaataatttatttaattcatttgagcctcagtttccttatttaacaaatagatgtgtgcaaatgatacctatattagaggactgttgcaaggcttatatatttaaactaactgaaatctgctggtggtcaataaatgtttgcccctttcctcccttcctttctttgtcctcccttagttcataacactatcatggctgttgcgtgcagttgaacatgcaaatttgtttgtttacatcatacatgttttaataattttcattttattgtggtaaaacatttaacatgaaatctaccatcttaaatttttaaatgtacaatacagtattgttaactataaggacaatgttgtacagctaatctccagaatttattcaccttgcataattgagacactattcccattaataagcaactccctatttccccctcccacagccccaggtaaccaccttctgattctatgagtttgactatttttgataccctatataagtggaatcatacagcatttctctttctgtgactggcttagttcacttaggataatgtcttcaagttttatccatgttgtcatatatggcagtattttcttctttttaaggctgaataatattctacgaatgggcatttaggatgtttccacatactggctattgtgaatggtgctgcaatgaacactggcctgctaatatctcttagagatcctgatttcaatttttttggatactcagaagtgagactgctggatcatatgttctgtttttaattttttgagagtctccatactgttttccttaatggctgcaccactttgcattaccaccaacagtgtatgagggctccaattttgtccttgctaatacatgctggtttttgtttttttgaaaatagccatcccagaaggtatgagatgatatctcattgtggttttgatttgcatttccctgctgactactgacattgagcattttttcatatatctgttggccatttgtatgtcttctttggagaaatgtctattcaaacctttagcccatttttaatctggttattctttgttttctgttgttgttattgaggtgttccatatatattttggaaattaactccttatctaatatatggtttgcaaataatttctcccattccttaggttggcttttcactttgttgatcatttcctttgctgtgcagaagctttttagtttggtttgatcccactttctttttgttgcctgtgttttggtgtcatatctatgaaattattgctaagatcaatgtcgtgaagctttccttctaagtgttcttccgtaagttttacagtttcaaatcttacatgtaagtctttaatccattttgagttgatttttatgtatagtgtaagataggagttaaatttcattcttttgcatgtggatatgcagttttctcaataccagttgttgaagagactatacttctcccattgtatattcttggcacctttgtcaaagatcagttgaccttatatgtgtagattgatttctgagctctctattcttttcctctggtctgtatgtctgactttatactagtacaggttgagcatcctaaaccccaaaacccaaaatccaaaatgctccaaaatccaaaactttttgagtaccaacatgatgctcaaaggaaatgctcattagagcatttcaggttttgtatttttgtatttggaatgttaactggtaagtataatgcaaatattccaaaattaaaaaaaaaaatcccaagcattccagataaggaatacttaacctgtaccatattgttttaatcactgtagctttgtattatattttgaaatcaggaagtagcctgatttcagagaacaaagcctctagctttgttttttctcaacattggtttggccatttaagatcttttgtggttctatatgaattttagagtttttaagattgggattttgatagggattgctaaattaaatctgtagatcactttggttagtttgcacattttaataatttaagtcttccaatccatgaacatgggatatttttccatgttcatgtcttctttaacttattgcatcaatgttttgtagttttcagtgtatatatctttcacctcctcagttgaatttattcctaagtattttattgtttttggtactattataaatgggattgttttcctaatttccatttcagatagtttgttgttggtgtacagaaatgcaactaatttttatatgttgattttgtaccctaaactttactgaattcattgattagctctgacaggtttttcttgtgtggagttttgtggttttctatatacataagatcacatcatctgcaaacaaggacaattttacttcttctggtttgatttggatgcctcctgtttctttttcttgcctaattgttcagtctaggacttccagtctatgttgaacagaagtagaaggagtgggcttccatgccttctttctgatcttacaggaaaaattttcagtttttccatggttgagtataatataagttgtggtattttcatattggcttttattatgttgaggtaattttcttctattcctcgtttgttaagagttgttttttggttttgttttgtttcttcctgagatggagtcttgctctgttgcccaggctggagtgcagtggcacgatctcagctcactgcaccctccacctcacaggctcaagcaattctcctgcctcttcctgagtaactgggattatagccacatgccaccacaccttgctaattttttttttttttgtatttttagtagagacaggtttcaccatgttggctaggctggtcttgaactcctgacctcaagtgatcctcctacctcagtctcccaaagtgacaggattacaggcatgagccaccatgcccagctgagagtttatattataaaaaagtgttgaattttgttggatgctttttctgcatctagtgagatgatcatgtgatttttatctttcttctgttaatgtgtattacattaattgatttttataagttgaatcattttagcatcccaggggataaatcccacttggccatggtgtatatatatgatatgctatatttatgcttgttcttgagccttacttcaaatttagtgaatcagaattccagaagtagggcactgacatctgtagctttaacaagtcccccaggtttgtggggattatggttgagcttgctttccacaggtttcctttgactaaaatgtcagctccataaagacaggaaatttttacatgtttttatatatgttcattgccatattaccagttcctataagaatgtcttgcacctagtaggtactcaataaatatttactaaataaataagtgaagatacagaaatgtatccctgcccttaaggagaataaagtgagtacagcaggcagatctatagactcataacgaatgtcttatcattgctaggtaattcaaacgcccaagatatcaacaacctgtgactaaaaagatcttatttacttttaatggccaaatgatgatagttcaaattattgctggcctaattgtcagaaattagccttatcgaaaggcattccagctatttctggaagcctcagtggaatttcaatatgtctacaaaccagtcacacctgcagaaactggaaggcaatggttttcaaagtgtgattccagaaccagccacatcaacatcaccagggaatttgttagaactataaattcttaagcctcaccccagacccactgaattagagactctggggatgggacccagcaagatgtgtttgaacaagccctctaggggaatcggatgcatactgagaacccatgtcacagggcatttacattcttttacttctcttaccccagctttcatttgtttgtactaccagagaagttgcttggtgaagccttacctattaccactgttcatcacaaaaatgatgatacatggcaaggatactaacttcagatatcccaacaaatcccaatacttacggtgccagcgtagcttgctcaatgttgtaatacccaaggagtgagaatgcttcttctctaactcagcaccatttttatttgaataatctgagtcccaaattagctctgcttgagcttagaatctttcaaaatttcccttctctttcttgccctcgctcttctaattgcaggagctcaaactctggatgaggattagacaccatactatcttctccattctactaagctctctttctaaataaaaccacaaaatatcctctcttgttctaagatttgcaaacaaaattatggcgcagaactagggtacacagaaagtgtcattaagcagagggaaaatacctgactttcaaagaatttagttaattttaccttcaatatcattttttctagctcaaacatgaaaatatgataaatagtacatgttggggtgagggcaggggatgattttctcacagtaatgtttcatgtgcccaattaataatgtaacacgctggacttttctccattcttgtactcacttgctgcaggagagaggagtgacctaccggactggtaaacttggggaaaattaaccagatatgctcagcccagcttctcccttttctttcttagaagtgagcttcttacagggacctgggttttcctttactcttctgggtggataaatttgcttaattttagggctcagtaatatgaaacccatttgttcacagatataagctatatcttccaatctagcctatatcaataattaagcctataatttggttaccatacatttatacttttccctgtttctcaattggtaagaattcaggcagggaaatgagtactctctactgggacccttaaagtctccagtactgtaaacaaaactgtttaaggtggatatacgaaaaagcactattaatatgcttaacattattactagaatctaagtttcataaaggcagatttctttgtctgtctattttgttctcattgctttatatctacactacctaggagagggcctggcacacatacttgttgaaaaagaatcaacaatgggaaaatagatttctactctcgggtcctaatcaaaaacattactgggctttggcttacaaactaagattcattcattcaacaaatatttatttcgatgtctactgtgtgggaagtggaacacaaactatattgaataaaatggtgaacaagataagtacaatttttgtcttgttaggaaatgcgtaaagttttaaaaacattaaataaaaatgttacaaaagcattattaaacaaaattttacacttccatatttgatcactataaaacacattttaaaagttccaaaagatgaatattaccagttcctttccacggcatcccttgaaaaactcaggatcagaaactggatcagtgagatatgattgaaggagattcagccgaagacccgtgggaggttcattagtcatttttactccattctgtagaattgttactgggaactaagacaaaataaatggagagcattatacaagatagcaagtggaggctctaaaagtgcatatacacgtggattaaaaaacaggcataatggagaactccagaaatattcaaaaaacctcttaaggttaagcatctgaggcttgattaagatatgcagacagctggccaggcgtggtggtgcatgcctgaaatcccagcactttgggaggctgaggcgggtggatcacctgaggtcaggagttcgagaccaggctggctgacatggtgaaaccccatttctactaaaaatacaaaaattagccgagcatggtggtatgcgcctgtaatcccagctactggggaggctgaggcaggagaatcgcttgaacccgggaggcgaagtttgcggtgagccgaaattgcgccactgcactccagcctgggagacagagtaagactccgtctcaaaacaaacaaacaaaacaaataagatatacagatagctaagtaaatgtacttaactctataaggaaataaacatacttttgaagatggatagcttgtcagccaaagcctaaaggatgagttacaggtttcagaggtaaaatcttcacatattttttccaacatgggcatccaggacactgcaagatggcaattctgtaggcacacccaagttccttcttcaattgctgctttaatcatttttgctgcaatcggtccttgtccctgtcccagtgaaatagcttgaaacttatttccagacatagatttatcatttgcaaatttcagcaggcctataagaggcacaaaaaaatggtcacactacttactctaaaattataaaaaagtgccttatgtataggtgttttatcatgaaaaattctagttacgtttctctgtaaatatcagatttactaactgatttataatcatataaggaatcagtattgagcaagatgttttatttatgatttcttaaaagtttacagtatatgcacttactggccataggatctgctcctggagatagaacaaaaattaagggaatggtgcaatttgaatccaagtaactctttgtcaaatcaaatggtggaggctctacaaactttttccctagtttgtcagttacatagtttgttatagctggggttatctgttgaagagaaaagatatgatctttagagcaacttttatttcacataatggatatgaatattattgaaaaacaacaaagaatacaatttgagcctaatggtcaaaaaaagcatatagcatcatagacaaagcactaatttctctaaaaaataaaaactatatacatttataggagaagactatccaaaagataaatgggcaaaggagacaaactgcttagagaaaatcaagtacaaattgatcctaaacatatgagggatgctcaatgtcactcattatagcagagattgcatattgtcccacttatttgtctctgtttggtattagaaccccaagttttcctggcatttcttgcaggtaatgtggccatgtgactaagttttggccagagagatacaagtagaaattacttatggatcttccagataatattttaaggaagctatttgccttcaacaatttcttctcttttcaacatagcgttcacaagccagcttccattttgctgatgaggaccacactgtaagcatgaaagaacctgagtttctgggtgatctcaggagcaagagcttccctgtcagcccttcatcatttgcctctgagctgttaggagagagagaaattaacttctatttgatttaagccactgtactttaggtccctttgttacagcagcttcatttatacgctaatactcataataagaaaaatacaaattataactatacttagataccatttttaacctattgaattgttatataaatcagccaaagatggcctgggaggccatgatatcttgatatttggtcaaatagcagtctacacatgttgctgtgaaggtatttttggatgagattaatatttaaattagtagatatggagtaaggcagattgccctccacaatgtggtgggcctcatacaatcagttgaaagccttaagaaagaaaaaagcctggggggaggagccaagatggccgaataggaacagctccggtctacagctcccagcgtgagccacgcagaagaggggtgatttctgcatttccatctgaggtacttggttcatctcactagggagtgccagacagtgggcgcaggtcagtgggtgcagcgcaccatgcacaagccgaagcagggcgaggcattgcctcactcgggaagcgcaaggggtcagggagttccctttcctagtcaaagaaaggggtgacggatgacacctggaaaattgggtcactcccacccaatactgcgcttttccgatgggcttaaaaaacggcacaccaggagattatatcccccacatggctcagagggtcctacgcccatgaagtctcgctgattgctagcacagcagtctgagatcaaactgcaaggcggcagcgaggctggggaaggggcgcccgccattgcccaggcttgcttaggtaaacaaagcagctggaaagctccaactgggtggaacccaccacagctcaaggaggcctgcctgcctctgtaggctccacctctgggggcagggcacagacaaacaaaaagacagcagtaacctctgcagacttaaatgtccctgtctgacagctttgaagagagcagtggttcccccagcacgcagctggagatctgagaacgggcagactgcctcctcaagtgggtccctgacctctgacccctgagcagcctaactgggaggcacccccaagtaggggcaaactgacacctcacacggctgggtactcctctgagacaaaacttgcagaggaacgatcagatagcagcattcgtggttcacgaaaaaccactgttctgcaaacacctctgctgatacccaggcaaacagggtctggagtggacctctagcaaactccaacagacctgcagctgagggtcctgtctgtcagaaggaaaactaaaacagaaaggacatccacaccaaaaacccatctgtacatcaccatcatcaaagaccaaaagtagatacaaccacaaagatggggaaaaaacagagcagaaaaactggaaactctaaaaagcagagcacctctcctcctccaaaggatcacagttcctcaccagcaatggaacaaagctggacggagagtgactttgacgagttgagagaagaaggcttcagacaatcaaactacgagctacaggaggaaattcaaaccaaaggcaaagaagttaaaaactttgaaaaaaatttagacaaatgtataattagaacaaccaatacagagaagtgcttaaaggagctgatggagctgaaagccaaggcacgagaactatgtgtagaatgcagaagcctcaggagccgatgcgatcagctggaagaaagggtatcagtgatggaagatgaaatgaagcgagaagggaagtttagagaaaaaagaataaaaagaaacgaacaaagcctccaagaaatatgggactatgggaaaagaccaaatctacgtctgattggtgtacttgaaagtgacggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgagctctcggcagaaactctacaagccagaagagagtgggggccaatattcaacattcttaaagaaaagaattttcaacccagaatttcatatccagccaaactaagcttcagaagtgaaggagaaataaaacactttacagacaaacaaatgctgagcaattttgtcaccaccaggcctgccctaaaagagctcctgaaggaagcactaaacatggaaaggaacaaccagtaccagccgctgcaaaatcatgccaaaatgtaaagaccatggagactaggaagaaactgcatcaagtaatgagcaaaataaccagctaacatcataatgacaggttcatattcacacataacaatattaactttaaatgtaaatggactaaatgctccaattaaaagacacagactggcaaattggataaagagtcaagacccatcagtgtgttgtattcaggaaacccatctcatgtgcagagacacacataggctcaaaataaaaggatggaggaagatctgccaagcaaatggaaaacaaaaaaaggcaggggttccaatcctggtctctgataaaacagactttaaaccaacaaagatcaaaagagacaaagaaggctattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggagttgaactcagctctgcaccaatggacctaatagacatctacagaactcgccaccccaaatcaacagaatatacatttttttcagcaccacactacacctattccaaaattgaccacatagttggaagtaaagctctcctcagcaaatgtaaaagaacagaaattataacaaactatctctcagaccacagtgcaatcaaactagaactcaggattcagaaactcactcaaaaccgctcaactacatggaaactgaacaacctgctcctgaatgactactgggtacatagcgaaatgaaggcagaaataaagatgttctttgaaaccaacgagaacaaagacacaatataccagaatctctgggacacattcaaagcagtgtgtaaagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaaccagagcagaactgaaggaaatagagacacaaaaaacccttcaaaaaattaatgaatccaggagctggttttttgaaaggatcaacaaaattgatagaccgctagcaagactaataaagaaaaaaaagagagaagaatcaaatagatgcaataaaaaatgataaaggggatatcaccactgatccaacagaaatacaaactaccatcagagaatactacaaacacctctacacaaataaactagaaaatctagaagaaatggataaattcctcgacacatacactctcccaagactaaaccaggaagaagttgaatctctgaatagaccaacaacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaatttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatactcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatctgaaaataataacagctatccatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattatatatctagaaaaccccattgtctcagcccaaaatctccttaagctgataagcaaattcagcaaagtctcaggatacaaaatcaatgtacaaaaatcacaagcattcttatacaccaataacagacaaacagagagccaaatcatgagtgaactcccattcacaattgcttcaaagggaataaaatacctaggaatccaccttacaagggacgtgaaggacctcttcaaggagaactacaaaccactgctcaatgaaattaaagaggatacaaacaaatggaggaacattccatgctcatgggtaggaagaatcaatattgtgaaaatggccatactgcccaaggtaatttatagattcaatgccatccccatcaagctaccaatgcctttcttcacagaattgggaaaaactactttaaagttcatatggaaccaaaaaagagcctgcattgccaagtcaatcctaagccaaaagaacaaagctggaggcatcacactacctgacttcaaactatactacaaggctacagtaacaaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatggtcaaggacttcatgtctaaaacaccaaaaacaatggcaacaaaagccaaaattgacaaatgggatctaattaaactaaagagcttctgcacagcaaaagaaactaccatcagagtgaacaggcaacccacaaaatgggagaaaattttcgcaacctacttatctgacaaaaggctaatatccagaatctacaatgaactcaaacaaatttacaagaagaaaacaaacaaccccatccaaaagtgggcaaaggacatgaacagacacttctcaaaagaagacatttatgcagccaaaaaacacatgaaaaaatgctcaccatcactggccatcagagaaatgcaaatcaaaaccacaatgagatatcatctcataccagttagaatggcaatcattaaaaagtcaggaaacaacaggtgctggagaggatgtggagaaataggaacacttttacactgttggtgggactgtaaactagttcaaccattgtggaagtcagtatggtgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatagaatactatgcagccataaaaaaggatgagttcatgtcctttgtagggacatggatgaagctggaaaccatcattctcagcaaacaattgcaaggacaaaaaaccaaacactgcatattctcactcataggtgggaatcgaacagtgagaacacatggacacaggagggggaacatcacactctggggactgttgtggggtggggggaggggggaaggatagcattgggagatatacctaatgccagatgatgagttagtgggtgcagtgcaccagcatgtcacatgtatacatatgtaactaacctgcacattgtgcacatgtaccctaaaacttaaagtataataattaaaaaaaaaaaaaaaagaaaaatgcctgatttcccctgaggaagaggaccttttgccagcaaactgcctttggacttgagctgcaacatcaactcctccttgagtttccagcctgccagcttaccatgcagattcaccagcttccacaatcacaccagccaattcctttcagaaaatcaatcaatcaatcaatcaattcccctcccctgttgttttatttctctggagaacagagggaaacaagtagaaggcctgaataatataggctttaattccatttagtttaactcaattcaattcaacttaattcatagacatttgttgagcttctaccatctgtcagacattgctctaaatcctggcgatacagaggaaaataacacatgaatcttgacctcaagaagctcacagtctagtgggagaccctaaaaagtaagcagacaattattgtacattctaatggggtaagggctatggtatataagcacaggcttccaaacacggcagacaaagcaaaaaccctacatgtggtattgaaacaatatctctactgcccatcaggggagccattctgtaaagtgcaaataggcaggtgttcccagatacatagctattaagtcttcgtcatgaacaagggaggctactggtgataaaataatgaataaaccattatttaggggttccagggacttaaagtgactctctagttagagtcactgtgtatgtctatacacagacacatatgcacacacaactatcaggcaagaatgagatgaatattaaccaagtacaaaggtctttgggaatcagggtaaggagtaaaacatttatgtaggcctctgtttaaatctacccagagacagagcattagataatgttccttgtgagactttactaaaacggtaaaatttttttcttttaaaaaaagaaggaagaaacgaagggactattgcaatcactttcaaaaccttcatatttttcatggtgtaggtgaagtgacttactggtaaagattctttcctcaaacaaaccttagttagacaggctcctctgaacccctttttctatgaggccttgtcttcaagagcccagttgtagcaagaaccctgctagccagtttagtgagagtcccctaccctctacatctgatcgccctccatatctgatcaaattcctcataccctgccatctcccaggtggtatctcatcaccctggcctgctttcagcaagaattttgttaggtcagggtagcaagaattccccctacccttggtgtctcttcttagtaatttccccccaccctgctccttgactataaatccccaactgtctctgctgtatttcgaactaagcctgagctctctttcctactgtgatagtcttgaacaaagtcttccttactgctttaacatttgtcatgaataattttttaacattactcaaagtttaaactagatgtatgaacatggtttcttgttttctttctattacaaaattatccctttgtaatactatgatcacctttcttaaatttgtgaaaattggtgtcagcctacttatcttacctttagaaagatttctgtgcatgtttgaactaataaaattgtgacatgtacaaaattttctgccatcttctacttttagctatgatgtggttatagggattggatttaccctactaccacaaacaatttaaaaaacaggcacaattaatgaaaccaccatttttgcacagggggcaataggtggtataggactgtgatcactgagaaaaagaaaacaaactgaacgctattctctcagctttcttcttggaggtatgctagactgtggaacagcgagagtgattaaggcagagcaatgcagtgtcactgagttgcaaaaacaagaaaaagactacaaaggggccaaggctgctggaagttgcagagttctaattaggatagaactgtccaggcagagttcagaaatctgctcacagtacctctgaatccttgctgaacactatggtgtgtatgcatgagaccaagaaaagagcatctgaggtgctgtaaccaggagatctggggagctaccactgttcatgaaggctgggactcattcaggttcccaaaagccatagagagtccttagtgatcgcttggagcattcagtaaaggccccagacgggtggcactttggtagagctaaataatgcattgaataaaggctattctagaccatcctaacaaatcttaaacaatatttgaaaggaacaattcaaacttcagtaatttaactacataaccacagaagttgataaacgttctgtagagggccagataagaaatattttaggctttgtgggacatatacagtttctgttgcatgttcttttttattttattattattttttatgagacagagtctcactctgccacccaggctggagtgcagtggttcgatcttggctcactgcaacctctgcctcccaggttgaagtgattctcttgcctcagcttcccgagctcgaactcctgacctagcgatccacccacctcagcctcccaaagtactgggattataggcatgagccaccgtgcccggatacatgttctttttaaggcaacttttttttttttttttttttagatggagtctcgctctgtcacccaggctgtagcgcagtggtgcgatctctgctcattgcaacctccgcctctccagttcaaacaattctccttcctcaacctcctgaatagctgggactacaggcatgcaccaccatgcctggctaatttttgtatttttagtagtgacagggtttcaccatcttggccaggctggtcttgaactcctgacctcaagtgatctgtcctcctcggcctcccaaaggccaggattacaggcatgagctactgtgcccagtcaaaactactctttttaaaaatataaaaaacattcttagttcatgggatggaccaaagacatcgtggggctggatttggcccacaggtgtttgttgacccctgaactagcaggacagaactcaacaatctttataggaaaatgaaatctaactcatcaacaatgtgatattcacaatgtccagtatccaatcagacattattagacatgccaaaaagcaggaaattatcatgtataactaaaagtaaaatcagtcaatagaaacagatccagaaatgatggaattagtagtcactaattttaaaacagttattataactgtgttcaactatttaaaagaaaatattagcagattaaaaagagaaataggatacacaaaaagaaccaaacaaattttttagagatgaaatacacaattactaaaattaaaatgggaaagggatttgtagcagattagacaatacaaaagaagaaatcaacaaatgtaaagatagcaacagaaactacccaaactgatgcaaggagataccacggcttaaaaaataattaacaaagtatcaattacattatattacattagcatcacattaggcaatctaatatatgtgcaactgaaatcctgggtggggtgaaataatatttgaagaaataataaccaaaaatattcctaaattgaggaaaacagtaaacccacagatctaaatccaaagagctcaatgaactgtaagctggataatcaatctgagagttaaagaatcaaataacaagaactttaagcctagcacttcataaatggcaaattatctgggttccaaatagaacacattggtcttttaccttatcaggtcttaaacaccgaagaattattattttctgtagttcatttaggttcttatccattggtgctggaaatttagcattatgtggctctttactgtcatagatttctcgccattcatatatatgttcacaaaaatgttgcctaatagaaaaaagcttaagaattattctttttattgggaaaaacttaaaagagattgttgaacaaggagtagaaaccagacagctatttaaaaccatttaaaaatcactaaattgaagaacaagtttacatattgccattcaatgataaatcatcgaatttaaacaatcacctgagtcctctgaaggcaggaaattcacttgcccgacagatttcctcccagcttttgtcctgtagccaagttggatcaggatttttctcagcacttttaagacttactcctccagttaaaagaaacatcagttcctggtattcaatctctttccttgccctgtattcccaaaataaggactgttatataattgttgattttaaaattgaatgatgtcaacttccgcttttgtaacctggatagaacaacttagactgtacttacccacctgctgtaaacaactagaaaactggacaaaattaatgaaacaactgtttttttgaaattgttcaatagccagtgcaggactgtggcctctgagagaagagaggtgaataaggtgatccccgttcctcagcaggctgcctggcactttctagactacagagcagggaggtgtgatcagaatcagagctctgcagtattgctgaattgaggaaaccggcattaagttctcctcaacagtattgctgagttgaggacatcagcattagggaaagcttaggtgactggagtttgtgagcagaggaggaagatgaatggaaaaggtgaatgaatgtcttaaaaatctacagaggtgctctcttggttctactgataaatacagccaggcattgctcatagaattcttagtcacgcattctaagaagtgtgttgttaggcgatttcatcattgtgtgaacatcataacgtgtacttacacaaatctagatggtgtatatggtatagcctgttgctcctaggctataaatctgtacagcatattactgtactgaatacagtaagcagctgtaacataatggcatgtatttgtgtatctaaacgtagaaaagaacagtaaaaatatggtattataatcttatggcaccgctgttgcatatgcagtttgttgctgactgaaacattgttatgtggcacatgactgtactaagagatgcatcagtaaggtaaaattccaggaagccagcaaaagaacatctaaggggctgtaaactgaaagctcccagagatcacacaagactaagaaatataagttattgccaaccagagttgagtctttgttcagcaccagaggaattcaggtctccttagtggtgaagctaacatagccttagagtaaaggttactctaaaactactgtaagaaagcttaaacacaagtcgtcttcttttttttaagagatggcgaactgctctgtcatctagcctggaagtgcagtggcacaatcatagttcactgcagcctcaaacttctgagcttaagtaatcctcctgacttagccttctgagtagctgagattagaggtgtgggccactgcacctagaataagtcttgaaaagatcaaactaatccagtagcaatttaactacctaaaagagtgaagtctaaagctctttaaaggaatacaaaatgtccagcatttaccaatataaaattcacagcatccataaccaggaaaaaaattggtcttagatgtagatgtagatgtgaaagagataatttaactagccagtaagaatgttaaagtagttatcataaacatgctgaaggagttaaagcaaagtatgaacataatagaagaaataggcaatattaaatagaccaaacacaactcctaaaaataaaaatacataatctgttataggaatagaaaaaaacctaaagataaaaatataaaaattgagatatttacttatttcttttccagatgtatagatattgaaaagattcattacaagtagacctacactacaagatatcttaggggaagtttcagataattggaactctggatctacaccaaagaataaagaacaatagaaatggtaactttgtaggtaaacataaaagatttttttaaaaaatcattaatatttaagtgtctgtaaaagataatgtcaggaatttggaagtcatcactcacatcctcacaataagaaaaaagctgaacaaactgaaaatcagcaacttttcttagatgcatcagaggactgaggtcatatggctaactcactacctcccaactggtaagagacagataaatacagagaatcctaaattacttgagcagaagctcaggttattatcaataataaccttgcatgtaaacaaattaaatcccccaattaaaatatataaactggctaaatgaataaaaaacacccaactatatgctgcctacatgaaactcacctcacctgaaaagacagagactgacagtaacaggatgaaaagagatattccacaccaatgaaaactaaaaggaagtaggagtagctatatttacatcagaaaaaaacagactttaagttaaaaagtaccaagagacaaataataacattatataataataagggaatcaattcagcaagagaatataacaattataaaaatacatgcacctggccaggcacggtggctcacgcctgtaatcccagcactttaggaggccataggcaggaggactgcttgagcccaggagctccagaccggcctgggtcacatagggagaccctctattttaataataaaatttttgtaaaagagagaacttttcagctgggcacggtggctcacgcctgtaatcccagcactttgggaggccaaggagggcagatcacctgaggtcgggagttcaggaccagcctgaccaacatggagaaaccctgtttctaataaaaatagaaaattagccaggcatggtgacgtatgcctgtaatcccagctacttgggaggctgaggcaggagaatcacttgaacctgggaggtggaggttgtggtgaaccaagattgtgccattgcactccagcctgggcaagaagagtgaaactccatctcaaaaaaatatatatatgtgtgtatatatatatatgcatccaacaccagagcacccagatatataaagcaattattattagatctaaaggcagaggtacaccccaatacaacaacagttggagacttcaacaccctactcttagcattggacagatcatctagacagaaagtcaacaaagaaactgcaaatttaaactgtaccatagaccaaaaagacctagaagacatttacagaacatttcatagtacttgcagaatacacattctcttcatcagcacataaaacattctcccggattggccatatgttaggacacaaaaaagaaaccttaaaaaattgtttcgctctccctctctctctcttctctctctttccacggtctccctctgttgctgaggctggactgtactgccgtgatcttggctcgctgcaacctccctgcctcgggctcccgtgattctcctgcctcggcctgccgagtgcctgggattgcaggcacgcgacgccatgcctgactggtttttgtatttttggtggagacgggttttgctgtgttggccgggctggtctccagctcctgacctcgagtgatctgcccgcctcggcctcccgaggtgctgggattgcagacggagtctcggtcacttagtgctcaatgttgcccaggctggagtgcagtggcgtgatctccgcccggctgccccgtctgggatgtgaggagcgcctctgcccggccgccacactgtctaggaagtgaggagcatctctgcctggccgcccatcatctgggatgtggggagcgcctttgcccggccgccccgtctgggaggtgaggagtgcctctgcccggccgccctgtctgggaggtgaggagcgtctctgcccggccgccacctcatctaggaagtgaggagcgcctctgcccggccaccaccccgtctgggatgtgaagagcatctctgcctggccgccccgtctagaaagtgaggagcgcctctgcccggccaccccgtctgggaagtgaggagcgcctctgcccggccgccccatcttgggggtgaggagcgcctctgcccggccacccattgtctgggatgtgaggagcgcctctgcccagccaccccgtctgggaagtgaggagcacctctgcctggccgctgtgcaatcttccaagtgtgaagtgacagcctttctgcaggtgtacccaacagctccgaagagacaacgaccattgagaatgggccatggtgacgatggcggttttgtcgaaaagaaaagggggaaatgtagggaaaagaaagagagatcagattgttactgtgtctgtgtagaaagaagtagacataggagactccattttgttctgtactaagaaaaattcttctgccttgggctgctgttaatctataaccttacccccaaccccgtgctctctgaaacatgtgctgtgtcaactcagggttaaatggattaagggcggtgcaagatgtgctttgttaaacagatgcttgaaggcagcatgctcgttaagagtcatcaccactcccttatctcaagtacccagggacacaaacactgcggaaggccgcagggtcctctgcctaggaaaaccagagacctttgttcacgtgtttatctgctgaccttctctccactattatcctatgaccctgccacatccccctctccgagaaacacccaagaatgatcaataaatactaaaaaaaaaaaaaaaagaaagaaagttgatctcatgagaaagagtagaacagaggctgggaggggttggcaggataaggataaacttgttaaaggatacaaaaattaaagctagataggaggaataagttctactgttctgtagcactgtaagatgactatagttaataataatttattatatactttcaaatagctagaaaagaggattttgaatgttcccaacacaaatcataaaactttgaaaaaaaattgtttcaattgaactaatattaagtatcttatctgaccacaatggaataaaagtataaaccaataacaagaggaacactcagaactatacaaatacgtgaaaactaaacaacatgctcctgagtgaccaattgattaaaaaaagaagttaagagagaaagtaaaaaatacctcacccctgtaatcctagcactttgggaggctaaggcaggcagattgcttgagtccagggattcaagaccaacctgggcaacatggcaaaaccttgtttctaccaaaaacagaaaaaattagccaagtgtggtggcatatgcctgcagtcccaactacttgggaggctgatatgggaggattgcttgagcccaggaggttgaaaccacagtgagctgtgatcataccactgcactccagcatgggggacaaagtgacaccctgtttcaaaaaaaaaaaaaattccttgaagcaaatgaaaatagaaacacagcataccaaaatgtatgggacacaacaaaagccatgtttatagcaagtttacagcaagtatagcaagaggcaagtttatagcaataaatgcctacattaaaaacagaaagatttcaaataaataagctaatgatgcacctcaagaaactagaaaagcaagaacaaaccaaactcaaaattagaaaaaggaaaaaaaaataaaaagcagaaataaatgacattgagactaaaaaaatagaaaagatcaatgaaacaaaaagttggtttttcaaaaagatcaacaaaattgacagagcattaactagactaagaaaaaaagagaagacccaaataaaatcacaaacaaaaggagacattacagttgatactgtggaaatacaaaagatcatcagagactattataaacaattataaactaatcaatttgagaacctagagaagatgggtaaatttgttgacacatacgacctatcaagattgaaccaaggagaaatagaaaacctgaacagatcaataatgagtaatgagattgaatcacagtaatgaaaaggaaatcaagaaagaaaagtccaggaccagatgtcttcactgctgaattctaccaaacttttaaagaactaatatttttaaaaattcttctcaaactattcccaaaaattgaaggggagggaattcttccaaacccattttacaaggccagcataaccctgacgccaaaaccagataaaaacacaacataaaaaaactagaccaatgtctctgatgaacataaatgcaaaaatcttcaacaaaatctgaattcaacagcacatcaaaaatatcatacactattatcaagtggatttatcctagggatgcaaggattattcaacctacacaaataatgtgagacatcacaacagaatgaaggacaaaaacaacacgatcatctcaatagatccagaaaaagcgtttgataaaattcaatatccctcataaaactctcaataaattaggcatagaaggaagtacctcaacacaataaaggctatataagacaaacccacagctaccatatactgaactggaacaagacaaggatacccactctcatcactcttattcaacatattaatagtactgaaagtcttagccagagcaattaggcaaggggaaaaaaatgaagggcattcaaattagaaagaaggaagtcaaattgtccctgtttgtggatgacatgattttatatatagaaaaacttagactctacccaaaaaactcttaaaactaataaattcagtaaagttgcaggatatagatatcaacatacaaaaattggtggtgtttttatataagaacaatgaactagctggaaaagaaatcaagaaagtaattccatctgcaaaaattacaaaaaataaaatacctaggaataaatttaaccaaggaggtgaaggctctctacaaggaaaacttaaaaaacaccaaaaaacaatgattttttgaaagaaattgaagaagacatcaaaaaatagaatgacatcccatctttatggattagaaaaattaatattgttaaaatgactctactacccaaggtgatcaaaagattcaatgcactctctatcaatataccaatgatgttcttcacagaaatagaaaaaaaaaaatcctaaaatttgcatggaaccacgaaagaccgcaaatagccaaaacaatactaagcaaaaagaacaaatctagatgcatcacagtaccaggcttcgaaatatactaccaaagctctattaacgaaaacagcatggtactggcatacaaccagacacacagaccagtggaacagaatagagaacccataaattaatccatgtatctacagccaactgacttttgacaaagatgccaagaacattgattggggaaggacagtctcttcagtaaatggttctggggaaaattggatatccatatgcagaagagcaaaactagactctctcctcttattctacacaaaaatcaactcaaaatctcttcaagacctaaatgtaaaacctgaagctataaaactactagaagaaaacctggggaaatgcttcaggacattggtcctggaaaagattttatgaataagaactcaaaagtacaggcaacaaaagcaaaatataaataagtgggattatatcaaactaaaaaagcttctgcacaccaaaagacacaacacaatgaaaagacaacctacagaatgggagaaagtatttgcaaactggccagacgtggtggcttatgcctgtaatcccagcactttgggaggctgaggcaggtggatcatgaggtcaggagttcgagaccagcctggccaacatggtgaaaccctatctctactaaaaatacaaaaaaaaaaaaaaaaaaaaaaaattagccgggcatggtggtgggcacctgtaaacccagctactgaggaggctgaggcaggagaatcacttgaacacaggaggcaggggttgcagtgagtcaagatcgcaccactgcactccagcctgggcgacagactgagactcaaaaaaaaaaaaaaaaaaaaaggaaagaaaagaaaatatttgtaaactattcatccaccaaagaattaatatccagaatatacaaggaactcagacatgtcaacagaacaaaaaaatctaatttttaaatgggcaaatgaggctagcatgatggttcatgcatgtaatctcagcactttgggaggccaaggcaggtggatcactttagcccaggagtgcgtgactgggcaacacagcaaaaccctgtctctacaaaaagaaaaatacaaaaattagccaagcatggtggcttgtgcctgtgtcccagctacttgggaagctggggtggaaggatcacctgagccgggcaggtggaggttgcagtgagccaagaaagtgccactgcactctagcctgggtgacagagtgagactctgtctcaaaagaaaaaaaaaataggcaaatgatctgaacagacagttctaaaaggacaacacacaaatggccaaaaacacatgaaaaaatgtttgatatcactaataattagggaaattgtggggaaaagaaagagagatcagactgttactgtgtctagatagaaagggaagacataagagactccattttgaaaaagacctgtactttaaacaattgctttgctgagatgttgttaatttgtagctttgccccagccactttgacccaactactttgacccaacctggagctcacaaaaacatgtgttgtataaaatcaaggtttaagggatccaaggctgtgcaggacttgccttgttaacaaaatgtttacaagcagtatacttggtaaaagtcatcggcattctctagtctcagcaaaccaggggcacaatgcactgcggaaagccgcaggggcctctgcccttgaaagctgggtattgtccaaggtttctccccatgtgatagtctgaaatatggccttgtgggatgagaaagacctgaccgtcccccagcccgacacctgtaaagggtctgtgctgaggtggattagtaaaaggggaaagcctcttgcagttgagatagaggaaggccactgtctcctgcctgcccctgggaactgaatgtctcggtataaaacccgattgtacatttgttcagttctaagataggagaaaaaccgccctatggtgggaggcgagacatgtttgcagcaatgctaccttgttattctttactctgctgagacgtttgggtggagaaaaacataaatctggcccacatacacgtctaggcatagtatcttcccttgaccttaattataacatagattcttttgctcacatgttttttgctgatcttctccttattatcaccctgttctccttctacactcctttttgctaaaataatgaaagtaataatcaataaaaactgagggaactcagaggtcgatgccggtgcaggtccttggtgtgctgagtaccggtcccctggacccactgttgtttctctatactttgtctctgtgtcttatttcttttctcagtctctcgtcccacccaactagaaatacccacaggtgtggaggggcaggccaccccttcaggaaatgcaaatcaaaaccacagtgagatatcatctcaccccagttagaatggctatcatcaaaaagccaaaaaatacaaatgctggtgaggatgcagagaaaagggaactcttatgcactgttggtaggattgtaaactagtacaaccattacggagaacagtatggaggttcctcaaaaactacaaatcaacctactgtatgatccagtgatcccacaaccaggcctttatctaaagggaaggaaatcattatattgaagagatgtctgcaccctgattttttttggtagcactattcacaataaccaaggtatggaatcaacctaagtgttcaacaacagatgaagggataaagacaatgtggtatacatacacaatggaataccattcagccataaaaagaatgaaaacttctcatttgtggcaacgggaatgaaactgaatgacattatgttcagtgaaatacgccaggaacacaaagttaaacaccacatgttctcacttatatgcagacgctaaaatgaagttgatttcatagaagtaaaaagtagaacagagtatactagaggctgggaaacagggaaaagcagggattagggagaaatttgttaaaggatacaaaagaagttctagtattcaatagcactgtaggatgagtgtagttaacaataatatattattgttgactcttgaacaaccaacacaggagttaaggtgctgaccccccatgtggtcaaaattcatgtataatttttgactcccccaaaacttaactactagtagtctattgttgactgaaaatcttactgataaacagttaattgtacatatatgtcatatgcattatatactatattcttacaataaagtataccagaaaaatgttatcaaggaaataataagaaaaatgcatttacggtatatactgtatttaccaatactgtaaatttacataatctgtttacaagatgaaatgtctgtctgaaatggtgggtaaccatgctgcagacctcaatttatggtaaatatcaaacaattccattttttcttgtaaagtaatgactcttctctgtctcttgggagaacttccaggaaaactacaaaccaaaatctctcatgaaaatagacacaaaaattctcgacaaaatattagcagatcaaatcccataatgtatacaaagaattatacactagtggcactttgtatgggtcttatgttattccaagtttgtgatattttactaaacacaacgaaaaatacacgagaaccatgaagagatcactttttactgccatacccaatgtactgaagagatgaactgctcttgagatgatgagcatcacctgacattttaagtggataattgtaacacttaagctcatgtcaacagcaacaggaggtggctacaaaattattacagtagtacagtgtgtgccacagttaattttatgcagttatgatttgatgctgcatctttatatttgtttatatttcttgactgcaaatgatgccatgtatgaactgtgtgtgagctttgataaatttcaactttttgtaacagatttgtacatattttatggtagtaaatgataaaaatagactagtatctacatatattttatgtatttatgacatacctaaccttttcttaattttttgaatatttctggctaggcagttcatctgtcttttcaaagtgtcacaaatcttcagaaatttttccagtatatttattttttaaaaatctgtgtataagtggactgctgcagttgaaacccatgttgttcaagggtcaattgtatatattttcaaatagctagaagagagaatactgaatgttcctagcacaaagaaatgataaatgtttgagatgatggatatgctcattaccctgatctgatcactataacctgtatgttctgaaatattactgtggaaccaaaaaatacatacaattattatatgttaattaaaagatacaaaaatgaaaataatggcttgttcaaaataataatagcaacaatgtatttggtgactatagctatggataagtgaaatgaatgaccacagtgttataaggcacgggggaggggaaactgtaaagagtctgttacaaagtacttgcaggaagtggtatagtgttatttgaatgaggacttagatagattagttgtaaatgtacattgcaaactcaagggcaataacaaaaaaaagttttttaaaaaagtaagtataattgatctgctaagagaagagaaaaaatggaatcatacaaaatagttaaaaccagagaagacagaaaaatagaagaggaaaacagtaacaacaacaacagaacaagggcaatgaataggaaacagtaacatatatggtagatattaatccaactgtatcagtaatcagtttaaatgtcaatggtctaaatacatcaattaaaagacaggttgtcagagtggatccaaaagcaagacccaactatatgctgtctacaggaaacccactttaaacatagaaagacacagatacattaaaagtaaagagatagagaaagatataccatgctaacactaatgaaggggaagtagggtagctatattaatttcagactaagaagacttcagagcaaggaaaattattgggaattaagaggagcattacgtaaagataaagaagtcagaatctcccaaaactctcacaagggaaaacagataatatgaatagacctgtatctattaatgaaattgaatcaataattaataaccttctaaaacagaaagcaccaagcccagatgggttcactgaataattctaaacatataattaaacataactaaacatataggaagaaattaaaccaattccaccatgtcttccaggacatagtggaaactggttctatgaagccagtattacctaatgccagagccaagcaagacattataagaaaggaaaactacaatccaaaatctctcataaaaatagatgcaaaaatcctcaacaaaaggaacaaaatgttagcaaatattagcaacaaaatacagcaaatcaaatccaattatgtatagaaagaattatacaccacgactaagtgggatttattataggtatgaaaggctgattcaacatttgaaaatcaattaatgtaattcatcatagcaagagagtaaagaagtaaaaccatatgatcctatcaaaagatgtagaaaaaacatttgacagctgggcacaggagctcacacctgcaatcccagcattttgtgaggccaaggcaggcagataacttgaggtcaggagtttgtgaccagcctggccaacatggtaaaaccctgtctcaatgaaaaatacaaaaattagccgggcttggtggcaggtgcctgtaattccagctactggggaggctgaggcaggagaatcgattgaacccaggaggcggaggttgcagtgagccaagacgagatagagccactgccactccagcctgggtgacagatcaagaatctgtcttaaaaaaaaaaaaaaaagcaaaagacctgaacagacatttcaccaaagaagatatatagttggcaaataagaataggaaaagatgctcaacatcacatttcattaggaaattccaaattaaaatgaaataccactaaacactattaaaatggccactttccaaaataggtaacatgaactcttattcattgctggtggagacgctaaatggtacggccactcaggaagacagtttggcagttctttacaaaactaaacatactcttaccatacaatccagctgttgcactcctggtacttacccaaaggagttgaaaacttatgttctcacaaaaacttacacatgaatgtttgtagcatattattcataattgccaaaacttagaagcaactaagatgtccatcagtaggttaatgaataaactgtggtacatccaaacaatggaatataattcagcactaaaaagaaataagctagcaagccatgaaaagacaaagaggaaccttactactaagagaaaaaatcccatctgaaaaggcatacatagcgcataattccaactatataaccctctggaaatgacaaaactaaaccatggagataacaaaagaatcagtgattggcagggttgaggggagggagggctgaataaatagaacacagaggatttttagagcagtgaaactacaatgatagatatatgacattacacacttgccaaaattgataggtgtataatacccagagtgaagcctgatgttacctatgaacttacttaggagtgataatgatatgtcaatgcaagctcatagatgctaacaaatatatcactctggtaaggggttttgttagtgcaggaggttgtacataagaaatctctatcttctgctcagttttgctgcgaatctgaaattgctctacaaaataaagccttttcaaaaaaaggatgggcaagatatagaaaactatgaaacattatagagtgaaatgaaaaagaactaaggaaaatcgagtgacatactatgttcttagattgaaacactcagtattgtgaaattgttaattttccacaaactgatttacagttccaatgcactcctcatcaaaacttcagtgcattactgggtatctttccactttggacttgaccagatgatgctaatatttatatggaaatgcaaagatccaagaataagaaagacactcttgtgtaaaagaacaacaaacaaatgcaacaaaaacaaagataaatagatgggacttaattaaactaaaaacctcctgcacagcaaaagaaataatcagcagagttaacagacaatccacagagtgggagaaaatcatcacaatctatatatctggcaaaggattaatatccagaatctacaaggaactcaaattagcaagaaaaaaagccaaacaatctcataaaaaagtgagctaaggacatgaatacacaattctcaaaagaagatatacaaatggccaacaagcatatggaaaaatgctcaacatcactaattatcagggaatcgcaaatcaaaaccacaacatgataccacctcactcccgcaggaatggccacacacaaaaaaaatggatgttggcgtggatgcggtgaaaagggtacacttttacactgttggtgggaatgtaaactagtacaaccactacagaaaacagtgtggagattccttaaagagctaaaagtagatctactgtttgatccagcaatccccctactcggtatcccagaggaaaagaagtcagtatatgaaaaagacacctgtacacacgtttatagcagcacaatttgcaattgcaaaaatatgaaaccagcccaaatgcccatcaatcaacaagtggataaagaaaatgtgacatatatataccacaaaatactactcagccataaaaaggaacaaaataatggcattcgcagcaacctggatggaattggagactactactttatttatttattttgagacggagtcccactctgtagctcaagctggaatgcagtggcgctatcttggctcactgcaacctttgcctccagggctcaactgattcttgcctcagcctcttgagtagctgggactacaggcatgcgccaccatgcctggctaatttttttgtatttttagtagagacagggtttcaccatgttgccctgggtggtcttgagcacctgaactcaggcgatccacttgcctcggcctcccaaagtgctgggattacaggcgtgggccaccacacccggactggagactattattctaagtgaagtaactcgcttcacttactgtaatgtaaaagcaaacttcgtatgttctcactcatatatgggagctatgctatgaggtcataaaggcataagaatggtacgttggactttggggacttgggagaaagtgtggggggtggagagggataagagactacacattaggtacagtgtacactgctctggtgatgggtgcaccaaaatctcagaaatcaccactaaagaacttattcatgtaaccaaacaccaccagttcccccaaaaaccagttgagataaataaaaaattaaagaacaagatgaaacactatcagaaatcaagattaattacacacatacacattaatggaactgaatagacagtccagaaacagatctagatatatgaatgtattatttatggcaaggaaggcactacagagcagtagggaaaaggccaagtcttttcaacaagtggagagctgcatggtaaaaatgtaaaatttgacatttccttagaccacacacacacatcagttgcatgtggcttgtacatctaaatgtgaaacgcataataaagcttccagatggttatataggagaataccttcataatattgggctgtgaaaagagttttcacaaagcaagaaccataaatcagattatattaaaattaagaacttgtgctcagcaaaaggcagcattaagagaaagaaaaagcaaactagagagtgagtgccaatttgtcacatacaattgtcaagggatttgtgtctagaatatataaagaactcacacaaatcactaagaaaaacccaatagagaaatggacaagtgatgtgaacaagtacactagaagatttccaagtggcctataaacatgaacaagtgttcaacttcattagtcatcagagaaatataaattcaaaccatgatgcaataatatgtatcacataccaaaacagatttttttaacaacaatataaaacgttggtgggggccgggtgcagtggctcacacctgtaataccagcactttgggaggtcgaggcaggcagatcacgaggtcaggagtttgagaccagcctggccaacatagtgaaaccctgtctctactaaaaatacaaaaattagctgggcatggtggtgcacgcctgtagtcccagctactcgggaggctgaggcaggagaatcgcttgaacccgggaggcggaggttgtggtgagccaagatcccacaaccgcattccagcctgggcaacagagtgagactgtctcaaaacaaacaaacaaacaaacaaacaaaaaaccaacaaaaataaaacgttggtggggatctggtgcaatggaatgctcaaattctgttaatgggatataaactggtacaatcattctggaaaacaatttgtaattttctttctggacatcttcccaacagaaacgtgtgcacatgtgccctctacatttatacacaagagtgttcatagcaccattacttataatagtgccaaactggaaacaacccatctgttcattgagtagaacaggtaacgtcaatgtattcttataatggaatactgtaaagcagtcaaaacaaatgaactagcctcatgctaccacatggatgaatctcaaaagtaatgttgaggaaaagaagccagataaaagaataaagaatacatattacttgctttcattcatatatgtaatatatatatatgtcaagctaatctgcagtgttataaatgagtctatggtagttacctttttggggtagtaaggaggtggtaactgaaaggagtacaagtgcttcaaggatggtggggaaatgttctatttcgtcaccagatcctccctttgtaagaatttgttgaactgtacattaatactctgtgaacttttctgttacataaattttaaaaattaaataaacaccgatactatcgtagaagccattgttatcagtgaaatgcacaagtaaaatcatgacttaagcgaagaaaaatatagacttctgtgagaagacatattcacagatttgattttccagggaggttttaaaaataaataaattatggtaaaagcaagtaacttacagaagaagattggcacataataaaaaggaaaataacagcttgtccttctcaaatagtgatcggcatatattacaatataagttgtatgtgaagtggtcatttaaatatcgtaggcgcttttccaaaatcttggatttgttactaaagttaaaaagaaggaaaacgtattgtcaaacaaaactaagaaaatataagcaatgtgaattaacatatacactttttattttatgaaagtatcactattaaaaacgtataaagatacacacacgagggcatgtaaaactggtgaaatctgaataagctctatgggttgtagcaatatcagtttctcggttgtactataggcaagatgctagcactggagaaacaagatgaagggtacgtgaaacctctctgcacgtatttttctgtgtgcaacttcttgtgagtctgtaagtattttaaaataaaaagttttaaaatgtagggtataattctctgagaaagtgaaatatggtttacaccatctctctattttccaaatcctaaatatcttattctgccccaaagtgactgaagacaatcagttaattaaaaaaaaaaatgcctattaaatctctattagtgtaaggctctatggtagggagggaaatgtaacagacaaagcattatgaaacatttgcccgccccaaagaagcataaagtctagataaaaatctacataatttaaaaatgcatgaaaaggtcaggcgcagtgtctcctgcttgtaatcccagcactttaggaggccgaggtgggtggatcatttgaggtcagaagtttgagaccagcctggtcaacatggtgaaacctcatctctactaaaaatacaaaaattagccaggggtggtggtacacgcctgtaatcccagctacgagggagcctgaggcaggagaatcacttgtagtggaatgcacctgtaatctcagatacttgggaggctgaggcaggagaatcacttgtagtggaatgcacctgtaatctcagatacttgggaggctgaggcagaagaatcacttgtagtggaaagcacctgtaatctcagatacttgggaggctgaggcaggagaatcgctagaacctgggaggcgaagattgcagtgagccgagattgcaccactgcactccagcctgggtgacagagtgagactccatctcaaaaaaaaaaaaaaaagaagaagaagaagaagaagaaagacataaaatcaacaacctaactagacacctcaaggaactagaaaaagaagactaaaccaaacccaaagctagcaaggaagctaggaaggaaataataaagattagagtggagatgaatgaaatagagaatagaagatcaatacaaaaaaaaagagagagagaagactcaaataacaaaaatcagaaatgaaaatagtagcacactctggtagcacaaccaatgccacagaaatacaaagaattataggagaatgatatgaacaattgtatgccaataaattggataacctagcagaaatggataagtccctagaaactaaagcaccgatcgatttattaatatgctaaaaataacatagctaacaaatcatgcaaagcaggaactaatactgtatctgtctaatttcaaagtccacgttcttgctactatgaagtagtaaatgaagtatgctgatttctaaatttgtagttaatttggtagacaatgcatcaaaagttttcctctaaagtgtaagcagaaaaagaaacaatgtaagtgtaattttcctttcatgtctatgtagatagatttctttggtatgagcttggattctaccatttccgcctagaagtagcaaagaaaaatccatttctctatgctaaattttaggttgtagaaattgtttgtgaaaggtcagtgaaagtgaaagaagtccagcaatttctcccttttttttttccactttgtatcatctctctgttggggctacagacccctaggcatataaggacgaagccccaagtacgcactccactatcctgttggtcaccgggacagcaataaagctctaaagaaactattaagattactactaagacaacattaatgccatcaacatcatcatcaggttcatggttaaatctgctagaaaccatttatttatctgaaataagtcctctctgaactggaataaatatatagtcagtggcacaagccaggtacagaaagataaacattacatgttctcacttatatgtaggagccaaaaaagttgacctcatggaggtagagagtagaaagacacttatcagaggccagaaaggagaggcagacagaggaggataaagagaagcagctcaatgggtacgaacatgcagttagaagaagttccagtgttcaatagtacaatagcgcaactatatttaacaatgtattgcatatttcaagatagaagatttgcaacattcccaacacaaaaagatcgatgttctacgtgatagatatcctaaatgtgctgactccatagttattcattttatgcatgtatcaaaatatcacatgtacctcataaatatgtacaaatattatacatcaatatttttttaaagcagcagccatggtaatagtgtagtggataagacttgagttagaaagccttgctctgttatgtgtcacatgtcactcagcttcggtaaaacacagagacaacccacctgctgcattgcattgctgtgcctatagaatgagatcatgtaggtaaaagcggtaaaagctaggtaaagcactcaggacagaactcaacacacacagtagatgctctatggacagtattagcatcatcatcatcactggagttcagtacacagctacacaggctggttctctctttacgagtaaaagaatatactgttttcattttagatactaggcttcttcataattttaccttcatatcctctctccattcattcataccatagctcttagaaatttctggttggaaaatatgcatttttgccatggatgtagccagacgagttaaagattgacgaccacttcctccaagaccaacaagcaaagcatttccaccagattgctttagaactcgacatattcttgataaatgttccaaaacatacctaccacaaaagaaaaattttattaatgcattacaatataaatgtaaatgtatagttacatgtaactattgtttcactttcctagaagaatgtgactctgctgtcccatatgttactatcccaattttaaagagtttactatcaaaaagtgtgatttttcaaaagcagttacaactggatcatttgatgtaggggaaaactaattaaaagttcaaattcaggaaatttgatatacaagttatacaaataaaatgaaatattaactgctaatactggcagtatattatcacttttattaaatatgtttcttcagtctcttaagatttctatgtgagaaaagatcattacctataaaataacaaattcagaaaaggcacttagcttcactggtaattaggttaattaaaattaaaatgataatgagataccatttcactctccttagactagaaaaacttacagtatctgccagtcctaagcatcagcaaaggtgaagaataatggaagctctcaaaaataataatcactttaaaagatgttttggcaaaatttagtaaagttgaagatgcttatatactatgacatgataatcccacttataggaaaatagcctagagaaattctcacacatgtacccaaggagacacggatgtgaattttcaaagccttttttataatagcaaaaactagaagtcacctaaaatttgtctcagaagaatgactgcattgtggtacaattatataatagaatgcaatatagtggtaaatattcatttttctgtgactctcacaatatggaataaaccaactagcagaagattatatccagtattataccatttatatgcagttttaaaatatgcaaaataagactacatacatatttacgaatacatacatgtatagtaaaagttctaagaaacaaaagtttcggccaggtgtggtggctcacatctgtaatcccagcactttgggaggccaaggcaggcggatcacttgaggtcaggagttcgagaccagcctggccagtatggtgaaaccccatctctactaaaaatacaaaaaaaaattagccaggcatgccggcgcatgcctgtactcccagctacctgggaggctgaggcaggagaatggcttgaacccgggaggtggaggttgcagcgagctgagatagtgccattgcactccaatctgggcaacagagcaagactcagtctcaaaaaaaagaaaaagaaaaaagaaacacaagtttcttttcactactactcgtatgacacaggatgcagtgagacagggtgactataacagggaatttcaaataaattactaatattttatgttttatgctggataatgggtacaaagtcattcactgtatttttctttacaccttttggtacatttcaaacatttcataataacattttacagatagcaatttcaagcatcaacaccatatataggtacctaaaaatgacaagattcattcttgttttgtgtgtttgattatactcatctaagcactggtccacaacatcactaaaatgatgaatatttggaatttcaatataaactctatcatctccttcaaggtcaggattcatataatcaccaaacatgagatttcttaagtcttcttcagttacctatagaaaggaaatcaacaaattttaaaacttaaaacatttaaaaataaatttaagaaaacaaaatttttgtttcatccatgttataaagtaattaagtttttaaacattagggtagtaaaaaatgcacttataaaattaatacctgaaattatatccttaggatataaaaagaaaagtaagatttatatgttttgttgttgttaggctagagaagtcattctgggcgactcccattgagtagttactaagtgatggtcatcatgttaagcactttatatctattatatcatttattccctatcacataaggtgttattctttaaataacttctatgttacatactttcctatgaagataaatcttctcaaaacaaacacctatttacaaggaatgctaaaagaatatgttcattaagaaatgatttttaaaaatataacttaattgtaacaattcatatatggtactgctttaactcaatatgttcttaatcgccatactcactggtgcattttgtttcctcaaatgtgaaaagatactgtgaaatgattctttaaaatggtcctttataacagttttagttaactggaacagccatcttcgatcatcatcattaatgaggcgatcataaaacactcggagaacctcatgcacaaacagacggatcatagtgtgtttgttcgccacggcgtctctttcaatgagtaaacagccccggatgacgcgtgaaaaatcacgcaagttgaaagtataatgggattttgtgggagtgggtaaaagattttccacagattgtttatatatctgaatatgaaaaaagcaacaaagcaaaaataaaatgcttataatcagtaaagtcatgtaaccagtggaatgttatacaaaatattttatttactctgtcagattatatgggcttgggctgggcgcggtggctcacatctgtaatcgcagcacttttggaggctgaggtgggcagatcacctaaggtcaggagttcgagacaagcctggccaacatggcaaaaccctgtctctactaaaaatacaaaaattagccaggtgtcatggcacgtgcctgtaatcccagctacgcaggaggctgaggcaggagaatggcttgaacccgggaggtggaggtagacattgcaaagagccaagatcacgccattgcactccagcctgggcaacgaagtgagattctgcctcaaaaaaaaaaaaaaagaaaaaaaaagattatactggcttggaaaattgcatagtactaagcttagcatggcatatatgtttattttggcttatagcactcaaccaggcattattaacttgagggaacttaatatccgattccatccaagcccagcccatccaagtggaaacctgtctctacttttatttcccagttattatggttacaccatttaaaggtgaataatctgaggttaaatagtgaaaaacaaaatctttcagagaaagggaaatcagataactcatgctgaatcattccaaatgaagaggaagatgaaataattttcttgttactacaatcaacttcaaaataaatcaatttgttctctctcttcccttctatctcttattccctcaccccccttcttctttatatctaaattggctttaaggaaatgaagtatatttttactatgtactgaattcaccaaatgaagtttaacgttctcttaaaggaaggtgaattaagccttttataatatagtcaaaaaaggaaaacaaaaaaactttttttttatttttgagatggagtctcattctgtcgccccgctggagtgcagtggtgaggttttggctcactgcaacctccacctcctggattcaagtgattctcctgcctcagcctcccgagtagctgggactacaggtgcacaccaccacgcccagctaatttttgtatttttagtagagacagggtttcaccatgttggccaggatggtctcaatctcttgaccttgtgatccgcccaccttggcctcccaaagtgctaggattacaggtgtgagtcactgcgcccagccaacgttttttatttgtatgtgttctgtgattcatctccctgctccaacctccacacatggtaggtctataatgcttcaaagacagaaaaaaaaaaaaaaaagccgggggtagggaggtggcagggatgctttctgtatccccttctacctgaccaacacctctgtattttccaggacatgcctgaaatagaaatattatgttttataaatagaagcacttttctgtatcagaacaaatgtactatctctttgctcatagtagtttctttacttgaacagcacacactttccactgaaacaaggggagaattttagaagattgatgttcttggaaatggatggaaggattctagggagttttctgcttcctgttgcagtgatcacaaaatgaaacttgctttatgaagcttctagaaagtgtagtttggtaagatcatgactgacgtgcctttaaatatattgtttcccatttaccattagagatgaggctggctctagtctttgaacagaggcaaataacacacccgaaataagttaaaaactgttctttggccatatggggagtcttgttgtctgtttctacccttgtatttctcttttataattattttttcattgctacttataaattatgtggtctgactaaaagtaatgtattcataagctgcttaaatttctttaagacaagcatgcaaaatgggagggaagatagagagaaaaaacgacaagtaccagagtaggaacctaatagaaaaatacctgtgatgtggcagatactagttttagatgttttccttataacaaccttgtgaaataggtgttttattccattttagtcattaaaaaaacagcctctggaatgtcaaattacttgctcaaaatcatatagctaggaaatagcagtcaaggctcaacccaagttggattccctcatttcaaatcctgtgatcttcctattctctggtcttctaaacagtttctctgacaccaaagaccaaagcagatagcatcaaaaaaataaaataagcgccaaatgagggaaatatgtaatactaaaacatttacattgcattattgactgacctccatagtcccattgactatctggttcccaattacaaagtactctggaggaaattcatgagttctaaggtagaatgctacaatagatgagaagattcggaccatagtttcatcactaaaagaattaatactgcagatgttgaaatgtcgaatacaacggggagtaactggatttcttccaccacctggagggcccattgcagcaatcagctctatgtccaccagcgtgattttacttgtgtccttaaggtcgtaccttagaaagcacacacaaaaaatttagattatctgttataaagacattaagatgggatgaaatatagatctcccaagaaatttaatcagattttagcttctctaaaaggaataacttcagataacactttgagtaggagagaaattttttttaaagcagaatttggtttctcccctcagtgactgattctgctacccagattttggatatctggaatgacccttccctcttacttttccctctctttcctcctactcttccttacagtttgactctccatttctcctttcttattccaaatctagaagcatggatgagtgatcaatcctatttgtagctgtttatagataaggtgactatatatctcattttacctaggacaattctggcttgtgcttgttgtaccgaagtaattattaataacactccccttttactccagaaatgtcacagtttgaacactaagttatatactaaaactggttatagcaatgtcctgattttttctcatctcaaactgtatcttcagagtggataaagatgtctaaataggatctatacattttgttatagaaagggacccattagggaaaaatgaaatttcaaagaagttttaatcagaaataaataggaaatgacataatttagctggaaccactcagagtaaaaggttgctattgtcaataagccatcaagtctctaatactgaagttactgcacacacagacatatacatacagaggctggggtaggagtctatctagccagtccttagactaaaagcatgctagaaagtatgaaaatatggtttttggtaacaaccctaataatcaacaatagaagaccagctaagtaaattacggtgacatccacataatattaaagccaataaaacgaatgagtagacaaatatgcactgatatggctatttgagataaatatataagtgtaaaataatttacaaaatattacatgtaatatgagcctatttttacacataaaaatagacttatatagaaaaaaatcactgaggaatagtgattatctcctgataatcactaactcaggagagtgactatcttctgagataatcgcagtgattatctcaacaatggttatctcctgaaagcagaattcctagggcctatagtaataacaaaaatgcaactgtaaaatatgacttagctttgaaattcgtctacccttgtcttgagataaaaatcatggcatactgaggaatagaaaagtacatttaagaggaggaaaggaagaattattcatcctaattaaaaggtgctatatcttacatgtgagaaactaaccatatcaccataaattggtgtggggagaatggaagggttatccatgagattgctgtcaaatacaagccatctcaaagatatggtaggtagttccaagcagccacagaaaacatacagttaaaaacatggtagaaaaatagggtgctgattatggttacttaggttgggcactacccacaaattcttgacttgggggaatggtactttgaaggatgtaatctgtaaattattttcaataattgaaactaatagttgaaaagtgcaggcataccccattttatttcacttcatttcattaagctttgcagatactgtgtttttttacaatctgaaaaagtttttagaaacctgtgttgagcaggtctataggcaccatttttccaacagcatttgcttacttctggtctctgtgtcacattttggtaatacttgcaatatttcaaacttttccattttttttatatctggtatggtgatctgcgatctttgatgttactattgtaattgttttggagcaccatgaattgacctacataagaagaaaaccttaactgattaaatattgtgtgtgttctgactgttccactgactggctgttccccatctctctccctcttctcagaccttcctattccttgagataaacagtatggaagttaggccaattaataatcctccaggccgggtgtggtggctcatacctgtaatcccagtgctttaggaggccaaggtggtggatcacttgaggtcagaagatcaagaccagcctggccaacatggcaaaaccgtctctactaaaaatacaaaaattagccgggtgtggtggtgtgtacctgtagtcccagctacttgggaggctagggcataagaatcacttgaacctgggaggcggaggttgtagtgagccaagatcacgccactacactccagcctgagtgacagagcaagactttgtctcaaaggcaaaaaaaaaagccaaaaacgtcctagtaaactaggaataaaggtaacttcctcaacttggtaaggaatatctacaaaaaccctacagctaacatcatacttaatggtaagaatctccaagctttcccactaacatcaggaacaagataaaaatgtcccctctcatgacttcttttcaacatcatactaagggctagcaataagatgaaaaaaaaggtataccgactgggaagaaaggaatgaaactatccttgtttgcagataacatgatgatctataaagaaaatctcaaagaactacaaaaaactcctggaactaataagcaattatagcaagcttgtaaagagttaccatgtaaaattcaatcacctttttacataccagtaataaacaagtggaatttgaaattaaaagtacaacacctgggccaggcacagtggctcatgcctgtaatcccagcattttgggaggccgaggaaggtggatcacttgaggtcaggagttcaagaccagcctagccaacatggtgaaaacctgtctctactaaaaacacaaaaattagttgggcatggtggcacatgcctgtaatcccagctacttgggaggctgaggcaggagaatctcttgaacccagaggcagaggttgtagtgagccaagatcatgccactgcactccagcctgggtgacagagtgagacactgtctcaaaaaaaaaaaaaaaaaaaaaaaaaaaaagaaagaaagaaaagtacaacaccatttacattagcacccacccccaatgaaatacttagggatatatctaacaaaatatatagaagatctatatgaggaaaactgtaaaaccctgaagaactaaatcgaagtactaaataaaaagaggtattccatgttcatggataggaaaacaatattatgaagatgacagtccttccaaacttgacatgtagattcaacgcaatcccaatctaaatcccagcaagttattttttggatattgagaaactgattctgaagttgatatggagaggccaaagtcccagattagtcaacactattgaaagagaaaaacaaagtcagaggactgacacacccaactttaaggcttactataaaactacagtagtcaagacaatctggtactggcaaagcagacaaataggtcaatggaacagaatagagagcccagatatagacccaataaatacagttaactaatctttgacaaaggagcaaaggcaatattatggagcaaagatagtcttttcaaggaatgctgctgggcacagtggctcatacctataatcccagctacctaggaggctgaggcagatggattgcttgaagctagaattttgagaacagccttgacaacatagcaagacccctgtcttttagcaaaagacaaatatcgttaaacaactggacatacacgtgtaaaaaattgacctatacacaattttacaccctttacaacaattaactaaaaatggatcacaggcctaaatattaaatgcaatactataaaactcctaggagatagcaaaggagtaaacctagttgaacttgggtatggcaatgactttttcagacacaacaccaacagattggttgagaaactggacttcattaaaattaacaacttctgctctgccaaagacaatgtcaagagaatgagaagacaggcctgacttggagaaaataattgcaaatgacacatctgataaaggactattatccaaaatatacaaagaactcttaaaactaaatgataagaaagcaaacaacccaatttaaaaatggccaaagaccctaacagacacctcaccaagtaagatacagagagggcaaataaacatattaaaagatgcttcttaccgtatgtcatcagggaaatgcaaattaaaacaatgaaataccaccacacactcattagagtggccaaaatctagaacactgacaataccaaatgccagagaagacgtggagcaacactaactctcattcattcctgatgggaatgcaaaatggtatggttattttggaaggtagtttggtggtttcttacaaaactaaacgtattcttaccatattgttcagcaattgtgttccttggtatttactcaaagaagttgacaacttatgtccatgtaaaacctatgcacaaatgtttatagcaactttattcataattgttgaaaacttggaagcaaccaagatgtccttcagtaggttaatggattagttaattgtggttaaccagacaactgaatgttactcagtgctaaaaagaaatgagctatcaagccatgagaagatatgaatgaaactcaaatgcatattactaaatgaaagaagctaatttgaaaaggctatatactgtattactccaactatatgacattctgaaaatggttaaactatagagagaaaaagaaattaatggatctcttacaaaggggctgaagttgggggaggaatgaaaagagaacacagaggatctttacagcagtgaaaattctctgtatgatattataatgatggacacatatcatatacatttctccaaacccatagcatgtacaacacataaagcaaaccctaaagtaaactatggactttgggtgattgtgatataccaacgcaggcttatcatttgtaacaaatgtgccaatttggtggggatgttgagattgaggaggctatgcatgtgtcggggggcaaggagtatacaggaaatctctgtaccttcctcttaatttaaaatagtcttttcgaaatatattagagaggcttcatgtataggaaaatctgagcaactattcttttccctaaatatcttgaaaaatgtattattttactttaaaaacctaaaataaaaactgaggtataacttcagcataacttatcgaattaaatagttaccaatgtccacagtcaaaaaactgtcgtaataattcaataggtggttgagctccatacttctccaatgcaggcatattcatatcatctataaaaattatacacttctttcccataggtggtccaaagactcctttgcgtcttttatccaatctagccatgataatgttctaaaatatgaaggaagaatggtatatttacctataattgaattagggatttatcatacttatattaaatcagtatcaacaagtaaaacaacccattttgccagaatccatgggatttttaccagtaacaattactatttgcttaatttatcaatgattaacttaacataaaataccatatttaacaccagaaaaaaaaagtttaagtttctgtagggaaatcataccaagcagcattatgtgtgtgtttttatttattcatatttagggtgatactaaacttcacaatcaacatcattcaaacatttgttgaaatcctatgcactcacaattgttacacatgtatatttatgtattatctttgtatagtatatgcatgtttctacaacatttctacaagtgtcaccaaaatttctacaatattttcctcactggataaccaacatatttttatttttttcttcactgaataattttactttccaacttttattttagattcagggagtacacatgcaggttatatgggtaattgtgtgttgtgagggtttggtgtacagattatttcatcactcaggtaataagcatagtacccaataggcagtttttcaatcctcaccctcctcccccgctccactctcaaggaggccctgatttctgttgttcccttctttgtgtccatccgtactcaacaatgtatctattaattttaacttacttaatatttaaatgcattaatctttacatttggcagctttttatagctaaaataaatgtggatgctttcttatagttctaatactttgggaactcacttgtccattggaaaaataaaccaaaattattttcattcaaataaagctccacagtaaaggagttctaaatttgtaagattttgaagttcagtgaagaacatagacttaaaacaacagaaatgaggccaggagagaatggataggtataaatttggaaatgtatgataaaaacggcaattagaaacagtttcatgaaatgtgtcaaggtcagtttcaccttgacacatttgagggcaaagggtaggatgcactcacatggttcctgtcacaggcccatggtttgaaaggtccagggagcagcaaatgcccctaatgaccatccaggagggtcttgagagaacaattcaaagttctctcatttctccctgggtctccccacccctgccccaccctatgtgtgtgtttgtgtgtgtgtgagtgtgtgtgtgtcttttatattccctttaccagttaagaaatcgttgcttcttctcaggcttaaaaaaaaaacaggtgataaagctcagtaacccactattaacgtaaaaatgttctctgaaacttgtatcattaattccaaaaacttgtaactccccaaacatttgaaagttttaaattcatagatttacacagttgcttatttaatgtacaattttaaacactgagcaaataagacaaaaaaattaacgatagacccccatttctgtctttaaactaacctgaacctgattggcgctggtccgtgcagataagttaatataaaaaggaaagtactggtccttttccaagtgattcattagcttatccttcacatacacagattttcctgtacccgttggacccacaaaaaggagtggccttaatgaaaacaatgaatatattattcaaaatggaaaaaaagtcagaatacatttctactaaaggaggcggtagttaaaagtgtacataagaatcaaatcatcttcattaaaaactcatttttacctatagttatttcatgaaagacagataaaagtaatgattggcatatatttttgcacaacattgcagagactttattttgtgtctttttattttttattctttttttttttttttttgagacagagtctcacttagttccccaggctggagggcagtgacgtgatcttggctcactgcaacctccacctcccaggttcaagcaacccccctgcctcagcctcccaagtagctgggactacaggcatgcaccaccacacctggctaatttttgtatttttagtagagacgggtttcaccgtgttggccaggctggtcttgaactcctgacctcaagtaatccacctgccttggcctcccaaagtgctgggattacaggcatgagccaccatgcttgatctatttttattttttgagataaggtttcactctgtcactcagtctggaatgaagtggcacaatcatagctcactgcagccttgaacttctgggctcaagtgatcctcctgcctcagcttcccaagtagctaggactacaggtggcatgccaccacaccaggctaatttttttacttttaacgttttaaagagacagggcccggctatgttgcccatgctggtctcaaactcttggcctcaagtgatcctcttgtcccagcctcccaaagcactgggattacagacaggagccactgggaccagccttatagatactttaatagtaataaactattatttgaatagatgtaatatcgctatatataaaacacttatgaaacaagtaataatatgcttaacttttcagagcagaaagtcaaagtctgtctcctcagaaaagagttgtatttgtacttttagggtacagacatgggggcagcatgtgaataacaaggggatgacaataagacagctagctgtaggctgtttcccagtgatctcaatagccaaaggttttgtgagagatggaatgacagtcaattctaaagctaacagttatgtatatgtatactgttaacagcatttttaaatcaattcaattacaaactgaaaatatttgtccaaaagcaaactctaaggaattccccattcagtgaatggggaattcaagcaaggtttcccattcttaaatgatcataactaattttaaggggaaaagtaatcatatgagtttatgttcacaaaactctggagaatccctgtttgagaaatgctgcattaaaaataaaatactatcattttgaatgataacttgttactacacaatacataaagacaaacacaggccaggcgcggtggcacacgcctgtaatcccagcactttgggaggccgaggcaggtggattacctgaggtcaggagttcgagaccagcctgaccaacatgtagaaaccccatctctattaaaaatacaaaattaactgggcatggtggcaaatgcctgtaatcccagctacttgggaggctaaggcaggagaatcgcttgaacccgggaggcagaggttgtggtgagctgagattgtgccattgcactccagcctaggcaagaagagtgaaacaccttctaaaaaaaaatttaaaaaaagacaaatacaaaggccagcactgaaactgagtaatagccatattcagttctaaggggtcatctaagtgagccaaactatgctagtattaattttgaaaactgttactgaaatatgaacacaaaattaaagttcttttagaaacagagtgacccctgagaattcatctacatgttccagtctgagtaacattagctctatgaaaatttattaaaatagtattaataaatttctgttcttaacttggggtccatgagccaactaaaaacattcatagaattcagagaatctgtgaacttgaatgacaaaaatgttatacctttactttttgctatcctctaaaatgtagcaattgtatgaatagtacctgtgtctttgtcaccagtagaaatcatagctattatcctacacattacaattgttacagtatctcaaaaatatcactcatgcccattccttcttcaaaggtattatagtcatcagatccactgacagatcttgttatttaatgtgttaataaagaaacatatatatattactactatggcccaaatatgttcaatattttcataaatgtatttcgatataaaaagaaaaaaacaggctgggcacggtggctcaagcctgtaatcccagcactttgggaggccaaggtggatggatcatttgaggccaggagttcaagaccagcctggccaatatggtgaacccccgactctactaaaaatacaaaaaattagcctggcgtggtggcaggtgcctgtaatcccagctactcaggaggctgaggtaggagaagtgcttgaacccaggaggcagaggttgcagtgagcagagatgctggaatgcactgcattccagcctgggagacagagcgcaagcgacttgtctgaaataaataaacaaataaataaatatatatatggtttactttataattctatttgtacttatttaaaagtattattctgacaaatggttcttggcacaaaagaactgtattgccaggcacggtgtaatcctagcactttgagaggctgaggtgggtggattgcttgagctcaggtgttcaagatgagtctgggcaacctgtctctacaaaaaaaaaaaaaaaaaaaaaaaaaaaagccaggcatagtggtgcatgcttgtagtcccagctacttgagaggctgaggtgggaggatcgctagagcctgggaagtcaagactgcagtgagccgtgatcgcaccactgtagtccagcctgggtgacagagtgagaccctgtctcaaaaaaaaaaacaaaaaactgctatactagaaatgtcacagaattggcaattgtcttccttgcttagcttctaaatgcaaaaatgcaactacggacacaaaataggggtaaactaattttccctcataagctatttttcctgtttttttgtttttttaaatgagataaaattggtcacagaatgcattcaggaacagcttctttatcaaaaaaatgacatttatgattatataaacttgtctagtttaaatagtatgaatggtaaattatacctagtgttttaaaagaaaaataactattaaatgttattaagaaagttggtatggatatgcaaacagtacacatctaggcttttgatcagtttcatgtgtctttacttttgatggactcttctgagtttttaatattcaccttaagttatggaatccagaactggcataggacataggtgaaaaatgctaaatgtaataggagaatgtggatcatggttactttgatgtctcaggagtacgctgaatctttaattagactgcatacctttttaacagtaacacagcagcaggctttcagtgtgctgttacaaatcaaaaatgtaaggcaacttatgaggcagcaaagtatgatggcaagggctttggagtgggcaatgggaaatgtgtattccaggtttgccaatagcaacagatgtcactttcaacatgccaacaagtcccccaggatttcagttacctgaaaagggatgatctcgaatacttcaaaaattgccataatcctattaaaatggtacttttacattcaaaatgcttgtttatagcagagttccttactttgcataggtaatactcaaatccattagaaacgtatatctaattgtgtccatcgtagggactatgatatcttgaatcttgatttgtttatctcctaaattagtatttttaattaattcattccaatggacccagcgacctttgtttttcaactacaagaaaatataagttttaaaatattaaaaccatgtacttgctgtatctgaaaggctcttttcaacatgtatactattatattagcttttaaaaacttaagtcttcccccttttaatgaaatattacattcacataaaagaacacatatagcatattttaagtcataagcagattaataaaataagcattcatgaaaacaccaatttaaaaaatatattttttcaattttcatttttaataacctgaaaaatataatgtaacttttgttatcacatattcaacatatctaacatttcagatacttttgcctttatgtcttcttaacactccaatattccccaaatgccttcaagatgtccttttgcatacattgagtatttatttgaaagccactctaatgtacttcaagttacaatttcctgggttttggctttacttttttatattttaaaacaaatgggcaataatctaactaaaaataaaatatcacataaaaccactatatttgtttctctaacattattctctttggcattttgatccaggctgaaacaaccaggatatatatcagcatagctgtattaattgttatgatactgaaattcttctgaatcactggctaaataactgctgtcctgacacccctgagtgcctcccaatcttcactccacccccaaccattatcttcttctgcaggttgttttgacccctccctggagaaccccagcccttccactgttaagtaaaaaaagttttaatacctgccaaagtagccccctaagacccgattccagagctgtggctggaatctcacaatcttttcctattttccagcaaattgtacacgtatatgttacatgtttgaattgtggtaactttgtaagtttgggtgaatgtttctttagtaattcatatttgtatttttttaagttttagcttttatttttatcaacattatatatgtacatattttacagtcaaaagatttacaaggttaagaaaaacagcatttccctactgtcactttccctttcctagagaccttcaccttctctaagctggatagtttggtatttattttcgattcttaaagaatatgcttgtgggccgggcgcagtggctcacgcctgtaatcctagcactttgggaggctgaggtgggtggatcacgaggtcaggagactgagaccatcctggctaacacggtgaaaccccgtctctactaaaaatgcaaaaaatcagccaggcgtggtggcgggcacctgtagtcccagctactcgggaggctgaggcaggacaatggcttgaacccaggaggcggagcttgcagtgagccgagattgcgccaccgcactccagcctggacaatagagcaagactccgtctcaaaaaaaaaaaaaaaaaaaaaagaaagaaataaagaatatgcttgtgttaccacctcttttttcacttttagagattactttattgacttcccgctatggctaatgaggatgaaactctctttctggccagattcttaaaattctgtgttagcatggttttggggaaagggtcctgcactgtcagtcaggagaacttgagtcaagttctggctctgctagccattaatctttttaggtttacttccttatcataaaacttgagatttaagtgaaattataactaatgctctatctagatcttatgggggatgaaataaaatttgtatgaatcaaataattattcaaatacttgctgtttaaaaaatgctttggggaattatttaataaaatggaaaaataaatttaatttaaatgtgaaattataaaaatattattaaagcaaatttatttatacagccaataagttatgggaggtgaaactaaaagaagggagcttaaaaagctcaccgcaggagtcaaaataactctaggatgaaaacccaggagctttgtctgctggcctaagcctttgtgttttatcttaccataacaagctttttatgtcatacctcatacatgtagtcatagaccaggcctttttcatcaaatgggcattcccatttacccacagaatctggcactgggttttcatcatcttttcccagtatgattaatcgtatgaaagtatcaaaaacacgacggccatctgtatcacaacttcctccaatcgaccaaatcaaagagaatataaagcaagcctgttggtggagaaaaaatttaacttatagcaattattttaaaaggcattttaggagaaacattaaccaaaattcaatatattaggatatgctcaacttacttgaacaaggtcgtaagtgtaaataaagtagaatggagcactgctaagccacatagtcatttctctgacaatttttatcaaaatgtttgcatgtctttttttttttttttttttttgagacagcgcctctctctggttgcccaggctggagtacagtggcaccatctcaactcactgcaacctcaacctccccagttcaggtgattctggtgtctcagcctcccaagtagctgggactaccagggtacaccacaaagcctgactaattttttgtttttgctttttaagtagagacagggttttgctatgttacccaggctggtcttaaactcctagactcagcaatctacctgccacagcctcctagagtgctaggattacaggcataagctaccgtgcctggcccaatatctatcaaaaaaaatttttttttcttttttgagacagtctcactctctcacccaggctggagtacagtggtgcgatctcagctcactgcaacctctacttcccaggttcaagctattctcctgcctcagcctcccgagtagctgggactacaggcgcccaccaccacggggtttcaccatgttagccaggatggtctcgatctcctgaccccgtgatctgcccgcctcagcctcccaaagtgctgggattacaggtgtgagacaccgcgcccggcctctaacaaaattttaaatacccatactggctgggtacagtggttcacacctgtaatcccagagctttggaaggccaaggaagaaggattgcttgaggccaggaatttgagaccagcctgggcaacatagtaagaccccatctctacaaaatattttttaaaacaaaaataaataaataaaatgtccttaccaaataacctaggaatttctcttgtgggagtttatactcaaatatatttccacctgtgaaaatgacacatgtacaagaatattcactgcagcactatttgtaatagcaaaagatcaaaagcaacccaaattgttcttcagaaatggtctgcttaattggattctgctaatacactgaaatacatgcagctgttaaaaaacaaggtcactctataagcactaatatgaaaatgacatattacaatagagaaacgatgcaaatcagtagacaatgtatgctaatgtatttaaaaatgtatacatgtaaaagagtgtgtgcataaaatacttctagaattctatatagggcaccggcaatattagctgccttcagtgtggctgggggactgctatggaaaagtggggaaaacccacttttgccttttgaattttactctaggtacatgccttatcaagtccaaaagtaaatatatattcagagaaaaatttcacctagatatcaatctgtataactctcttgaagtgattctgaaccacttgaaaggtttaggttttaggtttaccaacagaataaaatgttcaggaaaaatgcaacttgaaggttatataggtaaactattcccatgatacttttataaacagtaacactgatagatatggaagaaagctaaaacttagttttgtaaaaggcggttccaaacctagggagaaaaaggaataaataaattatacttcaaacatgtctgttcaatatcttctaaagcggaaggatataaaggcgaaaaaggaggacaaaaggaagggatttggttagcaggaaaccctggaatgtgagatgtctgaggcagcagatactttgggcagcaaatggaaggaaaaacaatgggagggaactgctatgctgtgaggggagagggaggagatcaatgcatttaggaataaggtggtgcatgggaaaccagcatagaccaggaaaaagacactaaaaacctctttcctcaggctcttgataatctgtttacttgtgccattccctctggcctagctaaccaagactactgacttctccctacctgaggcctccatggattctgcctccaacactccacctagctggctggatgcctattcctggttttatttttttttgagatggagcaattctcctgcctcagcctcctgagtaactgggactacaggcgcctgccaccacgcctggctaatttttgtatttatagtagggatggggtttcaccatgttggccaggctggtctcgaactcctgacctcaaatgatctgcccaccttggcctcccaaagttttgggattacaggcatgagccacggcacccagcctactcctggtctttcatagctagcttttatgttgcctaaatgctggcttaacattaattaataaaattaattcacctaatgtccaaatttgtttaatattaaatcactttattgttgatcaaattataatctttcataataggatagttgaccgagcatggtggctcacaactgtaatcccagcactttgggagaccgaggtgggcgaatcacctgaggtcaggagttcaagaccagcctggccaacatggtgaaaccctgcctttactaaagataaaaaaaattagctcagtgtggcagtgcgcacctgtaatcccagctactcgggaggctggggcaggagaatcacttgaacccaggaggcagaggatgcagtgagctgagatcgcaccactgcactccagcctgggcaacagggcaagattccatctcaaaaaaaaaaaaaaaattggatagttgccaggcgcggtggctcacgccagtaatcccagcactttgggaggccgatgcgggtggatcacgaggtcaggagttcaagaccagcctggccaagatggtgaaactccgtctctactaaaaatacaaaaattagccaggtgtggtggcagtcacctgtaatctcagctactcgggaggctgagggaggagaatcacttaaacctgggggaggtggggggtggaggttgtattaagctgagatcacgtcactgcactccaacctgggtgacagagtgagactctgccctgtctccaaaaaaaaaaaaaaaaagatagttttggttccttgtgacattttaatttctttaaagtgttttttattatcagaataccaggtgttagggcaactttagtgtctccagctattctttcaatgctcaccaaaaaatagctttggatcttgtcatgtctttctcaatataaacatcatgtaccagaagcataatttatttataattaaaaactacatgaagtataaaaccaaccataatccaaacacgaatgtgcttgctagtaggatcattttctaccacattgcaaagtagcacttcaaagaggcgtgtgagagatacaaccacgttgctgttgcttgtaggaatcagttcctgcaaggtgaaaataagataactttcttaattttcatcttatttagaaaataagaaaaacactttatttttaaaaactgataaaagcatacatggttttaataaggtctttttttttgtttttgagatgggatctcactctgtcatccaggctggagcccagttgcacaatcatagctcactgcagcctccaactcctgggcttaagggatcctcctacctcagcctctcaagtagttaggactataggtgagcaccaccaggctatttttttttttcccagataggctctcactctgtcacgcaggctagagtgcagtagtgtgatcacagctcagtgcagcctcaaccttctggactcaggcagtcctcctgcctcagcctcccaaagtgctgggatgacaggcatgagccaccacaactagcctcataaggtctttataatatttaaacttaaaaactttaagtaggcatgataaaacatttctcaaatattttagtttcccatattatattacacaattatacataacaattgtacaatcgcacataatacattctaaattctctgacaaatgaaaactagctactgcaagagaataaacagtgttctaaggatagcagaaatgaagtctctaagagccattcatttatttattcaacaaacatttatgaaaaacatactatacctatgtggcaagctaggagatatggaaataaaagaatccctaaaaatggatgatattaaaattaaatagacaaaaataatatgatgtaataatgatatgacagagaaagtctcagggtaggaggcggctgctagagtgcttgggataaacaattggaggagtgcacaaggaggaaaacgggagagagatacaccaaagagggcttcctggaggaagtaataatagctgagctgaatttggaaggaaaatgtaagtttgccaggtgaacaagggaaggatattcaaggcaggggaatgtatacaaagaaatggagatgtgagcagacacagattattaaggggattctgtaggatatgaaaatagggtatgaaggagggatgcccaaaaattaggcttgagaaatacacaagagtcagatcctaaaaggtttttatatgctgtattaaggatttaattacaagaggaagagagttccaagggagggttttaaataaaggaataaacagaaaggatttgtgttttggaaacttcattctgtagcaggatacagactggaccagagcagctgcatggtattgattcaggtaggaagtgatgatggtcagaattgagatactataacgggaagggtggggcgaggaggtggctgcagaaacagggatggaaagaaaacaggtataaactttatcaagaagggaaaatcaatagatcctggggcctggaccaggtggctcatgcctgtaatcccagcactttgggaggccgaggtgggcagattgcttgaggccaagagttagagaccagcctggccaacatagcaaaacctcatctctacaaaaaaaaaaatatacaaaaattagccaggtgttgtggtgcacgcctgtaattgtgcctgtaatcccagctacctgggaggctgaggcacgagaatcacttgaacctgaaaggtggagtgccactgcactccagcctgggagataaagagagactgtctcagaaaaaaaaaaaaaaaaaaaatctggggactggatgagaaagaactatgagaagaaaatccattactcattatgtggaaaggtgaagcctattttgtattatttataatatatagcattagagttttaaaactataagggactttgtctattttctctatgaagacactatacagaatcttcataaagtggaattgctcatttttttcttttaaatggcacttttttctatgcctagaacattttaggataaaactgagtatctctttcccctctgtatatcaatatatttatttatatgtaagaagcgaatgtgtgtgtgtgtgtgtgtgtgtgtgtgtgtgtgtaggagatggtggaaatggttgaacaatggtccccaaaaagatatttccatgttctaacctgaggaacctataaatgtgatcttatatggaaaaaggtctcagaagaagcaattaagttaaaaatctcaggaggaagacatcattctggattatctagtgggtgctaaatccaagtccttgtaactgtcacatggaggagagacatgtggagtagaaggccatgtgaagattggccggatgcggttgctcatgcctgtaatcccagaactttgggaggccaaggtgggtggatcaactgaggtcaggagttcgagaccagcctggccaacatggagaaaccatgtctctactaaaaatacaaaaaaaattagctgggtgtggtggcatgtgcctgtaatcccagctactcgggaggctaaggcaggagaattgcttcaacgtgggagacagaggttgcggtgaaccaagatcgctccactgcgctccagcctgggtgacagagcaagacagagcaagactccatctcaaaaataaaataaaataaaaagaaggccatgtgaagatggaagaagttggagttatgtagccacaagccaaggaacacctgaggctaccagaatctggacaaggtaagaaaagagtctcccttagagcttccaaggaagtatagccctctacaaacatcctgattttggacttctggtctccagaactgtgagagaatcaatttctggtttttgggtgttttttggttttggggtttttttttttctgagacggagtcttgctctgtcgcccaggctggagtgcagtggcgtgatctcggctcactgcaacctccatctcctgggttccagtgattctcctgcctcagcctcccgagtagctgggattacaggcatgtaccaccatgcccggctaatttttatatctttagtagagacagggtttcaccatattggccagactagtctcaaactcctgacttcaagtgatccgcccacctcagcttcccacagtgtgctgggattataggagtgagccaccgtggctgtagctttagccatcaagtttgtggcaatttgttatgacagccctgggaagctaatacaatatgtaaagttttctcataaaatactaaatattgaataactcataaactcactaaatgtacattgagtttttagaggcacatatttaaaataatttgaaatacggaaagtaattagaatttttaaaattttagacactatggttgtatacaaatagtttagctggaataattcaacccctgagttatgcagctataacttaagcaatataaaaccaacggtggatagtaaatgcataaggacaaactggttttagttattcattctaccaaccactgtgactttagacttagtcaagttgaatggaaacaaagaaacttgaataggtcagagaattataggattaccttgcattttttcttacgctggtttaaagagggtggtattaaccaggcaaaaagtcctctcagaagagcttgatattctggttcacacagaggtcctttcagtgaattcaaccaagaagacacaagtggttcccatcctaactgtgaaggctccaaataaatcataccacaacgacttacagtggcaggctagagaaaaaaggcaactttttgcactgttgtttttataccagtggcacctggcaattatcaactatttcttaagatgacttatgagatcctttataatctagctcccatctgcttcacatagcttcacacagtctagacgttccccatacagaaaactatttgcagttcagttccccagatatgtaaaggctccatgtctttaaacattatctcgatctggaaacgcctaggatttccaaatccaatctccctggagaagtcttacatcttcctcaaaatcagatcaaacactcagttaccttccatggtgctcctctatccatcctcctcacagatgctcactcctctccacacattttttttttttttgagacggagtttcactcttgttgcccaggctggagtgcaatggtaccatctcggctcactgcaacctccacctcctgggttcaagcgattctcctgcctcagcctcccaagtagctgggattacaggcatgcaccaccatgcctggctaattgtgtatttttagtagagatggggtttctccatgttggtcaggctggtcttgaacttcccacctcaggtgatctgcccgcctcagcctcccaaagtgctggaattacaggcgtgagccaccgtgcccagccatcctcttcacactcttaaagcactaacatgtagctgtgtaatgggattattaacatgcttctcatcctccctaaacaagcatacactgtgtcttattcatctttatattcctagtgcctaacccattttctgacatataataaaaaatacttattggctaaattaaagaatgaagaaatgaacaaaccaccattgtattaaattatgaacttacggatgcctgggaaaggtccattgtttcaaagatgaggctcatttggggggacatctgaatgatttctccactcataaggcaaagctaaaagcaattatttttcaaatgtttattttttaaaatttcaagtttctcagataaaaatttatactatgtataaaataaagtagctcctgtgatataatggaataagaattagaatggaagccagaaaatcttaattctaggtctagccctgttaattattaagtatttaagcaaatacttaacatctccgagtctcagtctcttcatctataaaacagggataatagtgctcttgtagaattgtaggaagggggactataagacaaagtccaaaacctataaaatcctatacaaatatcggctattaagaaaattaagtgaaatactcctgaatttataaagtgaccatagacctttttattaaattaaaaaatagaaaatagagaatagcatgcgtactcttatacccagctcatagatttaatcaatgttaagattttgccatattgccattacctttttaaaaaaacagtttaaagagcattatagacatcacatcatggcatttcacattcaaatgcctatgtttccaaaaaataagtatattttctatgtaatcacaataacattatcacacctaacaaaatgaataattctttattatcatctaatactcagtcaatactcaaatttcctcagttgtaccagaaatgtcttttcaatggatttatttaaagcaaaattcaatcaaagactatgcattgagttttttatgtctccttggtctcttaatctaaaacatttcttcttttatcaaatatgtcaaaaactgaatttatcaactgcttcctttccctcaaatttctgtcttgtctattattaaagccatcctatctcctcaatctctttggcttgcagctatggaattatcattaacttttaatagtattattattattaacttgatacctaaattaattttattactaagtcttttaaattcttgtacatttagttttcagtgtttcctttctgcttttacaatcatcactttagttccagtttttcccctatctagtcacatgtcaacaatgagaaatttaacatttgtggattccgtttcttagctgtaaaatgaatgatctagaggtggattgtccaatacggtagctgctagccatatgtggctatttatatttaattttagctaactaaaactaaataaaatttaaaattcagttcttcaactgcactaatccacacttcaaatgctcagtagccacatgtgactagtagctaccttctcagagaacacagatagttgcagtattgtaaaaagttctactggacatgctggtctagaatacttttaatctttgaccagattatttcagcaaacatcctcctaactctgcacaaatttgaaaggtagggtcagcattctcctcactgccctgtgttgtttcccaactacttctattccacccccagtgacaacccctgttttttccctgccactcaacagtactcagtgattccctcctcaatagctaaagtccttgggacatggcctaatctcactctctactataactctggcctgatccagtgtttataaagactgagaatctcaacacagctgcccatcagatccttgaccaccttgctccactccagctgtccactttatgtatctgggaccttctctccagaaataatacacaattctgaaatattaaattcatgtatctcagtctctgcccacagcctccaatccatccagttatttcattcattgtctcctactacacttgctcctcattttcccaatattttcacatccctgatgttttcacttctttcattaggcagcttttgtcctatggtctaatgcttctaccattctcatgtcaataactttgaagtcttactatatttccaggcctacaatattacctatgcctaagctgcttagactggtagagagtacctcacaaaggcagaccttggtactactaatgataatttatggtcttccactcaatcaggctctcagtgctacccagaagtgcttctatgttttcctaggtagctctctttcccatcttccacaaaggctaatttaagtctcttcttttatcctcaattttgcaaagaaccaaggcccatcacttcacgaagaaaagagaaatcatcacaaggatttgccttcaaatttccacagtcaaatccatacactcacctatagctgtcttttcataattccctctcatgcagtaagagacaatccatctgcttggctctgaacccttagacttcactctacaattagaataaccttcctgcttcttctctatttactttctaccctaagctcaaccaatattactgaatgcatgaaagaaggaatgtgaatgactaaccacctatgataaagtacttcagtatatctttttttttttttttttctgagatggagtcttgccctgtcgcccaggttagagtgcagtggtgtgatctcggttaactgcaacctctgcctcctgggttcaagtgattctcctgcctcagcctcctgagtagctgggattacaggcgcgcgccaccacacccagctaattttttttttttttttgtattttagtagagacagggtttcaccatgttgctcaggctggtctcgaactcctgacctcaaatgatccacctgccttagcctcccaaagtgctgggataacaggcgtgagccaccgcgcccggccttgagtgtatctttaaatgctaattaaatgagtttgtttatttagtagggcagtcatttcatgtaagtatggaaataatctgtgatatattcacacactaggatactaatatagacataaataagttaacaaaactgaactacagtaatatgaacatcacacatatattgatttaaaaaaaacactgaagaatatgattccaatgtattaagttcaagagctggcaaaactaattcatcatagaagtcagaagagtgattatctctggaggaagataaacaaactaggaaggaacatgagtgaaccttgtagggtataggaaatttcatgtgtcattttttaggtgatgattatgtgagtatacaaacacattttaaaaatcatagaatctacacttgaaattggtatacattttataccttatatatgttgtctctcaattaaaataaatattagaatactttcactttctagttcttttgtatatctcatagcgccgaaggtgatatactgtatataaacgctgaagcattccatgttttcaaaaggaattaggcttttgttattttatcctaaaatactgaagttctataagaaaccataagactgaagtcacttaacaacttattctcaccctagattactatgtcttctggctaacacagtaattttaatacaatatactttcattctacaaaaaaaaaaaaaaattaacccaaggacttactatagcagttttcattgaaaagagaatttataaacctactcaacttgctgcatcctttatttttgcatcctttattttaaatagagtcctagtttagttgctgaacacataaaattgcttaatcatggctgaatctgcttctcttttgatcatgatttacctttttattatcatccaatactgtgttcatgctctctatccacaaagtgtcaataggaccatcaaatacaacccatttccggtcaggtgtttctgataaggcaaattctctaaaagtgttagccacaataccatcagtccactgaggaggaaaaaaaagaattaaaaagctctcctcataaaattagatttaggagtaaaactatgaaaatacttcacgtttcttgttttaacaggcactttccataagagagttgggaatacttatatttaggttacctcatgagacactgggtcaaactgtccaaaaagttggcccatagtaatagatttggggtttacagttctataaatgaccttttcttcctctccatagccatgttcattcattaaagttagcgtatccgccagcacatgcagaacttttgtcttagcagcaaaaggctctcctactaacataaaactatgaaggaaaagaaataattatacaataagagtctttaaagagttaaataatttatatcagtatataaaactttaccctgtgataattactacttataatttttgaaatcatatgaatttttctcagacatgaagaaaacatatttaatttctgaactgattgactacaaatcaaattcttcactgtaatattattttctccaaaagggaatataataaacaatctccaaatgacaatgaaaacttattatctgtgtactcttaaaaaaactaaacctgaagcccactaaggagagaactgggaaagatttatattcccaaagtcttcacttgccataaaactattagtgttctttaccaactatttctggatctcctccctcctggcacatataggatttctggccctcttgtggaaagactaggtaactagttctaaccaacgggtaataaatggaaatgatgggcattacttccaagcagggataggtaattgccagctagagacctcacagagctcccttttccctctagcatggccgtgacccacaacgttgaggtggtgcttactctaacagcctgggccctgagtggtcatgacgagcagggctgccctggtaacctactatatataaatgagaaataaatctttgttttttaaatcactaacatttgggtgttgacagttcttacagaatatcctagcccatccttaataacagaagttggtacctagaagagggggggatattcttgccataataataataataaaaaaaacctaatgtggcattggcttaaaggccagattgtgagtgacaaattaactggtatcagaagctaaaatatggacaattattgtcatgcaatgaatgatgaaacatttggtaaatgtattccttgagattacctggaagacagctaattacctaaggaaatgagaattttaggtgaaaaggatagtaaacagaatgttattagtatataatgacaggtactggtttcacttaaaaaagaaccataacaaagaaatgagcccagaaaaaaacatggtcagtttgcaagcaggaatgaaagagggagtccagaaattcagggacttctggaattgaatgtatcaagttattctcattcgcaactggtaaaagataaaattaagaaaacctttaaacaaaaatctattaaaactcagtttggcatcaagtatcaaatcaagggtagggtcattgtatcacattattaaaacctatgaaggattaatatgggccgggtggctcatgcctgtaatcccagcactttgggaggccaaggtgggcagatcacttgaggtcaggagttcaagaccagcttggccaacatggcaaaaccctgtctttactaaaaataccaaaattagctgggcgtgatggcatgtccctgtagtcccagctactcaggaggctgaggcatgagaatcacttgaacccaggaggtggaggttgcagtgagccaagatcttgccactgcattccagcctgggtgatagaccaagactctgtctcccaaaaaaaaaaaaaaaaaaagaatataattcccagtaatcatttcaggagaataaaatgattcatgaaaaacagactaagattgtggctccctccacaaagcctgataaggtcaaggatacttccaggaaattttaaaaggtatggcttattaaggacagtagttacggatataggaacatggagctgtctagaatcaaatagataaaaagctgattgtttttgagggagtttactgaccaaaaaaactgtgagtctagtctaaaacataagtgaatgttcaagacttaaataatccttgggaactaggtgtggtggtgcgcacctgtagtcccagctactcaggaagctcaggagggaggatcacttgagccctggagtttgagaccagcctgggcgatatcaacagactacatctcaaaaatacataataaataatatttaaaataatccttgggtattgaatgcataagggttgattgtactattccctctatttttgtatgtttaaaaatttacataatgtttttgtaaccctacctttagaaaaaatcgtgaccattgagatcccaactttctataggcaagaagcaggctcaaaacatttctcaactctcccaagaacagtattttctctattgcccacttcatatgtgcccagagaagaaaatggaaatggaaagacctctcagaaggttaaactaaggcccaagaagaagaattaaactggaaagcccctctcaggtagcaaaaaccaagcagaagtagattcaggttttaagaaaggtggctctctaagtaaatataaatatatatacacacacacataacttacttatataacatatatataacttttacttatataactataaatacaaaatgtccatagccactttaatgacaccctgtataataaatcacatatacaaaatgcttatggctccttagatgaggcccttcaagtgagaggtcctgaagtttaaactctattagtttcacaatcaatccatctctagaactggggccctcacatgaccagctggatttcagaattgtcacattacagtgttggctgtgtcttctattcttcagtttctgaatgggagtgtttgctctggtaaccctgttctgataagcccactattgtgcactgggtttgtggagaaaagataacttgtctttctaggttgtaggtctctggatcaagaggaacaacttccaggtatgatacaaaggctaccatgcatcgtcacctagggatcctgaactttgagtctggttcatttattgattagaacttttaggtgcctccctgggaagggaagagtgtgtttttatgcaaatggtggtatttattagtactaggtcactgaatgagcacttcttaccaacccttgttggacatgtagtatgagaaataaacctttgccttttaagccactggggggccagggggcgggcgggggttgctctcaactcacctaatcagtttgccaagtctttggttcatggattttagttgttttaccagcttaattaagaaataacatctaactatagcaatatataatcttacccatgtctaacaatcatcatttcatatgtttgaattattttttcaagaaaaaatttaacaggctgaagattatgtacattgcaggcttcatgagcacattccaaaaattcctgaaataaaaaaaagtaatgcatttctacaacacaatattataaatgtcatacctgtcttataagtgtagattttaaatttactagttaaaaaaaaactatcatcattgtttattatttcttaaaactttattattttttcaaatcaagaggagaaacatagactcaaaatacttttaatgtattagtcttccctattgtaagttatgaatgatcatagcatgatagtactgggtgtatgctgcatgaaaataactccttttaatagtgtttcccagaatttcacttttggttaggaaatagaaagacctgtcagacaatcctgcacacttgtagtaaccagaaataaacaaataagttttttaaaattataaaaaatttaaacacatagaagtactttggatgcaaataaatatataaaagaactcagtttcagaaagggatgatgagcctttcctaggtaagcacaaagcaacagctgttttcaccctagggacattttctaagtctggacttggtggatatcggattgggcctgctatagacagaaggacttagccaaagtaggaagaaaccaatagagattttaatggttgtgtgggcttatgtgacagatttgaatttggagaagcccaaatgccaagctggttctcccgaacatccatgcttttgctcagcatgtagtgacacaagagaccaagggcttggctggaaagacacacagagagatttctttagtctcagaatgcttagatcccaaaatcctactacagggaagggccaatcatatggcaggacaattcttactcagaagacatttgaagccagaagtaaactacagctcagtaatgctgcaacaaaactctgacttaggtcaacactcaactgaattgattagcaatgcaacctagctacctgaaatagggaaaaatctcatgatttttctgcaggaaaataataccacctggccaggtgcggtggctcatgcctgtaatcccagcactttgggaggccaaggcgggtggatcacctgaaatcaggagttcaagaccagcccgcccaacatggcaaaatcctatctctactaaacatacaaaaaaatcagccaggcgtggtggcgggcacctgtaatcccagttactcgggaggctgaggcaggagaatcgcttgaacccgggaggtggagcttgcagtgagccaagattgcaccactgcactccagcctgggcaacaagagcgaaacttcgtctcaacaacaaaaaacaaacaaacaaaaacaaaacaaaacaaaacaaaacatcttagcctgtataattattttatacacattgtttaacatacaatcaaaacttaaggttggacgtcctagccagaacaatcaggcaagagaaagaaataaaaggcatccaaatagaaaaagaagaagtcaaactgtcttctctgacaatatgatgctacacctagaaaaccctaaagactctgccaaaaggctcctgaaactgataaatgactatggtaaagtttcaggaacaaaatcaatgtacaaaaatcagtagcatttccacacaccaataacattcaagctgaaagttatatcaagaatgcaatccggccgggcgcggtggcccacgtctgtaatctcagcactttgggaggccgaggtgggtggatcatttgaggtcagaggttcaagaccagcctggccaacatggtgaaaccccatctctactaaaaatacaaaactatctgggcagtagtggcacgcacctgtaatcccagctacttgggaggctgcagtaagcagagattgtgccactgcactccagtctgggcaacagagtgaaactctgtctcagacaaaaaaaaaaaaaaggaaagcaactccatttacaatagacatacacacacacatacacacacacagtaggaatatatctaaccaaagagataaagatctctacaaggagaactacaaaacactgctgaaagaaatcatagatgacacaaatggaaaaacatcccatgctcatggattggaagaatgaatattgttaaaatggccatgctgctcaatgcaatctacggattcaatgctactcctatcaagctaccaagattacttttcacagaactagaaaaaaattattctaaaattcagatggaaccaaaaaggagcctgaatagccaaagcaatcctaagcaaaaagaacaaagccagaggaatcacattacccaacttcaaactataagattacagtaaccaaaactgtatggtactggtacaaaaatagtgacacagaccaatagaatgactagaaacccaaaaataaagctgcacacctacagccacctgatcttcaacaaagtggacaaaagcgatggagaaaagacttcctattcaatccatagtgctaggatggcttgttagccatatatagaagaattattggacccctacctttcaccatatacaaaaattaactcaatatggactgaaaagttaagatctcaaactgtaagaatcctagaagaaaacctaggaatcaccattctggacactggccttgggaaggaatttatgactaagtcctcaaaagcaatcgctacaaaaacaaaaactgacaagtgggacctatttaaactacagagcttctgcatggcaaaagaaactatcaacagaaaaaacaacaacctacagaatgggagaaaatattcacaaattatgcatccagcaaaggtctaatatccagaattgataaggaacttaaacaattgaacaggaaaaaaaaacatttaaaaatgggcaaaggatacgaacagatgcttctcaaaagacatgcaagcagccaacaaatatatgaaaaaatgttcaacatcactaatcgtcagagaaatgcaaatcaaaaatacaatgagataccatctcatacaagtcagaatggctattactaaaaagttaagaacaacagatgctggcaagcctgcagagaaaagggaatactcatatgctgttggtaggaatgcaaattagttcagtcaccgtggaaagcagtttagagatttctcaaaaaacttaaaacagaactaccatttgacccagcaatcccattactgggtatatatccaaaagaaaataaattgttctaccaaagagacacatgcatgcattatgtttaccacagcactattcacaatagcaaagacatggaatcaacctaggtgcccatcaacagtagattgaataaagcaaatgtacatatataccatggaatactatgcagccataaaaaagaacaaaatcatgtcctttgcagcaacatggatatagctggaggccactctcctaagcaaattcacacaggaacaggaaaccaaatactgcatgttctcacttgtaagtggtaggcaaacactgggtactcatgaacataataatggcaacaacagacactggggactactaaggggaagagagagggaggggaacaagggctgaaaaactaactattgggtactatgctcagtacctgggtgatggtatcaataatacctcaaacttcagcatcatgattatgcccatgaaacaaacctgcacatgtaccccttgaatctaaaagttgaaattcctttaaaaataagtaaataggccaggagtggtggctcatgcctgtaatcccagcactttgggaggccaaggtgagtggatgggttgagcccgggagttcaagaccagcctgagcaacataacaagacctcctctctactaaaaatacaaaaaaattagccaggtgtggtggtacattcctgtagtcccagctactcagaaggctgatgtaggaggattgcttgagcccaggagttggaggctgcagtgagccatgattgcactgctgtactccagcctgggtaacagagcaagaccctaactctaaatagtcacttcataacagaaccaaaaaaataatgaagtcatgagaaatagctgatgaccaagagaaaaaacagtaaacaaaacaaactcatagatgacccagatgtcataattaacagataagaacttgacaatacatttacaaagtataaaaagaatagattataagatagaaaaaatagaggaaaaaatatagaattttagcagaaaagagaactctctaaaaagaaccaattggacacactagaactaaaaagatcaaaatatgtgaaattaagaattcattgaatgggcttatcagcaaactggacaaagccaaagaaagaaccactaaccttgaagataggtcaattagaaagtatccaaactacagagagaaagtaatgaaaaacaaaagagaaaaaaagaggcatgagagacacatgaaactatatagaatggtctaatatacatgtcactgaagttccggaaggagagaggagaaaaaattaaggcataaaaacatataaaaagataattactgaatattttctggctgagtacagtggttcatgcctgtaatcacagctctttaggaggctgcttgagcccagagcttgataccaacctgagcaacaaagtaaaaccttgtctctatgaaaaataaaataattagttgggtgtggtggcacgcgcccataatcccagctacttgggaggctgagatgggaggattgcttgagcccaggaggttgacaatgcagtgagctatgatcatgccactgcactccagcctcggcaaaagtgagaccctgtctctaaaaaaagaaaagaaaaagtaaattttctggcaaaacacatcaacacacagattcaagcagcatagcaaatcccaggcaataaagtacaaaacaaaactaggcacatagtcaaactgctcaaaaccaaaaaagaaaaagaaaaaatattaaaacagccagaggagtataaataagaaaaatgcctgacttctaagcacaacactgaaaggcagcagtctatgaaataacatctttaaatgctgggcgcagggtggggtggggaggagacaccttgccaatctagaattctgtatctgtgaaaatattcttcagaaataaagattaaataaagacattttcagacagacaaaaggtgagggaatttgttgccagaagacccatatacacacaaatactaaaggaagttttttaggttaaaaataaaaaatccaaaatgaaaacatatatctgctggaaagaataaaagcactagaaagggtagcgtaagaggcttttttttttcaaatacaatacttaaagcagaaaataataacaatgcattgtggtgtttacaaaatatatagaagtaaaatatatgacaacaatagcacaatgggcaggagtgagtggataatgaaactataccatttaaggtgcttatattttttgtcaactggtaaaatactaactgtaaagttgtaataagccaaggatatatactgcaacctgtggagtgaccactaaggtaaagctataaagccaatagagaagataaaatggagtgataaacattttttgaaatccaaaagaagtcagtaaaacaaatacagaacccattaaaaagcaagatggcaatttagtactatttttccaactggaatctacggatttattgcagtattcataagagtacataagagttcttcaagaaaatattaaaattttgtgttttcattttggtgtttaaaaatcatattagcatattctgaatcatcttgatagtcaccttaacctgccataaaatgcatattagtatttgagcataagaatttaaaaaacagacaaaaaaataaagatgcctttaagttaagtgatctcttaatgatttgacagctcaaacaaaaagattttgcagtcatatcgtaaagagaagacatggaagaattgaatcatcacttggcaaaaggtggtttatgaacgctgaactcaagagaatcttcactgtacatttcacaatagaaattcccataaagtaacaagttactttcagccacatattacctatttcattaattgcgttaaattgaatttgagattgttttgtttgtaatgttattttatttattatttttattttaagatggagtcttgctctgtcgcacaggctggagtgcaatggcgcaatctcggctcactgcaacctccgcctcccgggttcaagcaattctcctgtctcagccttccaagaagctgggactacaggcgtgcaccaccatgccccgctaatttttgtatttttagcagagacagggtttcaccatgttggccaggctggtctcaaactcctgatcccaggtgatccacctgcctcggcctcccaaagtgctgggattataggtgtgagccaccatgcctggcttgtaattaattttaaactatattctggttttctataacggctataagcagcagttaagtatatacatatttaagcttcattataatatgtataatctacatgaagttggaaatgcgagtggtttgtgtcttatttttgttattttaaatttttaattgacaaatatttttatatatttaaggtgcaacatgatgatttgataaacatatacattatataatgattaccacaatctaattaacatatccatcactacccgtagttaccgtgtgcatctgtgttaaggactgtttcctttaaaaaaaaataaaaatgagtctattaagtaaatttgagaaacaaagccttattatgttacctataggatgttttactactttcatttctatctaataaaatacacaatagtatttagtatgcaatactatatattacacaatagtgtaatacactattacagtatgtatactaatattgtaaatcacaagatagaaaataaaatattttttctcagccaggcacagtggctcacacctgtgatcccagcactttgggaggccaagtctggcagatcacctgaggctgggagttcaagaccagcctgcccaacatggagaaaccccatctctactaaaaatacaattagctgggcatggtggcgcttgcctgtaatcccagctacttgggaggctgaggcaggagaacaggttgaacctgggaggcagagcttgcagtgggctgcgattgcaccattgcactccagcctgggcaacaagagcaaaactctgtctcaaaaaataataattattataataaaataaaataataataatacttattctcttacaaagaacattactttttttaatttttattttttttgagacagagtcttgctctgtggaccaggctggagtgcagtggtgggacaccaccatgcctggctaattttttgtatttttagtggagacagggtttcaccatattggccaggttggtctcaaactcctgacctcaggtgatccacccatctcagcctcccagagtccaggattacaggtgtgaaacaccgtgcctggcctgtttaacctgaatcttgacaggttaaccctggtatcatataatatgaaagtacccaaatttacttattgttattaactaaagtggacaaaataggggattttcctcaaaacagaataatttcacacattaataaatcttggtaaacaattgagtcatcggatgaatttattatgccgaataagtcattctcatgggtttacttacgtgatagtcagcttcaggaagtttaataccaggaaataagtcactagttattccattaaataaaggtatatcatgtgataaaaactttggttcatttacatctttaattgatcgaagaagctaaaattacccaaaaagtacaatgttaagttagttgccagcaattgcaaccccacttctccctcccctcccagccccggcctgccccaccccacccccctggctaaaagtcaaagtttattttacattgctctctggaatccctataataaaaagtcaatactatgcttatcaaactaaaaagtctttgtattcatatgaagtataacaacataacccaaaaaaccatcatttcaacctcttatgaaaagacaaagctcaaccctctcaagtgcctatttgtagttcctgattaacctcactaaagaaaattatctttctactgaaactttcccaatgtgtatatttaatacttacaagtatatcttcattttcatttgggtattttagttttagattgccagcagccactaaaacggcttttactgctcgcattccatagtcgtaatgaaattgcgatgagagctgctctgagcaaagcctataggtcattactattttcacagacagaggtcttgcattcaaaaatccgtaagagtagagggagatttctgctataagcgcatagtttggaaccatcatagccactgttctaaaaagaacctgaagtataaaataaatgaaatatattacgtacataaatgaagctgtttttaagctgagcataagtattcaaaggtgtggtgttgtcaagtttattctccaaatgcagcacctttttctaaactctaattttttttagtagtacttttaatatttttatgcagttagtatttttttggatgtttaaaaaagttttgggagggaaattacaattttatggaaaaaaatcattttgaatggattatgctgggtttttttaattcacgaacttacactcaaaaaatattggctgggtacagtggctcatgcctgtaatcccagcactttgggaggctgaggcgggcgaatcatgaggtcaggagatcaagaccatcctggctaacatggtaaaaccccgtctttactaaaaatacaaaaaattagccaggtgtagtggtgtgtgcctctagtcccagctactcgggagactgaggcaagagaatcgcttgaacccgggaggtggaggttgcagtgagccaagatcgcgccactgcactccagcctgggcaatagagtaagactgtttcaaaaacataaaataaataaataaataaataaataaataatattaccttaagattgtccggcaattcagagcgtcctgcatagccaggattcatggtaatagctacaaaacaattcggattgagcttaagttctgtcccttcaaaaacaaacacaaccaacttctgttgaatagctctctgaatgcaaaggatctgttgagctaccactgacaacacttccaactcaattcgattgaattcatcaaagcaagcccaagcaccagaagaagccagtcctttaaaaaactaaggacaaagaaaaaggaaagtgatttttttctcaggaaaggatatcatctcttaaaacaaatacctaatattttaagtcagaattgaaagttaaatttagtaaaagttccaaggataaaaacaatgtctttactcctaaaatgaaagtccaagtaatattcaaaccacattcatgtttaaacatgagtttgcttccatttatccaattagacctagctgtaagtttgaaacatttaatattattgattcagcaatttaactacctttcccattgctagataatctagcccatcagaacagttgaacaccacacactgtacagcaagagctttagccaagtccttggtggtttcggtttttcctgtgcctgctggcccctctggagcacctccaaggtttaaatagaaagcacctatctgaaatgaaaaacacatgtgaaaagaaatccatgcttaaatttaaaaaaacaacagacacttgtttaccaaatggatttagcctgttctgtagcttcagagaagccattatataattacattgtttaatttttagcccaaatttttctagctgcatgaagagaaagcattttaaaacgttcaaaaaagtgacaatgtatcaaaacttgtcttctgacactttcataggtatcccatttgtttttaaaaacaatctagccttatgggggtaaaattagttcaggaaggttttaattagaagtggttgtggagatggttgtggaggacaataatgacacattctagatggctcactgcaaagggggtaaaacaccagaaagtgagagctataaatggcacccatgattgggaaaagaaacagatgacctattatataattttgtctacgatttgcctggctattgccttttactcttggtatgttctccattttctacattcccataaaactgctctatgcttctcttaccggtagtatcactttctaccttgtattatacttaattacgtacattcttttttctcatcaattagtctttaaagtgcttaatgacaatatcagcagtatttgaattattcctgggtccccacaatgactggaatagtggctggaaatttttagaaacataaattacagtcagctctaactatggagtctgtttcacgggagtttcaaatttaacttcttttagaaaaagtacggctaagtgaccaaggctgtgcatgtaaggggggtagggggaataagtgaactctgcagtttgctcttaattttgctatgaacctagaactgctcaaaaaaaggtctacctttaaaaataagtaaaccacaaagtgataaatatttttactttatttttactttattttaaaaatccaagagagacagctagtgtaaaaaatgcagtatcagtgatagttcatccattttattttattttttgagaccgggtcttgctctattacccaggctggagcacagtggtgagatcttgactaggtgcccctctgcctcctgggctcaagcaaccctcccacctcagcctcccgagtagcgaggactataggtgtatgccaccacactcagtttattttttgtatttttagtagagaagaggtctcactgtgttgcccaagctggtctcaaactcctgagctcaagccatcctcctgccttagtctcccaaagtcctgggattataggcatgagctaccacacctggccaacctattttaaatttataatggatgccatattgttaatgcccattaacttgattgctgaaaacctcgggctcttccttttcaattttaagaaaatgttcacaaacatgttccctttattgtgaataataaatatactagtgtgtctggaattggtgggtgcttggtctcactgacttcaagaatgaagccgcggaccctcgaggtgagtcttacagctcttaaggtggcgcatccagagtttgttccttctgatggtcggatgtgttgggagtttcttccttctggtgggttcgtggtctcgctggctcaggagtgaagctgcagaccttcacagtgagtgttacagctcttaaggcagcacgtctggacttgttcattcctcctggtgggctcgtgctctcactggcttcaggagagaagctgcagaccttcgccctgagtgttaaagctcttaatgcagcacgtctggagttgttcgttcctcccaggggggctcgtggtctcgctggcttcaggagtgaagctgtaggtcttcgcagtgagtgtgacagctcagtggacccagagtgagcagtagcaagatttattgcaaaaagcaaaagaacaaagcttccacagcgtggaatagaacccgaccatgttgccaatgctggctcaggcagcctgcttttattctcttatctggccccacccacatcctgctgattggtagagcgagtggcctgttttaacagggtgctgattggtgcatttacaatccctgagctagatacaaagctctccacgtccccatcagattagttagatacagagtatggacacaaaggttctccaaagccccaccagagtagctagatacagagtgttgattggtgcactcacaaaccttgagctaaacacagggtgctgattggtgtgtttacaaaccttgagctagatacagagtgccgattggtgtatttacaaccctgagctagacataaaggttctccaaggccccaccagagcagctagatacagagtgttgattggtgcactcacaaaccttgagctaaacacagggtgctgattggtgtgtttacaaaccttgagctagatacagagtgccgattggtgtatttacaaccctgagctagacataaaggttctccaaggccccaccagagcagctagatacagagtgttgattggtgcactcacaaaccttgagctaaacacagggtgctgattggtgtatttacaatccctgagctagacataaagactctccatgtccccaccagactcagaagcccggctggcttcacctagtggatcccacacccgggctgcaggtggagctgcctgccagtcccacgctgtgcgctcgcactcctcagcccttgggtggtcgatgggactgggcgccatggagcagggggtggtgctcctcagggaggctccggccgcacaggagcccatggagtgggtgggaggctcaggcatggcgggctgcaggtcccgagccatgcccggcgggaaggcagctaaggcccggtgagaaatcgagcgcagcgctggtgggctggcactgctgggggacccagtacaccctccacagccactagcccaggtgctaagtccctcattgcccggggccggcagggctggccggctgctcagagtgcggggcccgccaagcccacgcccacctgtaactccagctggcccgcaagcgccgcacgcagccttggttcccgctcgcgcctctccctccacacctccctgcaagctgagggagtgggctccagccttggccagcccagaaaggggctcccacagtgcagcggcgggccgaagggctcctcaagtgccgccaaagtgggaacccaggcagaggaggcgccgagagcaagcgagggctctgaggactgccatcacgctgtcatctctcactaggagactttttctcagtgtctagtgttatattcaagcgtttaatatgatcccgggtgggcacagtggctcacacccgtaatcccaacactttgggaggcataggcaggtggatcacttgaggtcaggagttcaagaccagcctggccaacatggtgaaaccctgtctctacgaaaaatacaaaaatcagccaggtacagtggcacatgcctgtaatcccagctatttgggaggctgaggcaggagaatcacttgaacctgggaggcggaggttgtagtgagccaagatcgcaccactgcactccagcctgggtgacagagtgagactgtctcaatttaaaaaaaaaaaaaggtggcccagtgaggtggctcatgcctgtaatcccagcactttgggaggctgaggtgggcagatcacctgaggtagggagtttgagaccagcctacataacatggagaaaccctgtctctaccaaaaacacaaaattagttgggcgtggtggcacatgcctgtaatcccagctacttgggaggctgaggcaggagaatcgcttgaagcagggaggcggaggttgtggtaagccgagatcgcaccattgcactctagcctgggcaacaagagcgaaactccatctcaaaaagtgttgaatatgattctgatttttacaactcaaagttgttagcccccaccttacaagcacaccacagcttctgacttcacagaggtaacagatatgacatcctattttgaaattcatctgctcaacaaatatttagggataactgtgtccttgttcagcactagagtagagaacaagacagacatagttcttgcccacaggcagctacccgagaaaataaagggtttggtgaaatcttttctcccagatccattgttgccctacccagagcccctttacccagccattgcattcatcccccatttgctgtgtcagttgcaaatagttcacagctgctcttttctccttatcagcaagaaaatgcctgaaagcttactcatatccctgccccaggggtgacccttagtcaatgacattaaacgggtacaaaagtcagaccctgctgctttgaagtggaataattcgtgccattcatgcttcagagtgccctgtgagagcaggctacaactgtacatctgttgaaaccacatctttgcttaactttttactgtcccatcctgctgtccttatttccctacaggtttttactaagaacattacctaataaatcctttgcacaagaattgccacttcatttctgctttaagataactcattcgaagacactttaatttcacttactcagcacaggtagagtggtacttcttgatgctccttctcaattcccgtaggaagggttgccagatttagcaaataaaaatacagaatgcccagttaaattttatttcagataacggccgggcccagtggctcacgtctgcaatcccagcactttggaaggctgaggcaggcagatggcttgagcccaggagttcaagaccagcttgggcaagcaacgtggctgaaaccccatctctactaaaaaaatacaaaaattagctgggtgtgttggcatctgcctgtagtcccagctacttaggaggctgaggtaggaggatctccttgagcccaggtggcagaggttgcagtgagccatgatggcgccactgcattccagcctgggcggcagagcgagattctgtctcagaacaaaacaaaacaaacaaaaaattctgttacagtgggtagctagtcaggtatgagcagagccggagagcgcgcctcaccccacacacaccaggagtgtccggtgaccatcaggtgatggtcaggtgttgttaactgtctctctaaagtaataattggtcacagctggtaccagggatgggcgtgctcctaacaaacagaaaacacctgaaactggtgatcagctgtttccccataagatctcaggagttgggtgagtggggagaagtaatgcaagacccaggaagtatgtcaatgtataaaagtcaaaaggtcaagctgcgtacttgatctctcaagtcactcacttgggcctccttgaagtgtgctttaccccctttcgttcctgctccaacacttaatgaactttcgctcctgctctaaaccctgcctcagtctctttctgccttatgcccctcagttgaattctttcttctgaggaggtaagaattgaggtcgctgcagtctggtaccgatacagatatgctccactggtaacatattttggtgccatgtgacttgggtaatttccactgctaccattcagataaacaatgaataatttattagtgtaagtatgtcccatgcaatatttgggacatatttacttacattaaaaaattatttgttgtttgtctgaaattcaaatttacctgggaatcctgtattttatccggcaaccacattcccagggtttttatagttgaacagctctatcctccatagcttcagctctggatctcaggtctcagcaccacccccatacatttcatctctccatcctacttaacagcactaatttggtgtcctaaggcccaaatgtacttttctcatcttcctgtcatctctcccaagacgccactgcaaaaactgataccattttccaaagctccagttttctcattatattgtcaatactctcctctttctaattatcccccatcggagtgactcacaactttcatacgataaagttcaaacactcttgtatgctacaaaagcacccagaagtaaatattcactattataattttgcataaagagaattcaggattagaaagggataattgtattcaactactccaggtaagacaagagagaaaagatgacgctacagcaaaaagtaattattaatgtgtgaattaagataatttaaatgcataccaatgttctgtaacacctgtcagttagaggcgtaatgacaagtcgaggtgagttaccaagatattcataagcatattttacattgcaattaatgatacgaactcgggcattctcattttcccaataatatcggagctgagcaagccacaggaaatctgtatcatgtgagacacctagaaaaaataaagtaaaataagacacatgatccttaaatggaaataattttaaaaagaagtattttatcttttataacagcaaatactaaaaataattcatgtttgccaacttataaaaaagattgtgttaaaaaaattctgttgagagaagaatacatatagtacaagtctttgtttccagatgctatcaacattttatctttaaaaattaaagaaaaagtcacatacccattttaatcatgtccatgaccacatctctagcatggacatcaatagtaaccaaagcccccagagtggtcctggtctgcttagacaactttcctcttaccagctctacaatctcattcagttggttctgaagttccttataatacttctttaatccctacaaaataaaaaaaaaagcaatctaattgatgtcacatcatacttaaaacatgtattttatatatttagtcttttataaaacaattctgacttcttaatctatctcaatatagaaatgagttcaagcgtggtggctcatgcctaaaatcccagcatctaggaggttaagatgggaggatcttcttttttttttttgagactgagtctctgtcgcccaggctgcggtggtgggatctcggctcactacaacctccgcctcctgggttcaagtgattctcctgccttggcctcctgagtagctgggactacaggcatgtgccagtaggtctggctaattttttgtgtttttagtagagatgaggttttaccatgttggccaggctggtctcgaaccccgacctcaagtgatccacccacctcggtctcccaaagtgctaggattacaggtgtgagccacggcaccaggcgcaaggtgggaagatcatttgaggacatgatttcaagaccagcctggcaaagcagagagacccctgtctctataaaaaaatttttaaattagccagatgtggtggtgtgtgcctgtggtcctagcaattcagaggctgaggcaacaggatagcttgagcccaggagtttgaggttatactgagctatgactacgccattgcactccagcctgggtgacagagcaagaccctgtctctaaacacacacacacacatacacacatggagaaatgaattttgtgagtgattttgtctaagcccagtaaaatattaagaacaagttctcaggccaggtgcagcggttcatgcctctaatcccagcactttgggaggctaaggtgggcggatctcctgaggtcaggtgttcaagaccagcctgaccaacatggataaaccccatctcaactaaaaatacaaaattagccgggtgtggtggcacatgcctgtaattccagctactcggaaggctgaggcaggagaatcacttgaacctgggaggcggaggttgcagtgagccgagatcatgcctttgcactccagcctaggcaacaagagcgtaactacatctcaaaaaaaaaaaaaaatgaatagttgtaattttaagattatatatagaaactgacagacgtattgtctttgcaaacaatagataagttaactaagaaacataggatggggccaggcacagtggctcatgcctctaatcctaatactttgggaggttgaagtgggaggatttcttgaggccaggagttcaagactagcctgggtagcatagcaagatctcatttctaaaaataataaaattaaattttaaaaaacctggaatgaaggatgttacttaaaagcaaacaatgctttacctccgtcccgccacttatcacttcctgtgtctcagatgtccagaacatttgagaaatacaaagtacaacttggccaggccactctcgaacccagtctcttcttgcagattctggataagcctgaacaattaaaataaatttctaactttaaaagcttgaatgagaaaaaatagctaaatgtctaacaatagagaaatgtaatatttggcacatacataggctagaatgtcatatagtcataaaaaatgttaaatgactaaaagactccctccaaattttataaattattattatgtttttgaaatatttatttataaaagaatggaaagataaacaccaacatgttaataatgggtagatttaactgttgattcttctggaagttgatttctgtgtgatttttatgttcctttgctgtggagagttgtcaagttttctatatagaatacctattacttctatcataataaaatataaaaattttagtaaacttagaaaaaactagtcaaggccagggtggtgactgacacctgtaatcccagcactttgggaggccgaggcaatggatcacctgaggtcaggagttcgagaccagcctggccaatgtggtgaaacccccatctctactaaaaataaaaaaaaaaaaatagctgggcatggtggtgggcacctgaaatcccagttactaaagaggctgaggcaggagaattgcttcaacctgggaggcagaggttgcagtgagccaagatcatgccactgcactccagcctgggcaacagagtgagactctgtctcaaaaacaacaacaacaacaacaacaaaactagtcaaatagattatgtatattgatgccaagatttaattgaaaaggagattatacaatatagttaaaaactgcactaatagcgcccttgtattatttatccatagcttttctgaaaacctatatgaccagggtatacaattttacaattatatatttgttcaattatgcataattgaaccatctatagttttgaattcaaggtatactttcattttttctaacactttgatattcaaaatgcatttaaatggatttatggagggagaggtttaatctttttaaaaatagctttttcaacagtaagtgattttagcagatccaaactataaattgaaaacaactacagaatgaattttgaagctgatgctaatgcaaattatattttcaataaaataacatcatcttagatataagaaagttaaaataggatatcagtattattataaaatgcttcttagccatatttagaaacaaatgcaaacgataagctaacctaagcttcaaagaaggatgaatggtgactgagagctattgctaggtacatagaaggtcaatttctatactgattaaagaaatactttcatggacaatggtggctctttcctatgtgttttagtttgctttgaatcataaatagtaaaaggagagaaaaagtcaagatttatttgtaggaacactgaagctgaacagaatagccaccacaagaagatgagctccatagggctctcggtcaaagaaaaagaacactcactcacatatagtgagttgctgaatataaagcttcgatgccttttaaaactattctactactttacaactgctcatttgtggtcctaaaggcagaaatatacgtgtttatcattcaagattaggttaattggattaacataagtgagatacatgtagtgccaagtgttatccttctttcaaatttatgacatatccccctttaatgtttgttcatctcatttgagtttttaagtagttgtttaagtgtaaaaagcagtaagtgaactaggtcatgcatttaccactcgtgtctgaagagaactgtcctacagatccacatgtgctaatgtgcaggattgtttgcctatgaaacatatccactagcctagctcatagcatttcaattttaatatatctaaaattgagctcttgatattcccctaagcctccacaaatctgcttctcctccaggaatcacccagagtaaatgccacccatatgctcaaattagaagcctaaaagtgatttttgagaactccccctccttacccttgtactctacaacaaattcatcatcaagacctgttgaaattaactacaaaatttatttctgatattctacttttctccctatcttctgccatttgcctagtgacagaccacatcttttttcctttatttttggtttttatttttattttttgaaactgaatctctggcaaaccagcccaaatcatctttcatctgaactaatctgagtctcctaatttgtcttcctgttttcacacctccactaatctattatttataccatagccatagtggtataaaaatataaatcagactatgtcccttccctgattaaaatatttagatggtgttccattgcatttaaaataaaatgcaaactcctaactgccttcctttccaacctcatgtcactttactctccactttgcttactctactccagacatatttgtcttctttcaggatctcccaaatccccagttctctctgattccaggggctttacgtaggatacctagatgctctctcacttgctctttacctggcttattcctacctgtcctttgtgtctcagtttcaacatcaccttctccaatagcctatcactggaccttcccccattctaaattatatacctcttatttttctctctcataataccttttctcttttataacaatcatatactattatcaattcatagcaatattgttatattaataatgttagaaacaaagaagtaaagaaaataaatgatttaaaatagtaagaactttaagtgttaatttactggtttccaaaacctcttaaacaaagcatttgcagaatatagggtatatatcaaatcctaggaaacacaccagcctggctgcagcgatcacatcgtgaacactccggagcattaggtcttccacttgaatgagccacttttccacagcaccccgcgctgcagacgtggaaatgagtgcaatcagctccactcgctcgccctcagagctatacatggctttaatgtccaaattgggaaggaactctaatttagcaatgccctcaaagcatttttttaaatgtggctgaactctaagtggatctttggtctctgataaaatctctaacatttcatcattagataagaagaaaaaactagggaaaaacatgcaaatacaaaagttttagttataattcatcacacataagaaaatgtttttaattacagcacaattgattatttatcataccgagggaagaaaagacgtttcttttcaagatatgcgttaagacctttcataattttctccaaaagttcattgcagttctgtagtttttccaataaacctgttaaagaagtggcagcaagaacctaaacgagacacatgcattcaagtcagcacttttatgccagatataattatgacttaaatatcaatctatactatatgttaaaatcttttaatgttaaaaggtttatgaaaaaatgtcaaaggtttataaaatttgcaatgaaattttttgtagtgtaaaaactattaaaattcaataagttacaaatacttatccaaggacactagttaaaatgacaagttatgattgtcgtgcatattgtcatttctcctatattatttcgaatgatgtgagaaaagtctgtttggctggtgctcgatttaattcttacttttactactgtcaaccataaatgtaacaatttacagcaaggagttggcaaactacatcctgcagaccaaatccagtctgttgtcagtttttgtataagttgtaagctaaaaattattttcacacttttagaagttaaaaaaatcaaaagaagaatattttgtgacatatgaaaatatcagtgtccataaaattttattgtagcacagacacactcattcatttacagattatctctggctgctttctcactgcaacgacaacagaattgagtagctgcaagaaagatctgtcctgcaaagcctaaaatatttactatttggaccttagcagaaaaaaattgctgacctctgatctacaagaaatcatgtttcacaaagattctgaagtcaacaggtaaagcaaaatccttaaaactcataaatttcagtgtactactgactctcagtaagtccagcacagctagtttttcattcagcatgggaataaattgttatttcttaaattgaataccagatgaaaaagtggatgcatatctatggactatgttcactgtgtgtatgaaaaatatatagtctgtctttcaacatttactgggagagacataggaactgagtgagaccaatggagagaacagcagattcttccccatcactccgagtacacagagtcactagtagaatgtcaggtgagtcacctacactattcattctctctccctctctcttgttctcactctctcctctctccatttgatttgatttatctatttattttatgaggaggagagcagtgagtgtttatagtagaaggcatgtgaatcagatgtacatttgaagcagctccaccaggtatactaaagagttacaagcaatgtatcttatgaattgaaaagtaaacttattttaatacttttatgctttcttatatttttctgaactttccagtttgtatacaatgagcaagtttaatttttataatcagaaaaaaagtcacatgttttacttaatttccaaaaacaaaggttcacctactgtgagagagaaaacaaacacttcacctttggatctttagcacaaaacttcatgatatctctccagtgtctgtctactgtctgaaattgacgcccttcttctggcatctgttgcatgatatcctcagaacaaaagatgggctctaagtacagccattgagcttgtacttttaaccattcatcaattgtttcttgtattcgaatcaagcggtcctcccaggccttaatgaaaagtatactgcactaaattctagttattaaagaaaggctataaattatagcaaggaaaatacattttaaatttactattatttttaaataagtgcaaacatctcacagcttaaggttacttatgtatgtctcacaaaggcttagaaaaattctaagaggtctgaagttttcctaaatcactggaactcacaattggaaatgactgtaacattattttgaccagtttcctaatttctcggtgagccatctggagtcccaaaaccatccaagaatatatccttctctaccagcagtggttatcaaccacaggcaattttgcctcccaccccagggaacatttgacaatgtctgtagacatttttggttgtcacaactgatgggggaagatgctactaatgtctagtgggtagaggccagagatgcagttaaacaacctataatgtagaagacagcccccatcacagagaattatagagcccaaaatatcaacagtgacaggttgagaaatcctgctctactctacatcaacacaatttggagaaaaatgaactgaaatgaaaaataaaatgaaataagcctccttattctcaagatcccctagaaatgacaagatatttcattagctgaagaccattaatataatatctctctttggttcttaaatatgtgcctaaggtctatgtgtcaagagattgtctcatatcttcgatttttaaaaaatctctacgacagcttttaaatttgtcttctaaattccccttgttagacaagtaaatttctacaaaaaagtaatatcttatcaggaaaggctaggttagcctgcttcttgggataatgtccagccttatgtcctcttggaagaacattactctgttttctccgaataatgacagccaaaatcttctataaaacaataaataaatcttctatttatgctcatattaaaaccaaactgccttggtttgaaccccagctctgtcacttattagctagatgaacttagaaaaattgcctatcctcctatatgttggtttccttgtccatgaatacagataataacagtgcctactttgaaggtctgctgcagggatcaagtgggttaataagtgcaaagttccagagcagcatctgaaacatagtttcaaatcaattgatatcagggtaaaaaatccagttgtctttccccaatttatatagtccccagttaggatagttttcatatccaataagatatgaaataatcttggagcctcaaataccatttgtttttctcaagtgaacaataattcattaattactctaaaagatccttatgctagctgtttacaactataattaaagtatggttactacaagttacaagaatgcaacaaaaaacagggtctaggttttctaaagttagaataagtaataccacctgttttcctctcaagtctatcactgccattggagaagattttaataagacatttttcttttaaaaatcatttatgtctcagatgtatatatttctatattaaattttgaatatcattttgtattttatgaaataaaatatcaaagttataggtctatgatttgaataaacacttaaaaaaccatccaataagctacttattaccatgagagcgtatatgtaataggattgcaatccgtataaatgaccaagagctgattatcacatttaacataccttgatctcatgttcaaatggtttgatgaaaggtgagcctctcattgtctgagtttttataatttgatcatcaaggatggcctgaatctcatccaccgaagaaagaatacagactccagtgtcacgatacagacttatatgaaaagcaatatcttcccaagttcctatcattgtattcatggctttctctaatgaaaattcctaaaacggaggaatgaagaaagaacgggatggtgaagaaaggatcttatttactatattgactttccctagtgaattcagtaagaatttgatgtattacattatcatttccttaagataatctgtgagtacagtataactttttaagttagaaggtttttcaacaatttaaaaattcctaagaagaacgattatgtagttttaaagaattcacttgctatgaaaactactgctgtcaatattaaaaatggacaagagaataaaatacctgtaggactttctctgaagtggcctttctatggcagcccatagtctgaagatgttttctgtgtacttcaagaacccattctttagggccatacttaccctgctagaacacatacatatcacatgccacatatacaacagtactcttaatggaaaaattatgtaccaacactagcacatcatccaacgacattggaatgtggcagaattaagaggagatcaaaggagtcatttctcgtctggattcaggacaagtaagtacacactttgggggggaggaaagagtgttttgttttgttttgttttgtttttgagacagagtttcgctcttgtcacccaggctggagtgcagaggtgtgatctcagctcactgcaacctccacctcccgggttcaagcaattctcctgcctcagcctcctgagtagctgggattacaggcacccactgacatgcccagctaatttttgtatttttagtagggatggggtctcaccatgttggccaggctggtctcaaactcctgacctcaggtgatccacatgtctcggcctcccacagtgctaggattacagatgtgagctaccgcacccagccggagagtggtcttctatcactctcccccatcacctcccgcgctatccagtactatacacattcaaccccaacaaaaactatgattacttgattaacgaagtcatcacataaagtatttcagttgatctttatgtttaccttgcttgcacctgcacttatcacttcaaattgttccaagtatggggtaaggtttaattttaaaacttttctcagtgtagttccagagtctggagtcaagtcatagcctacaatttctgatatctgtttccagtgacgagctctcattcctggattgcacagaatggagacagtaggaatatattcctaatggcaaaaatataaacaattatgagtcactcatttgacttccacacacatagattccatagatgaagccttgatgatataagggttacatttcttcaatttatttaatatatttctatcagtacaatcaaaacctcaattagatttggaaggagagagatactaagaaaatgaacctaaagttccctgcaaaaataagcatataaaaatagccaggaaaattataagagtaaacaagaagaatgaagggccaggcacaatggttcatgcctgtaatcccagcactttgggaggttggggtgggaggattgcttgagcccaggaatttgaggttacagtgagctaagattgcaatactgcactccggcctgggtgacagagtgaggacttgtctctatttagaaaaaaaaaaaagtattattttagaaattcaaattcattatatatactatttgcagaaatatataatatatagttataaacacacatacatagcatgaatggggaaaatatgtgtgcccaaatcccaaaatgtaacaatgttttatctctgctgagtgacgcctgccttggcctcccaaagtgctgggattacaggtataagccaccatgcctggccccctattttatttttatatgagtcatgttttaactttgtataagtaataatttaatattgtaaatttttttaattggaggaccataaactagcacactttttgttttgcttagttaaggacttcgttttaaccttccattggttatcaccatcatgtttttgcttatcatcacatattccctagaattcatcagaacataatataacaggcactcagtaagtattttttaaataagtgaagttttaacatctaaaaagtagaaaggacatactctttatttatttatttagacagaatcttgctccgtcccccaggctggagtgcagtgatgcgatctcggctcactgcaacctccgccttctggattcaagagattctcctgcctcagcctcccaagtaactgggattacagactcctgagtagcctcatgagtagctgggtcacacaaaagtgaaaaaactccaagcagatgagcagacagtaagagaatcggacttccacatctgcattgcccctccctctattctgtctggtaccaagagggcagaaaatttccccccaactcactgtttctaccctgataagagcaaggtcaaagtggacaaccagctaccccaccaccctgggttccctagcaggagacctgccctgccttaacccacaggaagcaacgccagtgcctgaagggataaataattcctgtggacaagcagagacaaagggaggaagtggcactaccatccccagccctggaaatgttactctgtaagccacagaagatgccaaatcagagtggctattctgcagcaccacactgtaggaggtttgtcccacaggtctcctgggcacaaactcctagccagcttcccacattgccagaatataccctgtgggaccgtccgcattcattaagggcagcgctcccatcaggtactagacccaagccaaacctgggcttaaggtgccacttggagctgaaaaggaagcagtgacctagcggtaaagaaactctaagcaaatatatccaatataaaccaaaacaagccagacaaaaaacactggaataaataatacttcaatgcaaagacagatgtacatccagcaaaaacaacagcaaacagggaaccatgatctccacaaacagaagcagcaaagaaccagtaactgactctaaccagacagggatatgtgagctctctgaccaacaataaacaactaaattcctaactagactgatcaacaaaaaggagagaaaattaaaataatcaatatttagaattaaaaaggagttagcactatagattctacagacatttaaaagataataaagaaatgttattagcaactttatggcgacaaaatcaatgacttagaagaaatggacaaattccttaaaactacaatctaccaaaattaaacacaaaatctgaatagctcctatatctattaaagaaattctcttttccgtcccctagagggggaattggcacaggacttgcttcagccaatgtaatatgggtggatatgaagtatgtcacagctgagtggaagatctaaactcaggtacatggtttagctcagcccttgctctttctctctaacgcgagattggcccacattagctcaggacatagcctgtgtcctggaagttagaaaactcaggagcagaacaagactgcaactgggagcagagacttagctaacccgtggtcctcatggaatatgaagaagaaataaataagtacttgaaaaatatatatatagagagagtctgttttaaaaacctttcctacaaacaaaacgtcaggctaaatggtttcatgagtgaatgtttctctaaaataagaaagaaataatatcaatttataaaaaaactctttcagaaatagagaaaataaaacttcccaatttgttttataaggccaacataaccctgataccaaaatctgacaaagacattacaagaaaactaagaccaagatccttcctgaacataacctcaaatatcctgaatgaaatatgaacaaataacaaactataagagtattagaaaaaaatattttgacatggggaaggcattttaaactacagttcagaacccaagagccataaaggaaaagaataaaaataattacataaaattaaaagggttctgcaaggcaaaagctatcataagcaaggtcaaaaagcaaataataaatattcacatcacagacaaagcctaatctcctatatatacaagaaaagaaatcaataagaaaaaggtcaataattcaacagaaaaataggcataggtaagttaaaacagtttacaggaaaagaaatataaaacactcttaaatatatgaaatatatgaaaatatgcttaaaattttacttgcagtaagagaaatgaaaattctcctagtagagtagcaaaaacctaaagtttgatgatattttgttatgaaggttgatgagagtatatattggtataacttctatggagggtaattcaactgtagattttaacctggcatttactcttccacaatttaccctgcagtcacaccttcaaacacatgcaattcacacacacacacacacacacacaccagattagtcatacattatataggtgtgaaaaaaatgaagaagctccctatatacaagaagaaaaggtctccaagataaattaagcaaaacaaagaaagaaaataatatacattgtatgctacacttcatgtaaaaagatagaaggataagaatatatactcacattgttatatatgtaataaaactctggaactatacacaagaaggtaataacattgatcacctgagttatacaggtgagaaccatgaggagacttttcagatgtctctttttatattttttagaccacgcaaatgtattcaacattgaaaataatttttaagttaaaaaaatcagacggccatggaatctctgagatgaatagacatagacaggaacaatgcttgaatccaatcacagagtttgcactctgggcatgctgacagtggaaatttaaggatgtattactgactgtcaaaaaaactgttcttattctctctttataaatgagaggaccgaggcacaagtggctaaatatcttgctcaaggtatgccactgccaagtggagaactgtgctataactaaacagtgtggttccaaatccttcccagtaaactgttaccctgtgttgctgcacttagtataggctaagtggtctgacctagtaaacttatgcccttatttttttttgagacagggtcttactctgttgtgcccaggagtgcggcagtataatcatagctcactgcaacctcaaactcctcggcttaagtgatcctcccacctcagcctcccgagtagctgggacttcaggtgtagctgaattttttttaccgtgcctggctaattttttattttttgtagaggtagggtctcactatgtcacccaggctggtcttgaacttctggcctcgaatgatcctcctgccttggcctcccaaagcactgggattacaggttacaggtgtcatccgctatacccagcctgcttccaaacctttctatttctcttcattagcacttgatgatgagaatagctctatcaaggtttttttgagtaattttggagtctcgctctattgcccagactgggcatgcagaggcatgatctcggctcactgcaacctctgcctcccgggttcaaatgattctcctccctcagcctcccaagtagctgggattacaggtatgcaccaccatgctcaactaattttttgtatttttagtagagaggattcactatattggccaggctggtctcgaactcctgacctcagatcaggtgatctgcctgcctcagcctcccaaagtgctggaattacaggcataagacaccatgcctggccttgagtaattcttaagattcagaatccataggtcaacaatttctctggactcaaaagccttcatctaagcattttgcaaatgctaaaattttttaatgtattcatctagaaaaagtagttataacctcacttcaaagtttggattatgctgaattaatggtaggctattttattatgtttgtttagttttattatagtaaattataaacaatggtatactcttcctatgttttccataggaaaatgacttagtgtcattttcaggaagtatgcaatctgccctaataggtctgagcaatcttctactgcctttcttgggccagaggaattctttgccccagttttgccagatctggctttatatgtgtattctccttgatctgccccaaatatggctgccattcaccacctaaccagcctttcctacactccacagtggtgcttcatgatgaggagctaaagttgtgggaatgagacaccaaaacatcaaagatgcaaacagatgtaattcaaaagatgagaggaataaaatgccctctcttgcccttaccacttcctcccaaaaccaatcactcagctctgtcacaagtacccatgcctagaacagaggtgggagtgaatacattaaaaaattttagcatttgcaaaatgcttagatgaaggcttttgagtccagagcttgaccaagaggctgaggcatagcagaggaatttaaaatcttatttttttctgattgtttctcctcagtaccttcatttggccatactcctttgattacaagtgacagagacccaattcattagccaaaggggaagaaatagtgtcttattcttgagcctaggagtctgaggctgcagtgagctatgactatgccactgcacagtcaacagagtgagaccctatctaaaaagtaataataggccaggtgtggtggctcatgcctgtaatcccagcactttgggaggccaaggtggacagactgcttgagcacaggagtttgagaccagcctgggcaacacagcaaaaccccatctcttcaaaaaattagccaggcatggtggtacacacctgtagcaccagctactcaggaggctgaggtgggaggatcgcttgagcccaggaggtggcagtggcagtgagtcaccactacactccagcctgggaaatagagcaagaccctgtctcaaaaattattaataataataaataataaacatgtaaaaccagaagataggctttataatttatatattaggtaacagaaaagttgagaagatagctataatattaaaatgttattatatatatttataccttaaaagcttttatctgttccatgactgtactgcacatagtaatagtagcattgtcttttggttcttcttcaattttctcttcttccaaagaccgttttcttgctgcctttcttttttcttgtaattctttctttagcttcgtttggaaaaattttagtgtcttaaaaatttctcgggaaaactcttccacatcagcctccatgctttccccattgaggtccaaaaaccctccatccatccacctgaatggaaagaaaaaatattattaaactcagacttttgaagtttgaaggggccttagagatcctttaggctagaccccttgttttttaagagagaaaaatgagggcaagagctgttaacagtttttctcaggcacacaggtagagctgatggtagaaaagacagaactaaaataatcattttgactatgctgcatgtgctaaaatatgtatcagattataaatggatgattaacagtacccacataaaatgcaggttcacattagagaaatgcaaatcaaaccacaatgagagaccatctcccatcagccagaatggctattattaaaaagtaaaacaaaaaaacaaaaaacagatgctgtggagaaaagggaatgcttatacactgttgcactattgatgggactgtaaattagctgagccactgtggagagtagtttggagatttttcaaagaatttaaaacagaactaccatttgacccagcaatcccattactgggtatatacccaaaggaaaataatcattctgccaaaaagacacatgtactcgtctgttcatcacagcactattcacaatagcaaagacatggagtcaacctaggtgcccatcaacagtggattgaataaaaaaaatttggtacatatacaccatggaatacaatgcaaccttaaaaaaggatgaaatcatgccctttgcagcaacatggatgcagctgaaggccattatcctaagcaaattgatggaggaacagaaaaccaaatacctcatgttctcactttgaagtgggagctaagccctgggtatacatgaacatagagatgggaacaacagacactgggaactactagaggtgggagagagggaggggagcaagggctgagaaactacctattaggtgctgtgctcactacctgggagataggatcatttgtaccccaaatatcagtgtcatgcaatatacccacgaaacaaacctgcacatgttaccgaatctaaaataaaagttgaaattataaaacaaaaataaaaataaaatgcaatttgactccatacttctaattttgggggtaaacattagtgaaattaatctattgtattaaaaagggaattgactctcagaaaccaaaatgacaactcatatattatatatatatatttttcatgtcagaagggtaatgtgccgacattgtaacaacgtttgagggaggcatatctctcacacatgagcatgaaaatccaatcattatgctcataaaccagaaaaggatctcagatattgtattagtaaggttagtgggaccttagcagcactggatgtttctcctacatggtacctggttctctttcaaatggacatataaatcctacttttaaacacttaaccaaaaaaaaaatcaatttatattttacaaattattttctatcatttgcttgatttttattacattaccagcaattaccgtttttctgatcgctgccacttcaaaacaaaattaaaaaacttctgatagggctcaatgttaacttttaatttatccagttcaggatattttgtcaattcccacttgaaaagttcctcttctttattaataaactgcactgcttcttcagattcctgaatacgtttttgtagttgtcttacatctgtcacatactgaaagtaaataagttttttgtcttaaaaaaaattcaagtaatgttataaaaataaaatcctatgatactgtgtacaatatgtccttgtatttatacaacaagtttatttttaggctggagtgcagtggcgtgatctgggctcactgcaacctctgccccgctggttcaagtgatcctcccacctcagcctaccaagtagctgggactacagatgcggaccaccacacccacctaatttttgtatttttagtagagacggggttttgccatgttggctaggctggtctcgaactcctgacctcaggtgatctgcccacctcaaactcccaaagtgctaggattacaggagtgagccactgcgcctggcctatacagcaactttaaatattaacttcacaacataactatgattgagagcaaaaggtacaattatgtctactctacaaatagagaactgagtcacaagaaagataacatagttccagttttgggcctaagagtcaggtctttgtttgccagcctgggcaacatggcaaaaccccatctctacaagaaaatacaaaaaattagccgggcatggtggcacatgcctgttagtcccagctactcaggaggctgagactacatataaagtatttaaatacatatttatgtattttactatatattatagtattagataaatatatatgtatatatgtaatatatagaaaaatatagagtaaacataaaaaaatagtaaacatatttttctatacttttaaatttatgttaacatgtcctatatgactctatgggctggccatagctattgtctcatatatttatcagacctgttgcatgcgctccagctctgcaaattctgtaaactcctccatgcggcgtgattctttttctatttccaaaataagtttctctctcttggccattagttcattttcttttttatgtttagcattctcaattagctttttaaaagacaatttgatcatgttagttaatctgtaacaaagaattatcaagtcagaaatccaaatactgtgtataataataaaaaccatcagagaagtaaaaatgagtacaaaaataaaacaatgcctataattactaatataaaaatgcaaagaataaaccacacagaaaaacattcctagatctccaaagtgactttaacaacttgtattcattaattaaatgctttatttaacagattctaggataataataaaattaccatttattgagcatgtgccatgtatcaagaactattaaatatcttacctatattattactggtattattattctcatttcagagaaaagaaattgaatcttatggaagtcacgttcatgttcacaaaatcataaaaatcaaaatctggattagaatcttggtttatctgattgaaggccatgctttttattacaataccatcttacctcccaattcaggttaaactgatttacattaggactttttcaatatctgaaatatattcagtctgatataaaattgtaaattttatcactgtgatattgaactatttaatttctctgagtctcatatttctcatctataaaatggaagaaatgggagcatgtgggatttttatgagagttaaataattgaataaatggaaagcactttctcagttaagtgtttctattattaatttatataatagttctgactttctaaatgtcagccccactacttaccagaccttgtgagttaagcctaacagcttgtcttaagcctagagggccataagtgtggccagtctcaaactcatattgacacacaaaattacttttaaagttagatggccaggagatatgaaaattaaatgtgaatgatgtgcttgaaatgtcagattacaaaaatacatactgaaaaatatatttacctcatcattttcatcaaagatgggattaattttcctaggccacatgaggacagttgcatttaaagctaagtcttcttgaggaaataggaaaacatctaaaaagtaactcatttggcgtttagattcctacaaaagaaactctggatataatatgtcatatagaaaatctacatcattatgaaaaagagaagaaccaacaacaatctctaataccctttcagatttcagtttgactcagattattaactgatattttatatatcacccaaaccagatgggtatttcaatagctgcagtattatttatcttgcttcatgccacataattgtatacttttatgctagaaataaggcttttaaaaagttttcacttacagttgatttagcataaaggaacttttggtcctcccttgtttatgactgaaaaatataattaaatcttcagaagtcctttaattttgattttaaaggattttaaattattttattcttataaatattttatttttgaatctttgatgacaaagattttagtatcttttcttttgttttgtatcttcactgacatcaccacctttttggcctacttcacatgttactgtatgcaatagtctagaatattgcggtatgtaatagttcagaaagagttgaaggtgagttggccaggtacggtagctcacacctgtaatcccaacactttgggaagctgaggcgggtggatcacctgaggtcaggagttagagaccagcctggccaacgtgacgaacccccatctctactaaaaatacaaaaattagctgggcttggtgacgcacgtctgtagtcccagctacttggaggctgaggcaggagaattgcttgaacccaggaggtggaggttgcagtgggccgagattgtgccactgcactccagcctgggcgacagagtgagactccgtctcaaaaaaaaaaaaagttggaggtgagttgcaaagaaaaaaaactcttaaaacaatagattatctgagtagataggttgaatatttttaccctctatatctttcattgctctataagctgtactgtagtactaatttttaagaattgaaatacagattcaaaggcaaatttgaggtttttgattttatattatacatatgtatacatatatatacatacatctatatatataatatagatataaaattatgtattgaaaataacattaaatatgtattttgtacattctatatattatgtatatacaatgcacatagaaataaaactttaaaataaaaagcaatccgtgtaattcgttatattaatagattaaagagaaaaagcatatgatcaacacagtagatgcaaaaaagcatgtagtgaaattcaaagtccactcatactaatttttcttttcaaaaaacgtagtagcacatcagcaatagaagggaattcactaatctggcaaaagtacctgtataaaacctacaacaaatgtcatacttaatagtgaaatcttgaaagctttccccttaaggttgggataaagatgggaaatctgccatccactgctattcaacattgtactagagtcccagacagtccattgttgcaaagaaagtaaagttttgcaaatgtgtaacatttgatcaggaaaaacagaactgtcatcatttgcaagttatataatggtatatgaagacattccaaaataatcttcagataaactattaaaattaagaagagaaatttaaaatatataaaaatattaaagttaaaaatttttttttgagacagagtttcactcttgttgcccaggctggagtgcaatggtgcaatttcggctcactgcaacctccgcctcccaggttcaagcgattctcttgcctcagcctcccaagtagctgggattacaggcatgtgccaccacgcccagctaactttttgtgtttagcagagacgggatttcaccatgttggtcaggctggtctcaaactcctgacatcaggtgatccacccacgtcggcctcccacagtgctgggattttaggcatgagccactgtgcagggcctaaagttcaaatttttaaatagaaaattttaaaagaaaaattgagcaatgggtattaaattagtatataaaaataaattttggtcgagcatggtagctcacgcctgtaatcccaacactttgggaggccaagtcgggcagatcatgaggtcaagagatggagaccatcctggccaacatggtgaaaccccgtctctactaaaaatacaaaaattagctgggtgtggtggtgctagctgggcgtggtggcgcgtgcctgtagtcccaggtactcaggaggctgagacaggagaatctcttgaacccgggaggcagaggttgcagtgagctgggatcgcgccattgcactccagcctagcgacagagcgagactctttctcaaaaaaaaaaaggccaatggaacagaacaagctgcctcaaaacagatctacacatatacggacacagtggggatggtctcttcaataaatatgtatttgctcatctatatgggaaaatatttaaattggacctcacattatttacagaaatacattttcaggattgaaacctaaatctcaaaagcaaaactaaacagcttctagaaaagggtggaagaaaaatgtctttgaaccaaggtaggagaggatttcttaaataaaacacagaaagcactaggtataaaataaaatactgctccatttaactgcactaaaattaaggcaacatggcaaggccttgtctccaacaggaagaaagaaagagagaaagagagagacaaagaaagaaagaaagattgctccatttattataaaataaaagactgctccatttaactgcattaaaattaaggacttctgttcatcaaaaacaccattaaaaagttaaattacagagtgaataaaaagatacctaataatatattaaaaattactacattgaactgtatacttaaaaatggttaaaatggtaaattttgtgttatgttcattttaccacttttttaactgctacaaatcaataaggaaaaggtacataacccaaaaaaataaatgagcaaaatgtatgtactatcatttcacaaaagaggcactccaaatagccaataagcatatgaaaagtgttcaaattcatttctttttaggaaaatgcaaattgaaaataccataactttcacccaatagactggcaaaatttaatccatctcacaattgcaagtaagaatgttaaaataatagacactttgtgcactgctaataggagtctaaaactggaactacttagaaaagaattttgccttaattagtaaaggtgaataaaagcatatcttataacacctggaagaaatgaatgaatgtgtgcactgggatacatgtgttaaaatgttcacagaagcattgccagtaatatcaaaagcagaaacaaccaaatatccagaacagtaaaatttttaaaataaattattgtatacaatgtggaatggatacaatatggagtggaatactagactgcaatgaaaatcagctaaagtttaggaacaatgacattactaacataacattgatgagaggcaaaagaatataaatggtatgattccctttatataaagaccaaaatcagaagaaattaactatattgattagaaatgcaagtttaagttgtataactataaaaaaaaacaaggaagtaatcactataaaaatcagaataggccaggcgcagtggctcatgcctgtaatcctagcactttgggaggctgagacgggcagatcataaagtcaggagttcgagaccagcctggccaatatggtgaagccccgtctctactaaaaatacaaaaattagccaggcgtggtggcgggtgcctgtactcccagctactcaggaggctgaggcaggagaatcacttgaacccaggaggcggaggttgcagtgagccaaaacctcaccactgcactccagcctgggtgacagagcgagactctgtctcaaaaaaataaaaaataaaaaaaatcagaatagcactaacatccagaagacaagggattatgatgggcttctagagcgttggcaaggttctatttattttcctaggtggtaattactggctgtttactttagaacattccaaattgtacaattcatgttttacgtaattttggtatatgtgttgtttaacatttttaaaagtttcttaaacaaagaataagagtaaaatataggtaaataggtacatcatcttgtgctggaaaaggtaaaaacatactattaaatgcagaaactataaaagaaaaaatatttttaaaaatctatattgtttaaggacatacacaaaattagtgaaactaaagaaattcaaagctaagggggtggagccaagatggccaaatgggaacagctccagtctacagctcccagtgtgagcgacgcagaagatgggtgatttctgcatttccaactgaggtaccaggttcatctcaccggggagtgtcggaaagtaggtgcaggtcagtgggtgcagcgcactgagcatgagccaaagcagggtgaggcatcgcctcacctggggagtgcaaggggtcagagaattccctttcccagtcaaagaaaggggtaacagacggcacctggaaaatcaggtcactcgcaccctaatagtgcgcttttccaacgggtttagcaaacggcacaccaggagattatatcctgtgcatggctcagagggtcctacacccacggagcctcactcattgctagcacagcagtctgatatcaaactgcaaggcagcagagaggctgggggaggggcgcccgccattgccgaggcttgactaggtaaacgaagtggccgggaagctcgaactgggtggagtgcacggcagctcaaggaggcctgcctgcctctgtagactccacctccaggggcagggcacagacaaacaaaaggcagcagaatcctctgcagacttaaatgtccctgtctgacaactttgaagagaatagtggttctcccagcatgcagctggagatctgagaatggacagactgcctcctcaagtgggtccctgacccccgagtagcctaactgggaggcaccccccagtaggggcagactgacacctcacacggccgggtactcttctgagacaaaacttccagaggaacgatcaggcagcaacacttgctgttcaccaatatccgctgttctgcagcaaccgctgctgatacccaggcaaacagggtctggagtggacctccagcaaactccaacagacctgcagctgagggtcctgactgttagaaggaaaactaacaaacagaaaggacatctacaccaaaaccccatctgtacgtcaccatcatcaaagaccaaaggtagataaaaccacaaagatggggaaaaaacagagcagaaaaactgtaaactctaaaaatcagagcgcctctccttctccaaaggaatgcagctcctcaccagcaatggaacaaagctggacggagaatgactttgacgagttgagagaagaaggcttcagatgatcaaactactttgagctaaaggaggaagttcgaacccatggcaaagaagttaaagaccttgaaaaaaaattagacgaatggctaactagaataaccaatgcagagaagtccttaaaggacctgatggagctgaaaaccaaggcacaagaactacgtgacgaatccacaagcctcagtagccgattcgatcaactggaagaaagggtatcagtgatggaagatcaaatgaatgaaatgaagctagaagagaagtttagagaaaaaagaataaaaagaaataaacaaagtctccaagaaatatgggactatgtgaaaagaccatatctacgtctgattggtgtacctgaaagtgacggggagaatggaaccaagttggaaaacactctgcaggatattatccaggagaacttccccaacctagcaaggcaggccaacattcaaattcaggaaatacacagaattccaccaagatactcctcgagaagagcaactccaagaaacgtaattgtcagattcaccaaagttgaaatgaaggaaaaaatgttaagggcagccagagagaaaggttgggttaccaacaaagggaagcccatcagactaacagctgagctcttggcagaaactctataagccagaagagagtgggggccaatattcaacattcttacagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaatcagtaccagccactgcaaaaacgtgccaaattgtaaagaccatcgaggctaggaagaaactgcatcaagtaacgagcaaaataaccagctaacatcttaatgacaggaacaaattcacacataacaatattaaccttaaatataaatgggctaaatgctccaattaaaagacacagactggcaaattggatagagtcaagacccatagtgtgctgtattcaggaaacccatctcacgtgcagagacacactaggctcaaaataaagggatggaggatgatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcacaaagcaagtccttagagacctagaaagagacctagactcccacacaataataatgggagactttaaaaccccactgtcaacattagacagatcaatgagacagaaagttaacaaggatatccagaaattgaactcaactctgcaccaagcggacctaataggcatctacagaactctccaccccaaatcaacagaatatacattcttctcagcaccacacagcacttattccaaaattgaccacacggttggaagtaaagcactcctcagcaaatgtaaaagaacagaaattataacaaactatctctcagaccacagtgcaatcaaactagaactcaggattaagaaactcactcaaaaccactcaactacatggaaactgaaaaacctgctcctgcatgactactggtacataacgaaatgaaggcagaaataaagatgttctttgaaaccaacgagaacaaagacacaacataccagaatctctgggatacagtcaaagcagtgtgtagagggaaatttatagcactaaatgcccacaagagaaagcaggaaaggtccaaaattgacaccctaacatcacaattaaaagaactagagaagcaagagcaaacacattcaaaagctagcagaaggcaagaaacaactaagatcagagcagaactgaaggaaatagagacataaaaaacccttcaaaaaatcaatgaatccaggagctggttttttgaaaagatcaacaaaattgatagaccgctagcaagactaataaagaagaaaagagagaagaatcaaatagatgcaataaaaaatgataaaggggatgtcaccaccgatcccacagaaatacagactaccatcagagaatactataaacacctctacgcaaataaactagaaaatctagaagaaatggataaattcctcgacacatacaccctcccaagaccaaaccaggaagaagttgaatctctgaatagaccaataacaggctctgaaattgaggcaataattaatagcttaccaaccaaaaaaagtccaggaccagatggattcacagccgaattctaccagaggtacaaggaggagctggtaccattccttctgaaactattccaatcaatagaaaaagagggaatcctccctaactcattttatgaggccagcatcatcctgataccaaagccgggaagagacacaacaaaagaagaattttagaccaatatccctgatgaacgtcgatgcaaaaatcctcactaaaatactggcaaactgaatccagcagcacatcaaaaagcttatccaccatgatcaagtgggtttcatccctaggatgcaaggctggttcaacatacgcaaatcaataaatgtcatccagcatataaacagaaccaaagacaaaaaccatatgattatctcaatagatgcggaaaaggcctttgacaaaattcaacagtgcttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctttcaccactcctattcaacaaagtgttagaagttctggccagggcaatcaggcaggagaaggaaataaagggtattcagttaggaaaagaggaagtcaaattgtccctgtttgcagatgacatgattgtatatctagaaaaccccattgtctcagcccaaaatctccttaagctgataggtaacttcagcaaagtctcagaatacaaaatcaatgtgcaaaaatcacaagcattcttatacaccaataacagacaaacagagagccaaatcacgagtgaactcccattcacaattgcttcaaagagaataaaacacctaggaatccaacttacaagggacatgaaggacctcttcaaggagaactacaaaccactgctcaacaaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttgaagttcatatggaaccaaaaaagagcctgcattgccaagtcaattctaagccaaaagaacaaagctggaggcatcacgctacctgacttcaaactgtactacaaggctacagtaaccaaaacagcatggtactggtaccaaaacagagatatagaccaatggaacagaacagaggcctcagaaataatgccgcatatctacaaccatctgatctttgacaaacctgagaaaaacaagcaatggggaaaggattccctatttaataaatggtgctgggaaaactggctagccatatgtagcaagctgaaactggatcccttccttacacctcatacaaaaactaattcaagatggattaaagacttaaatgttagacctaaaaccataaaaaccctagaagaaaacctaggcaataccattcaggacataggcatgggcaaggacttcaagcctaaaacaccaaaagcaatggcaacaaaagccaaaattgacaaatgggatctaattaaactaaagagcttctgcacagcaaaagaaactaccatcagagtgaacaggcaacctacagaatggcagaaaatttttgcaatctacccatctgacaaagggctaatatccagaatctacaatgaactcaaacaaatttacaagaaaaaaacaaacaaccccatcaaaaagtgggcaaaggacatgaacagacacttctcaaaagaagacatttttgcagccaaaagacacatgaaaaaatgctcatcatcactggccatcaaagaaatgcaaatcaaaaccacaatgagataccatctcacaccagttagaatggcgatcattaaaaagtcaggaaacaacaggtgctggagaggatgtggagaaataggagcacttttacactgttggtgggactgtaaactagttcaaccattgtggaattcagtgtggcgattcctcagggatctagaactagaaataccatttgacccagccatcccattactgggtatatacccaaaggattataaatcatgttgctataaagacacatgcacacgtatgtttattgcagcactattcacaacagcaaagacttggaaccaacccaaatgtccaacaatgatagactggattaagaaaatgtggcacatatacaccatggaatactatgcagccataaaaaaggatgagttaatgtcctttgtagggacatggatgcagctggaaaccatcattctcagcaaactattgcaaggacaaaaaactaaacaccgcatgttctcactcataggtgggaattgaacaatgagaacacatggacacaggaaggggaacatcacacaccggggactgttgtggggtggggggaggggggagggatagcattaggagatatacctatgttaaatgacgagttaatgggtgcagcacaccaacatgacacatgtatacatatgtaactaacttgcacgttgtgcacatgtaccctaaaacttaaagtataataataaaaaaacaaagctgtgcaacattgaaaaaaaaaaaaaaaagaaattccaagctaaaattactgtaaaaatcaactggaaacctctagaagaggacaggggagaaggagaggcatggcgatcagaaagttatatgcagagtcctggggtgctgacaatatcctatttcttggcctaggtggtggcaatataaccgctcaatttacagctatttgtgtaactatatattttatacatcttcaccatgaaaataatatttcacaatgaaaacaaaccaaaatatgcaaattaaaattccttacctggatccttaaaatcaactcttcgattcctacagtccgggctttttctacataagatatcagatccatcatctcttctgttgtttcagggacttttaatgcatgttctttaattgcttcaaattcactgcaaatactgacataatactctgctttaatagacttatggcaattaatgttatatcatattcaataaatgtgtgttatgacgattactataaaataagaactatgatatcctaaaaaaattgcttgattcactaaggtatcttaaaaatatttaagcttggccaggcacagtggctcacacctgtaatcatagcactttgaaaggccaaggcaggcagatcacttgagctcaggagttcaaaaccagcctgtgcaaagtggtgaaaccctgtctctacaaaaaaaaaaaatacaaaaattagctgggcatggtggcacatgcctgtagtcccagctacttgggaagctgaggcaggaggatcacttgagcttgggaggttgagctacagtgggccatgattgcaccgttgcactccagtctgggtgacagagtgagaccctgtctcaaaaaaaaaaaaaaaaaaaaagcttatctgctataattcagtatatactatacatcaacaaaacctacaaaattaaggtaatatttacatgcaaaattatggcatattagaaaaaaattttagcgacctcttcaactctcttaaatacccaggtaacactcatctttctggattgttgtaatacaacaatgaatgcaaagggtctagcacatagtacactctatttactgataactataatcattagtataattattagttttattattattagtgcctcttgtgaaacatgacagtacagcaagtaaacagatcaaaccctcaaactcttatacatagtttctttaattaacagttctcttagaatatcccatgtaggatatgaacctagatatcctacagcattattcaactaaagttacatttcatggaattttttcctgtgctttaaaatatctgggccaaactaatctttgataaagcatacaaaaacataaattggggaaaggacaccctattcaataaatagtgctgggaaacctgaacagccacaggatctccatctctcaccttatacaaaaatctcctcaagacggatcaaagacttaaatccgagacctgaaaccataaaaattctagaaaataacatcagaaaaaagcttctggacattggcttaggcaaagaatccatgactaagacctcaaaagcaaacacaacaaaaacaaaaataaataaatgggacctaattaaaccaaaaagcttctgcacagcaaaagaaataatcagcagggtaaacagacaagccacagagtgggagaaaatatttgcaaactctgcctccaacaaaagactagtatccagaatctacaatgaactcaatcaaatcagcaaggaaaaaacaaataatctcatcaaaaagtaggcaaaggacatgaataggcatttcttaaaagaagacagccaaaaaaacctatgaaaaaatgctcaacataactaatcatcagggaaatgcaaattaaaaccacaatgagataccacctcactcctacaggaatggccataatttaaaagtcaaaaaacaatagatgttggcatggatgtggtgaaaagggaacacttaaactgcttgtgagaatgtaaattagtacaaccactatggaaaacagtattgaggttccttaaagaactaaaaatagaactaccattcaatcaagcaatcccactactaggtatctacccaaaggaaaagaagtcatgaaaaagacatctgcacaagcatgtttattagcagcacagttcacaattgcaaagatatggaaccaacctaagtgcccatcgaccaatgagtggataaagaaaatgtggtatatagacaccacggaatactacttagccataaaaaggaatgaaataatgtcctttgctgtaacttggatggagctggaggccattattcttttttttttttcttttctgagacagagtctcactctgttgcccaggctagagtgtagtggtgcaatacaccacaaccttcacctccaggttcaagccattctcctgcctcagcctcccgagtagctgggattacaggcgcgtgccaccacgtctggctaatttttgtattttgagtagagatggggtttcacatgttggccaggctggtcttgaactcctgacctcgtgatccacctgcttcagcctcccaaagtgctggaattacaggcatgagccaccgcacccggctggaggccattattctaagtgaagtaactcaggaatggaaaaccaaatatcgtatattctcacttataagtgggagctaggctatgaggatgcaaaagagtaatataatggacttcggggactcggtgtggggaaggctgagaggcaggtgaggggtaaaagactacatattggtacagtgtacactacttgagtgatgggtacactaaaatctcagaaatcaccgctaaataacttaactgctaggcgtggtggctcatgcctgtaatctcagcactttgggaggtccaggagggtagatcacttgaggtcagaagttcaagaccagcctgaccaacatgatgaaaccccatctctactaaaaatacaaaattagccaggcatggtggcacatgcctgcagccccagctacctggggggctgaggagattccaggagaatagcttgaacctgggaggcagaggttgcagtgagactccatctcaaaaaaaaaaaaaagaatttacccatgtaacaaaaccacttataccccccaaaactattgaaattttaaaaattaaaattaattttttcttttaaaaaaatatctagcccaggcacagaggctcacgcttgtaaacccagtactttgggaggctgaggtaggaggatctcttgagcccaggaggttgaaatcagcctacgcaacatggcaaaaccatgtctctattaaattttttttaattttaagtaagaaatagaaatcggtattgtcattctattactagaaatatcaggaaaaaaccatgtaaaaacaaagtgtaaaagaggtaaatgattttttagttcatgcaggaatttggagaaatatgtgggaaattatacttgctcattcactcatttaataaatagctgagtacctacaatatgctaaggaaaattctaaatatagcagcaaatgagaccctgccctcataaagcttgtattgaagctgaggaaagagacaaaagcacacaaatatgtacactgttaggtagcaaaaaaaatgctgaggatcccttgagcccaggagttcgaggtggaagtgagctataattgtgctactgcacttcggtccgggcaacatagtaggaccctgtctctaaaggagaaaaaaaagctatgaagaaaaataaagcaacataaaaggaaaaagaatgatggagtgtcaagaagaagccactattttatacagaggggccagagaaggcctttctagggaggtaatattcaaggtgaggggaaaaaacaaatgagttgttcaaataccaggaaaagagattccaggaagaaaaaccagcaaggacaacggccataaagtggtaataagcttggcatactttaggaatggcaaacgaagttgaagtggtgagcaggaatcagatcatgtaggactttacagttaattattgaatatcagaaatacaggaggaatgtggccaggcacagtggcccacacctgtaatcccaacactttgggaggctgaggagggaggatcacttgagtccaggagtttgagaccagcctaggcaacatggcaagaccttgtctctaatagaaaagaaggaagaaaggaaggaaggaaggaagggagagagagagagaaagggagggagggagggagggagagagagagagaaagaaagagaaagaaagaaaaaaaaaaagaaagagaaagaaagaaagaaaaaaaagaaaaagaaagaaaaaaaagaaagagcaagcattaatgtggataatgcaaaaagacagataatcctcctggggatcatcttgctagtgcagaatctgagtcctttgggcagagatacttcagcaaaagaaaaggaggcaaacaaaatgatgagagcaagatggcccaagcagatgctaaaccaaacggtgaagtaagcaaattgctcttcagtgaccttgtacttaacctaggggcacacatttcctccttttgatgttatctaaagtacagaattgaaacaggaggaatcaaagaataaactaggtgaaggaaactggataaattttcagctgcttttatatcatagctttataataagataattattttgtgaaaagtatggaattttccagaaaaatcacagatactacaaaaataaatacaaaaaaattatgttaaacataaacttataaagtgttttttttttgttttttgttttttggttttttttaactaactatggcattgtcattgttgttactcatcaggatggttacaactctcaagaaagggaaaggttctaatactttaccctctttgatatcttctcgtgtagtatacttttatacagaatatgcctgataaatttgacttctgactgtcatatatttgcttattcaatttaagatatttattgggctcctattctatgccaagcaaggcactagatattttacaaatgttatctgtgatcctaatattagtcctgcgaggaaggtactctttttctttttgtttttgtttgtttgtttgtttttgagatggagtctcgcactgtagcccgggctggagtgcagtggtgccatctcggctcactgcaacctccacttcccgggttcaagcgattctcctgcctcaacctcctgagtagctggggttacaggcacctgccaccacacccagctaattttttgtatttttagtagagacggggtttcaccatgttggccaggctggtctcgaactcctgacctcgtgattcgccctcctcggcctcccaaagtgctgggattacaggcatgagccaccgtgcctgcctggaaggtactatttttcatagttgacacagtagaaaactgaggctcaggaaaattaagtaggttgcccagagttatggaactagttaatggcaatcagtattcaaattcatgtctttctgattccaaagcatgcaattttttcactttgcttccgggaaaataaacataatagttaacatttattgagtaccatgtgccaggcagtgtgctaggtgctatacatacattagttttcatctttacagaagttacaagcttttttggggacacacagataacaaatgagttcaataaattggatgatgaattggttgagcactgggtgaacaaaccacaggacatattccctctctaaaaggcaaagttgcttcttagctccatttaccacagcaggcccgatgtggcatggtcttcccactttttcaagaaaggtaagaaatccaaagtgtgtgtgtgtgtgtgtgtgtgcacgtgcgtgtgtgtactaattttaaaatgatggtagcaagtccaaaatctgtttaaacaaaataaaacacagtgtgaaacaagcaaaacacatctacatgacacactcaagtagcaggccactagtttatgaatccaattttatagccaccctgaaaagtaggtattactgtctccattttacagatgagaaaaataagctcggtgatacaataagtaaatattgaggtcagggatgatcccagatctgcccaatatcaccaaaagtctacaatcttatcattatcatgtaacctgtacctgaatctggtttatttccatttcttttttaaaaaaatcctgggttgcatttaaaaaggtatcaaacagtatcaaacaaaaagaatccagcccaatgggactacaaaggcacctctataggaggcagctatggagaaaaagttgtacgtacttacatattttaagcttttgtttttaaacaagagttactttagcaaaatacttcttttagccatataattctgagcttgggaattaattctacttaccattcattttcttttctatattttgaagctatgtcatttaataatatgtttgcaaaggcttttgctttatttgtcaggcctgtcttcaaatcttcacaatccaaacgcaccatagtgtaatgaatccactgaggcaaaagcattatttctgaggcaagactgagaaatttttctataaacttgaaaaaaagtgttcaaatgaaaaaaaaaatgtttagaactttcagtgattttataatattgtattgttatgaaagtcctaattatataaatacaactttatttcttttttgctaagtgactaaaattttttcccttgttgcatacatatttttttcacctattctttcattaaggaatttgtcaatataccagtaaatatccaatacgataccattcacagtatcaaaatctgaacatatcacacggtaaaatttccctcaataattattttttaaaattatccccagagtcaacccatttctctgtttagaaacaaacttatatcatgtaacaatttgcatagtggataaatatttgcttttgccattactgatagctcattaaagattctatttttttcactttacgtccacatggtcaaggattctaattcaacctttaggaaaaatacatatatataaggaacttattggtttttgtcaaaatactccaagccaggcatgatggtttgagcctataatcccagctactgttaggaggctgaggtgggaggattgcttgagcccaggagtttgaggctgcagtcagctatgatggcaccctgcattccaggctgggtgacagggtaagactctatctgttaaaaatataatgataataatccaggaacagatgctctgcaattaccaagatccaagatattggaatgtatgtcaacttcttagtgcccaaacactggggtaattttttaaaattaaacaaagtagtatcaagaaaatctgacaggatatgtgatacttggtaaaagtgaaacacacttaccaactttggacaaactttgacttaatttcacaatccacctttaatgtttctatctgccttccttctcacttgatctccactctctactgaaatggcctgttccttttattcttccttcaggagaactttccttcatgttactctctctcaatgctgtcctatttttctagagtatctaggatgtggtgaattgggtttaaatttttcagtgttcaagggggaagataataattaattgattcaaagactatcttaagcacctgccttgttcttggttggaaatacaccaaataggccaggcgtggtggctcacgcctgtaatcccagcactgtgggaagccgaggcgggtggaccacctgagggcaggagttcaagaccagcctggccaacatggtgaaaccccgtctctactaaaactacaaaaattagctgagtgtggtggcacatgcctgtaatgccagctactcaagaggctgagaatcgcttgaacctgagaggtagagattgcagtgagccgaggtcacaccactgcactccagcctggaagacagagcgagactctatctcaaaaaaaaaaaaaaaaaaaacaacaaataaagggtagacagaactcatggcattgaaaaaagatgaatatggataaattttaccatgatgaaagaagaaaaacacaaaagaatatatacagtatgatacctttcatacaaacttaccgtggacaaaactaaactatattatttaagtatacacacataggtggtaaaaccataaaggaaagcaagaaatgtcagggtaatagttaccaataaagacagaagaaagttataattggggagaggcacgtggtggcttctgggttttgcaaagttctctttcttaagctacatggttattaacacctaggttataattacctatcggtctatacatatgtactatgtatgttatatttcacaattacattaaattttttcatggaacattttaaacatacaaaaataggtaaaatgtacccattatccagtttcaacaattagcaactcatgaccaatctttttttaactatactcctaactactcccctgtcctgttttatttttacacaaatcacaagcatcttataaattcatctgtataagccaggcatgatggctcatgcctgtaaacccccagcactttgggagactgagacaggaggattgcttgaagccaggagttcaagatcagcctgagcaacatagggaaacccccatctctacaaaaaaaaataataatttttttaaaattagccagccagcttgggcaacatggtgaaaccctatctctacaaaaaatacaaaaattagccaggtgttgtggcgtgtgcctgtagtctcagctattcagaaggctgaggtgggaggaacacttgagcccagaaggcagaggctgcgttgagccgtgatcacaccactgcactatagcctgagtgactgagactctgtcaaaaaaaaaaaaattagacgggcatggtggcacatgcctttaatccttgctacttaggaggctgaggtggaaggatcacttgagcccaggaacttgaagctgcattgagctatgctcacatcactgcactccagcctggacaacagagaccctgtctctaaaaaaataaataaataataggccgggagtggtggctcatccctataatcccagcactttgggaggctggggcgggcagagcacctgaggtcaggagttcgagaccagcctgaccaacatggagcaaccgtgtctctactaaaaatacaaaattagctgggcgtggtggtgcatacctgtaatcccagctactcgggaggctgagacaggagaattgcttgaacccaggaagcggaggttgtggtgagccgagattgcaccattgcactccagcctgggcaacaagagcaaaactccaactcaaataaataaataaataaataaataataaataagttcatctgtacagatgttacagttcatcattcttaaatttcccccaaaataggcatactaaccacaactatagtatatcagaaactgacaaagaaatccaggaatatgttactaaatctaaaagtaaatttttaaatagttatataaactatcccaaaattattacaaaattctagaaaatgtcactacaaaataatagacctaaggaaataatcattttcaaagttaatgaagccgggtgcagtggctcacacctgtaatcccagcattttgggaggccgaagcaggtggatcatgatcaggagattgagaccatcctggccaacatggtgaaaccctgtctctactaaaaatacaaaaattggccaggtgtagtggtaggcacctgtagtctcagctactcaggaggctgaggcaggagaattgcttgggcccaggaggtggagcttgcagtgagtagggatggcaccactgcactccagcctgggcgacagggcgaaactccatctcaaaacaaacaaacaaacaaacaaacaaacaaaactttaatgaaacatatacttggtcttgatatttaggacttatagacactacaggttatacccagaccacaaaaaatttagttggtaattcatagaacatttattgtgtctattctctgcatagcactatattgagatatatggtaaaatacaaattaaagagaatacagttggccctctgtatccatgggttccatatctgcagaatcaactaacagcagattgaaaatatttgaaaaaagccataaaaataacaataaaataattcaaataaaagacaatacagtataactctttatatagcatttatattgcattaggtattagaagtaatctagagatagtttaaagtatactggaggatgtgcataaattatatgcaaatactataccattttatatgagacttgagcatctgcagattttgatatctatacaggggtcctagaacaaatacctgcagctaccaaaagacaactatataccatccctgaatttgtgaaagtaataatgcatttatgcattcacaaaatagtttcatgaacccataaaaaccaaataaggtaaaaagtatgcatattagaaaaaaacacatagtcgtctcaatagctgccaaaaaagcattaaacaaactggtgtaaaggtagtgagttatctcatttgattgttcacagtcaatcacagatcaaactgcttgttctactctttcccctttctcattattgggtacttgaccagtcaaaaaaaaaaaaaaaaaaaagcatttaacgaaacccaacactctttcatggtaaaaacacaaactaggaatagaagataacatcctcaactttcataaggcatgtctaggaaaaacctacaactaatattatacttaatgatgaaaaaatgaacatttccctctaagatcaagaacaagataagggtggttcgtgcttgtaatgccagagctttgggatgctgaggcaggaggatcacttgcatccaggagtttgagaccagcctgagcaatatagtgagaccccatctctacaaaaaatactaaaattagctgggtgtgatggcacacgcctgttgttccagctacttgagaggctgaggtgggaagattgcttgagccagggaggtcaaggcagcagtgagcaggattctaccattgcactccagtctggataacagagtgagaccctgtcttaaaaacaaaacaaaacaaaacaaaaatgtgtactacattggctgggcccagtgtctcatgcctgtaatcctggcactttaggaggccaaggtgcatggattatttgagcccaggagtttgagaccaacctgggcaacatagtgagaccttgtctctactaaaaataaaaaaaaataaaaatttagccaggcatggtggcctgtgcctgtagtcccaggtaattgggaggctaaggtgggaggatcactggagtctgggaggttgaggctacagtgagctgagatcataccactgtactttagcctgggcaacagagtgagaccctgtctaaaacaaaacaaaacaaaacattgtactaaaacaaaacaaaacattgtactacaggtactagccagtgaaattaggcaagaaaaataagtaaaacgaactcagattagaaaggaagtaagacaatcactattacacatgacatgatattgtatacagaaaattcagggccaagtgtggtagctctcatctgtaatctcagcagtttgggaggctgaggcaggcagatcgcttgagctcaggagtttgagatcagcctaggcaacatggtgaaaccccttctttacaaaaaatacaaaagttatcccaccatagtggcatatgcctgtattcccagctagtcaggaggctgaggcaggaggatcacttgagcctgagaggttaaggctgcagtgagctgtgacagcaccactacaatccagcctgggcaacaaagcaagaccctgtctcaaaaaaaaaaatgttactagagataaacagagatattttaaaataataaaagggtcaatccatcagaaagatatgacatttacacatatatttgcacttaataacagagtaccaaaatatgtgaaacagtaaatgacagaaataaattatactttttcagtagattgattgtataatatgtgaattacttctcaataaagttgttttgtaaaataaaagctagagtattagaatcagtaaaaacttcagaataagaaatataatcaggggccaggcacggtggctcacgcctgtaatcctagcattttgggaggccgaggtgggcagatcacctgaggtcacgagttcgagaccagcatggccaacaggttgaaaccccatggctactaaaaatacaaaaacattagctgggcgtggtcacgggcacttgtaatcccagctactagggaggctgaggcaggagaatcacttgaactccagaggtggaggtttcagggagctgagatagtgccacattaggacacaaaaagtattaacctcactctagcctgggcgacaagagtgagactccatctcaaaaaaatatacatatatttacatattttgtatatattatatatatttttatgtatttatataatatataaatatataaatatttctttcaaagttgttataccatttacagtctcaccagattatatctgctggtgagattatatataaatatatgaatatttttatatatttatatattattttatatatttttatatatttatatatttttaatccttgattttatatatatttatatatttatatatattttaaacaatgtatttatatattttataaatatatatttttaaaatatatttttatatataaattttataaatatatttctatatttatatatattttatactattttatctatttatatatttatatattttaatccctgattttatatatattatatatatataagatcagggacttaaaaggttattttataataataaagaatgttcatcaagaaaacataacaatcctaaatatctatgtatccaaaaccagaaattcaatagcctgtggcaaaccgaatcctgtcaatgaccacttgagtgaacttggaatcattctgcccccagtcaaaccttcatgagaacatagccccaactgacagcttgactgcaactttatgagagaccttgagccacagggactcagctgatccaaggctggattcctgacccacagatactatgagataataaagtctggtattttaaggcactaaattttgggggtaattcaagtttatcccaggaaaacaacattgggttaatatttgaacatcaataaatataattcaaaatattaacagaaaaaagagaaaatccatatgatcaattaaatatatgccaaaaaatacttgacaaaattcagcgccctcccatgataaaaactcttggcaaacttggaatagaagggaatttcatccacatgataaagggcatctaccaaaaaccctactcttaatgtatttaatgacgaaaatctgaatatatttcccataagaccataaacacagcaaggatgccctatgtcactgctgctattcagcactgtactgtaaataaaaattgctattaaaaatactatttatggccaggcgcagtggctcatgcctgtaatcccagtacttcgggaggccaaggtgggcggatcacctgaggtcaggagttcaagaccagcctggccaacatggcaaaaccctgtctctactaaaaatacaaaaattagttgggtgtggtggcacgctcctgtaatcccagctactcaggaggctgagacaggagaattgcttgaactcaggaggcagaggttgcggtgagccgagatcttgccattgcactacagcctaggcaacaagagtgaaactctgtctcaaaaaaaaaaaatgctatttataagaaaatcaagtaaaccagaaacattttaagggacagatttaggaaaatatttgcaagagctgtacaatgcaaactataactacattgctgagcgaaattaaagaaggttcaaataaatttaaatacacactatggtcatgtattgaaagcttctatttcaagatggcagttctttccaaattgattcagagattcaatggaatcctaaccaaaatcctagctggcttctttaggaattgataggttgattttaaaatgtatatggaaatgcaaagcacctagaacagtcaaaataattttggaaaaaggacaaagtgggagaacttgcactacttgattttacaatttaccattgaactacagaaatcaaggcagcatggtactggcataagaacagatacataaatcaatggaaaatagagaatccagaaatagacccacagatatagggtcaattgattttcaacaaagatggcaagataattcaatgagtacaagatagtatttttgatatatgatgctggggcagctggatgtccacatgaaaaacacctgaacagtgacccatatcccacaccacatacaaaagttaacttacaatgggtcatagacctaaatgtgaaagctacaactataaaacttctagacaatcacatgtgttgtttaggaattctaagaaaagcttccagagtaaaatgtaggaacaaatctttatgatcatgcagtaggaaagatttcttaggacacaaaacgtatgaacctcagaagaaaaaaattgatagactagaattaattataatataaaatgtctgctctttgaaagacattgttataaaaataaaatgtcaaggcataaactatgagataatatttgcaaaactatttcagatacaagacttttacccagaatatataaagaattcttaaaactccataacattgattataacaatatagtccaataaaatacatccattatagctcaacaataaaacataaaaacccaatttaaaatgtacaaacaaaagacactttatttttattagtaaaaagatacacagatggaacatgacatgttaaaagatgctaaacatcattagtcatcagggaaatgcaaattaaaaccacagtgggataccaatatacacatgaaattaaaaagactgataatctagatgtgaaagtgcagtgggaaaaaataaaacaatagtaaaaagtaaaagactgataagcccaaaggttgaaaaggatgtggaagaactggaaatctcatacactgctggtgagattgtaaatggtataacaactttgaaagaaatttaagtttcttctgttttttgagacaaagagttttgctctgtcactcaagttggagtgcagtggcatgatcataactcactgcagactcgaactcctaggctccagtaatcctttcacctcagcctcctgagtagctgagactacaggtgcaagctactatgcctggcttaacagtttcttaaaaagttaaaaatacacttcccataccacccagcaatccagctcctagaaagagaaatgaaagcatatgtccgcacaaagacttgtaaacagaagaccatagtaactttattcataatagccaaaaactggaaacatctcaaatatccatcaaaacgtgaatgaataaagaaactatatacctatacagtgaaatactactaagcaataaaaggaataagttaggctaggcgcggtggctcacacctgtaatcccagcattttgggaggccgaggtgggcggatcatgaggtcaggaggtcgagaccatcctggctaacatggtgaaaccccatctctactaaaaacacaaaaaattagctggccatggtgatgggtgcctgtaatcccagctactcgggcggctgaagcaggagaatggcttgaacctgggaggcggaggttgcagtgagccgagattgcaccactgcactccagcctgggcaacagagcaagactccgtctcaaaaacaaaaacaaaaacacacacacacaaaaacaaaaacaaaagaggaataaactactgacacaaaacaaataaatctcaaaaactttatgctagtaaaagaaatcagatgcaaaagagtatgtatatatgattctatttatctgaaactttagaaaacaaaaacctaatctatagtaacagaaagcatgtcagcagtttcctgaggtcagagttggggagaattgaccaggatggggtataaggaaggtttctgaggtaggagaaatgttctacatcttaattctggtgatggttacgtaagtgtacacatttgtcaaaactcatataactgtacaattaaaatgggtacagtttattgtatgtaaactaaatgtcaagttgattttttaaagttaatttctcttgaaattaataaagaatttttaaaagggatggaatgacaaataaatatagcaaaatcctagaatgtaggtggtatgctttgtaaaattccttcaatttctctgtacaggctgggtgtggtggctcatgcctacaatcccaacactttgagaggccaaggtgggaggactgcttgagcttagaagttcaaaaccacctggggaaacataaggagacaccatctctacaaaaaaaaaaaaaaaaaatatatatatatatatatatatatatatacttcttaaaaaaattagccaggcatggaggtgtacgcttccagtctcagctactcgggaggctgaagtggaggactgcttgaacccgggaggttaaggctgtagtgagccatgatcatgccactgcactccagcctgggcaagagagtgagaccctgtctcaaaaaacaaaacaaaactctatatgtttaaaatttaagatgttagaaaaattaaaatgtataaagtatacattaaaaaatctaaacagtcaatagaaagggggaaaatgaagaaatatgccagttttaaccaatagaacaaggtcccttgaggaggtaggaatcttttttctttcaattgccttttccccactactatcagaattacctttttttttttttgagatggagccttactctgttgcccaggctggagtgcagtggcatgagctccgctcactgcaaccttcgcctcccaggttcaagcgatcctactcctcagccccccctagtagctgggattacaggcatggaccaccatgcttggctaattcttgtatttttagtagagatggggtttcgccatgttggccaggctggtctcgaactcctgacctcaggtgatccacccgccttggcctcctaaagtgctgagattacaggtgtgagccactgcacccagcccagaattatctttctaaaactcagatccgaatagattacttccacagcgaaaaaccttcagaacaaagtacaaactcttgagcaaagatactccaggattttcccatgtggctccaacttacatttcgaacttcatcatattctaaatcttccatgtactgtgtccctgttccctattctttaactattttcattcatttatattctctgaacaccctggttcatgctacatcccctcccttctccacctataaaatctatttcaaagcccaactcacatttcacttcttgcataatctcttcaccaatttcccaaagcaaacaacactttgtccatatctctattctagtacttatctctatagttgttatttccgtgtcaggcttccaggccaaatataagctcctgaagacagtgcttatgccttttttttaagacagtgtctcgccctgttgcccagctggagtacagtggtgcaatcagagctcactgcagcctcaacctcctgggctcaagttatcctcttgcctcagcctcctgagtaagaaggactacaggcatgcaccaccatacctggctaattcaaaaacaaaaacaaaaacaaaaacaaaaaaactttcgtagagacacggtctcactatgttgcccaggctggtctcaaattcctgggctcaagcaatcctcttgccttggcgtctcaaagtgctgggattacaggcatgagccaccattcccaccctttcatttatttttgcatcaccaaatcttgttaggtgtctgaatgtgataaggaaatttttattgaattaataaatgagtaaatgaatgactaaagaaattgtaaggtaagacaatgagttttactgaaatgatattttaaataagaaattctatttaagcatttactttttagaatggaaagatcctaatgttacaaaaaaattcaaaacgcattaataaaaacagaattaccgcttacctctgtatattcatcaaaagtatgatcttctgtctgaaaagtctctatattctcaactgcagtcccatcaaggagccaattatatttttcaactgaaaattaataatctaattaaaatctcaataataccctttttagaagataaaacactttttttatatgatcatggaatggggacctactcaattaaatattattattaatagagtattaacatacatgatttactatattttaagaaaatgggtagaataaaaggaaaccaagttaaacagacattttaaaacaaaggtattagagtatttgaggcttttaagaataacttaggggtacatatacaccaattaatagaagatattggttaatagaatgtcaaagaataaccatacatcctgacctcacacacacttgagaagactacagaccaataaaattgagctacaggctctttgaaactattctcagaaactaccttgcttttacccttgaattattcccaacatttcttctctctgcctttgactttatcaccctgctccagttcatatgcaccctttggactggacaacaaaatgtattgggtttgattcttttttttttttttgagacggagtctcgctctatcgcccaggctggagagcagtggcgcgatctcggctcactgcaagctccgcctcctgggttcacgccattctcctgcctcagcctcccgagtagccgggactacaggcgcccgccacgacgcccggctaattttttgtattttttagtagagacggggtttcaccgtgttagccaggatggtctcgatctcctgaccttgtgatccgcccgcctcggcctccctgggttggattcttgactctgccaaaagctacgcctatgctcacttctggctctccctgttctttcatggcagccccagacaaacaaacatctgaccaaattctagcacaaataaagtgatgacaaatggtataatattatgtatgtcatacacaccatatgtctcataatgctttcttgcaccttctaagttccgatgtactgctgccttcagtgtatcaacagcccagtgtaacacgtgttcaggaagttctgtgtcaagatttactggtgttgaagttcctgatagccaagaggggattgtttggacattctaacacaaataaaaataataacaatgtatacaataaatatctaactgtataattaatctatatgtagatctttttttttttcctttggagacggagtcttgctctatcacccaggttggagcgcattggtgcgatctcggctcactgcaacctccgcctcccaggttcaagcgattctcctgcctcagcctcctgagtagctaggattacaggcgcacgccaccacgcccagctaatttttgtatttttagagacggggtttcaccatgttggtcaggctggtctcgaactcctgacctcgtgatccgcccacctcagcctcccaaagtcctgggattacaggcgtgagccatcatgcctggcctattttttgtattttagtagagatggggtttcacagtgttggtaaggctggtctcgaactcctgagctcaggcaatccgcccgcctcatcctcccaaagtgttaggattacaggcgtgagccattgcgcctggcctatatgtagatcttatactatattttaaaacattcttttcagatttcaatggcccaagaaaaaataacttgacataaaataataatttaaaattgtatagtttgtagtctaacataaaacaagttgggccaggtgcagtagcacatgcctattgtcccagctacttgggaagctgaggcaagaagatcacttgagcccaggagttcgaggcagcagtgtgctatgatcatgtctgtgaatagccactgcatttcagcctaggtaacacagtgagaccctgtctcaaacaaaacaaaacaaaacaaagaaaaccttaagttgggttagttttctatcatccaacaaatatttattgactaattatttactgacaaataaatatttgtcaaatatttatttatttatttattattggtttttttttttttgagacggagtctcactgtgtcactaggctggagtgcagtggggtgatcttggctcactgcaacctccgactccctggttcaaggggttttcctgcctcaacctcctgagtagctgggagtacaggcacgcgccaccatgcccagctaatttttgtatttttagcagagatgaggtttcaccatgttggccaggatggtcttgatctcctgaccttgtgttccgcctgcctcggcctcctaaagtgctgggattacaggcgtgaggcactgcgcccggctgacaaatatttattgacaaagtaattatgccagaaagctctagaaagaacaaatatcaattagatcttgttcttaagaagctcacaactcagaggagatgagacatgcaaataaaaaaatcaattcatagctacaagaaaagttctaagaaggaaaatgtcatctccagccttcaagcgactttttcaaagagaaagcaatttctaatttgaaataattgggggaggaaaataacagaaagagtcataacattgtatgtacacatacactgcatagagattcaattcaaataatttaaaattctttcccgatgggtaaagatgtaatacctgcagagcttcggctattcgttccaccaaactcaagacattatcttccaaatcttgaaaggtaggataaaattccattttgtcgtcatcaaatgtcaattctatcttaaatattggcagcctttgttgatcttttgggtcaaagagttttacaaatccttctacagttctccttaatagatcctttagctgcgtgatataaatcactgttactttagagagtacaaattcaacctttaactaaaatcagtaaactgattataattgtctatatctgattataattgtctataattaaaacatcctatcaatccatttaattgaaaattatcttcattcagcatactatatatatgtgtgtatacatacatgcacacacacacacacacatatatatatacatatttttttttaagacagtgtctcactctgttgcccagactgcagtgcagtggtgccatcatagctcactgtaaccttgaactcctgggctcaggcaatcctcctgtttcagcctcctgagtagctgggactacggcgcgtgccaccacacccagctaatcagcatgatatgttcttattaatttttaatatttgtgggtacataataggtgtatataagggttacatgagatattctgatacaggaatgtaatgtgcaatagtcacatcagggtaaatgggatttccatcacttcaagtatttatcctttgtgttacaaacaatctaattatactcttttagttatttttaaagggatgattaaattatgttttgctgtagttacccagttgtgctagcaaatactaggtcttattcattcattcttttttcttttctttttttctctctttttttttcttttttctttttgtttgttttgtttgctttttgtttttgagacagcattgcccaggttggagtgcagtggcaagacctcgattcactgcaacctctgcctgctgggctcaggccatcctcccacctcagcctcctgagtagctggaactacattcacaagctaccacgcctggctaatttttgtattttttgtagagacagggttttgtcacgttgctcatggctggtctcaaactcctgagctcaagtgacccgcctgctttggcctctcacagtgctgggattacaggcgtgagccaccacactcagcttatccattctttccaacttttttgtacccattaaacatctccacttaccacaccccccaccccccgcccacttctcccactacctttcccagcctctggtaaccatccttctactctttatctccattagttcaactgttttaatttttagctcccacaaataagtgagaacacacattaacaaaggtaacctaaaacaataaatagaacattatatgcaaaccctaattttgtttttggttttggttttttggtttttgtttttgttttgagacagagtctcactctgtcggtcaggctggagtgcaatggcacgatcttgactcactgcaacctctgtctcccgggttcaagcaattctcctgcctcagccccctgagtagctgggattacaggtgcctgccaccacgcctgcctaatttttgtagttttagtagagacagggtttcaccatgttggccaggctggtctcgaactcctgacctcaggtaatccacccaccttggcctcccaaagtgctgggattacagatgtgagccactgcgccgagcctgtttctgttttttaagactgggtcttgctctgttgcccaggctggagtgcagtggcacaatcatagttcacagcaggctcgagctcctgggatcctgggctcaagcaatcctcccacctcagcctcctgagtagctgggacaataggcatgagccaccattcctggctaatttttaattttttttctagagacagtgtctcactttgtttcccaagctggtcttgaactcctgggctcaagtgatcctcccacctcagccacccaaagtgctgagattacaggcgtgagccaccacacccagccaaaccttaattttttaatagaatatcaacaatcttaaaatggtgactcagaacttttcacattctttagtaattctgtccctggtacagaaaatgttccagaagatcaaacaacatggtaaagactgaagggaggggaggtctgacagccagaggtaagtgtgtaatggggggacatgcacatggagtgaggtacagtgaaatgctagaactagctcctgttctctcaagagccaattgttaaatactcaagaattttgtgagccagttgctaaactcttagaagctcgaaatttaccactgtgggaatatttacaccacagaagtcgacaaacactacaaatcagggtaattatctttttcttttatttgtttattcatttatttatttatttacttatttatttattatcttgagacagagtctcactctgttgcccaggctggaatgcagtggcacaatctgggctcaccacaacctccgcctctcggtctcaaactattctcgtgcctcagcctcctgagtggctgagattacaagcatatgccaccacacctggctaatttttgtatttttagtagagaggaggttttgccatgttggccaggctggtcttgaactcctgagctcaagtgatccacctgcctgggcctcccaaagtgctggtattagaggtgtgagacaccgtgcccagcctcagggtgattttctttcctggagagccatatttctagcacactactgggtgaaggtaaagccactggaacttagaaacatgcacaaggagcttctaaagtacgaataatggtttcttatagagaaccaactgttgggaatttagcccagcaaacaaacatggttctaaatgatcttcaagacattcctcatctctttacttttattaaataatcacagtcctcttaagagggtaaaggtagaaaggaaaccatgtgtattagttacagcattacatactagatattaaatatgtatattatccttttaaatatgctagacaaaattcatggaattgttggaggtctttactgaaagggaaagtttttcttcaaaactatttttctagaattgtatatcttcaacagtaaaaatttgaggaggccataaatataatttcataaaattaaaaattccctatttgtcatttaaagatgatcaataactttaaaaattttttccaccagatacctcttatacaatgatcaataacattttaaaccaagattttactgagaacaaaatgagaatcaatcaacttggaatctaataaattcaaaaatatgttactagaatagttcttttgttaacatactccaaataaagctataattaacttatatatcctttaggcatgagccaagtaattactcataatactaatatatacttctagatttcctttcattttagatagtttcagaaacacaatatttttctgctaaaattattaaaataaaattacagtagaaatattttatttcaaaataattacttagcactatgtttacgtagaattctatttaaaatattgaactaattttaataacattatcatttaatatatataaagtgtatgtacctgatttgacataagtgtggaaacacagctataaaatgcatccaatttttcaggtttaacaccttctagtgcctccttcttggtaaagagatttataacctttggataccatgtattcattatcttctcttctgcgtttctagtttgtattgatagatcagttttcagtgattcacagtcaattggacctttagctctatttatgagaaaaagaaatgtgatttgaagcaaatgatacatattggtcttaaaacacaattgttgggccgggctcggtggttcacacctgtaatctcagcactttgggaggctgaggcaggcagatcacgaggtcaggagttcaagaccaacctggccaacatggtaaaaccccatctctactaaaaatacaaaaattagctgggtgtggtggtgtatgcctgtaatcccagctactcggaaggctgaggcaggataattgcttgaaccagggagacaaagcttgcagtgagccaagatcgcaccattgcactccagcctggatgacagagcaagactccatcacgggaaaaaaaaaacaaaaaaaaaaaaaaccaaaaaaaacccacacaattgttgaaacaaacaagatacatttttttaaactctaaaatctagagaaaagtgttgaagatttaggattccattttaaaaattatacagtcaaaaatatagactcaagcaaggagacattcaaattttaaattaaacgggattttacctaattcctgtgaagtccaacaaaactgtatcagcaaatgttgtataaccaaggtccagtaacattttcatagttggatgaataatgtgcaaattagagaatatttgatttcttgcctgcacatagctagaatgccaaggattagaataatctaggcctctggaaaagcaaaacaccatatcaaacatgatgaaaataatacaccctaaactttaggaaataatgcttataacatgaaattagtattgaagtgagaaaactggggcttgagaagagggagctgtggtcagcaatgggaaccttaagatatatgcatttaataaaaacacatcaagaactcaaaactgcattatcttcagagagaacagaaataatttgtgagtaaggcagagtgatgggccagatctgagagctctgctaacttccactgtgctttggctcagttatcctggtaaaaatgaaagaacacagtctttaggactaaagaaaagcgctggagaaatctgtctgccataccccaaagcttactcaaggctaagttaagctatgcattcataaagatctccccagttatgtatgcagaactaaatgagcatagtagagagaatacctctgaggtaaaaacaagagtactttttttttagatgtgttcaaaatacctttgagcatcacaattgtatacttgaaggtaagatcagtttattttttatctatatcaaaaattggatgaagtactgtttttaaaataatttactcacacaggagattcaggtaaaggacctccttcatcttcaagcgatttaactggtggtttcacaagaacgctctgcactaaaatacatggatatattaatgcttcttgaaaatctctgcacaatctattaatatcaaagtttctaacttttgattttggatggtatagtttactgtgcattaaaaggaatgtaagaaaaaactcctttatttgaaacaaaatcaagttcttggtagtattttggccttacttgagagttcagataacgaaaagctttaataagatctcagtttttcacattccatctactcaaaagtcactagcatggccacttaaaaaaatgcatttcatggtggctaccaggggctgggaggatgttggtcacaggctacaaaatttcagttagataggagggaacaagttcaagagattacgcgacatggaggccgagcgcggtggctcatgcctgtaattccagcactttgagaagccaaggagggcagatcacctgaggtcaggagtttgagaccaggctagccaacatggtgaaaccccatctctactaaaaatacaaaaattagctgggcatggtggcaggcgcctgtagtcccagctacttgggaggctgaggcaagagaatcgcttgaacctgggaggtggaggttgcagtgagctgagattgcaccactgcactctattctgggcgacagagtgagactccatcataaaaaaaaaaaaaaaaaaaaaaaaaaaaagaaagcaattatacaacatagtgactagttagtaacaatttattgtacccttgaaaattgtcaagagtagattttatgttcccaccacacacaaaaaatgataaatatgtgaaaaaaatgcatcagttaattagctcaatttagctattccacacatatttcaaaacgtattgtacatgataattatatacaatttttatttgtcaatttttaaaaaggaaaaaagtttattctaaaaaatagcaaagattatacccctaataaatctcccaaaacatattagtattttctagcaaacctataaatagtatagctaaaatcataaagacaaagtaaaaaatcaaagagaagttagctaataaaaaaaatacaaaaagtacccttaaattgtaaggattttgacttaagtatagactcaaaataaaaactttaaataaaaatcgtatctaagaaatacatatagttaaggctgggctgagtggctcagcgtgtaatcccagcactttgggaggctgaggtgggtggatggcttgagcccaggagttttagaccagcttggtcaacatggtgaaactacatctctaccaaaaaataaaaaaattagctgggcatagtggtgtgtgcctgaagttccaggtactcgggaggctgaggtaggggaatcgcttcaactcagcaggcggaggctgcagtgagccgaaatagcaccactgcactccagcctgggcgacagagatcatgtctcgaagaaaaaaaataaaaagaaaagaagaaaaaaaccagatatagtttaaatacatagtgttcattactcattttgcttatttctatttttgattcagtggggacggggggaggccaaggtgaaagaagcctggtgtgtgttagatgctacttacccaaatatctcttcatgctgttttcaaagtcacttgacacctcatttatgagactttcaagaagttcttctctttctttcccttcctttaaagactcaggtatcagccttaacatgtgatccagccattcctgctgaataggtactaaaggactactttctacacattgcttcatataaatatagttgaactgagaacataagaaaaaattaaatgttctgcatggttgtatcatttcagtgtaactcctgaactctcccttcctaagacaacattttttcagattaaaaatattctgaaaaataacattttcagaataaaaaccatttaatccaaaagtacatcccacaaagaaaccattttatctttttctttatttatgatgaattcttgccaaattaatattcttagtatggttttcattttctcaaggcaaaatgaagattctttacctaacttattattccttattatctaacttattattataatatatccaccgattcaacaaatattcagacattgttctaaatgctgggtatatagtagctgaacaaaacagacaaagcccatgctctcttgagattatattccagtacaatagtagtataatataatttcataaattctcccataagaatgaatagtctcactaaaaatagacacgaatgaatgaaaagacacttgatcttagtaaagacattttaacatcatgaaaatttcacttttcccaaaattgatttaacacaataccaataaaattatctacatacatttttatggaattagataagttgatcctaaagttcatgtggaaaaataaacatgcaagaatagccaagaaaaccctgagaaagaaaatctgcaatggagggctagccctaggagacattagaacataccagaaagcctggtgtagcacaggtgtatggatagacagaccagtagaaaacaacagaaagtccaaaaatacaccagtatatcagaaaatttagcatatgataaacatggcatctcaaatcactgggaaaaatatgaaggttttaataactatttctggaacaactggttagccatttggaaaaagataaaataattcataccttccaccatacataagaacaaactccaggatttaacttaaacaatgaaactatacaaggatcaggaagaaaaacatagatgaagtcttttataacttgagtataggaaaaaccttcctagctatgattcaaatactagatacaaaaaaggaaacaagtaatagattaatttttactacataaaaacataaatgtttgcataacaaaaacaatttaaaatgtcaaaagacaattgacaatctggcagaaaatatttgcaacatacatctcagacaaagtgtaaagaatgctttaaaatttaggggatgggtgaaccttaaggacattatgctaagtgaaataagccaatcacaagaaaacaagtattgcattattccacttatataaagtaaatagagcagttaaatttatagaaacagaaaacaaaatagtagttgccaggggctacagggaagaggaaatgaggagttgttatttaataagtatagagtttcagttttgaagatgaaaatgttctggagattcgctgcacaagaatgtgaaaatactactaaacagtgcttgctttggcagcacatatactaaaattggaatgatacagagaagatcagcatggcccctgtgcaaggatggacacaaattcgtgaagcattccatatttttgaaacagtagatgctggcgaggctgtggagaaataggaacacttttacgctgttggtgggaatgtaaattagttcaaccattgtggaagacagtatggcgattcttcaagtatctagaaccagaaataccttttgacccagcaatcccattactgggaatacacccaaagaaatataaattattctactataaagacacatgcacacatatgtttactgcagcactacttataatagcaaagtcatggaaccaacccaaatgcccatcaatgatagactggataaataaaatgtggtacatggccaggcatggtggctcacacctgtaatcccaacactttgggaggccgaggcgggtggatcatgaagtcaggagttcaagaccagcctggtcaagatggtgaaaccccgtctctactaaaaatacaaaaaaattagccaggcgtggtggcaggcacctgtaattccagctacttgggaggctgaggcagagaattgcttgaatccaggaagcggagattgcagtgagccgagatcgcaccactgcactccagcctggcaacagagtgagacttcatctcaaaaaaaaaaaaaaatgtggtacatatacaccatggaatactacacaggcataaaaaggaatgagatcatgtcctttgcagggacatagatgaagctggaagccatcatcctcagcaaactaacatagaaatggaaaaccaaacaccgcatgttctcactcataagtgggaggtgaacaatgagaacacatggacacagggaagggagtaacacaaaacaaagcccactgggggatggagggcaaggagagggatcctagagagtgggtcaataggtgcagcaaaccaccatggcacacgtatacctatgtaacaaacctgcacgttctgcacatgtatcccggaacataaagtaaaatttaaaaacttataataaaaaaaatactactaaactgtacccttaaaaatggttaagatggttttatgttatgtgtattttatcacaatttataaacatttagggggaaataacatcaaaactacaacagaaaaatgggcagaagatataaactaacatttcacaataaaaatataattaaaatggcacttaaaccatattttaaacgtataatcttattcataattacagaaagcaaatttaaactaccctgagataccatctgtcacatatcagattgacaaaaatttttttttaaatatgacccccacattcttttgtgaaactatggggaagcaaacactctcataaattgctagcacattttggaaagaaattttgcaatatctaataagactacatattgaagtcccacttagagaaattaaaacaatacctccagcagtatgaaagcatacatatacaaggtattcattgcagcaaaatactggaaacatttaagagtggctgatgcatacattcgtgttctgtgcagcaatagtgaaaaatgagaaagatctctaaaaactgatatggagcgatttctaggatacattattaagttaaaaacaaaatgcggccgggtgcagtggctcacgcctgtaatcccagcactttgggaggctgaggcgggcggatcacctgagatcaggagtttgaaaccagcctggccaacatggtgaaaccccgtctctactaaaaatacaaaaattagctggacatggtggggggaacctgtaattccagctacttgggaggctgaggcaggagaatcgcttgaacccgggaggcagaggttgcagtgagccgagattgtgccactgtactccagcctcggtgacagagtaagactctgtctcaaaaaaaaaaaaaagaaaaataaataaacaaaaaaaagcaaaatgcaagagtatctacagtatgacgcattttgtgtaagaaaacatacctgttcattttttaaaaaaattaaacacaggaaggataaatcaaaaattaatgagattggttatatgaaagagtagcttggaacagacagaaagtatgggggcatgggaacagggtggaagggatgggagatgcttctctgaggtgtacttttggtatagttctgattttaaaccttgctgttgttttacctgctcaaagtataagtaaaaaatatcatcatgaatgagggagaaaagaaactccaaatgaaaacaaacaaaccaatgaacctacctgaatttcaagttattaataattacctagctgaaaatgtattaataattacctattgaaaaggagtgtagaactaaccaatactgaacacaatattttaaccatatatccttatgctaagtacaaaagactataggtgaatattaaactatggtgaggtttgtttttcacagtagtatgagttagcaattttgaaattatttatgtatactctaggatttaacaaaataagtaaaccttgtggctaatggatgaaagccagattcctcactaatagagaaggaagctatgcatagagaaagggggacaggctagaataaaccctgggatgttactggaataggaggtatcagtatgaatccatgggttttgagagagagagagagaaataattattttctagatcttctgctgagaaagccaggaagcaatgacactcagtatcaaggagcacatttaacacacatatcatggtttttaaataccattctccactaaaaggagccaaaaatccctggagaaatgactgattacagggctagaatagaaaaagtatatatagcatgatcctggaacatcttattgtgccagaaagtaaggatgtgctcaaagaatgatgggatatgtaaaaaaaagacgaaagagtcaactttaagggctcccactggccaaatgtggaacaactgaacttcaaattaataataaagccaggccttgtggcgcatgcctgtaatcccagctactcaggaggctggggtgggaggatggcttgagcccaggagttcaaggcttcagtgagccatgatcacaacactgctctccagcctgggcgacagagcaaaaccccatctctacaaaataattattattaataataataatacattataacttaatagttaaagtaaaaatctatagtccacactgatctaaatgaatgaataagcgaagaaaaatattaaaagttctttcttactacagaattccaacaaaaaatgtaaaagaaatgatagaaaaattactatttggcaacaaccatagtaatcattgttacaggcaaagatgttaacattatgggaacacataaagcatacaggggaattctttgtactcttttttgcaacttttccgtatgtctaaaattattttgagataaaaagattttttaaatgtgtagcctagatggacattttttcttttgtctcttacttttattttttttcaattagttgctcactccaaaattcttacagaaagacattttctatgtccactccattaatgtactgcttagtctttttttttttttttttttttttttcttcagatggagtctccctccgtcgcccaggctggagtgcaatggcatgatcttgactcactgaaacctccacctcttgggttcaagtgatgttcctgcctcagcctcctgagtagctgggattacaggcgtgggccaccatgcccggctaatttttttctttttagtagagatggggtttcaccatgttggtcaggctggtctcgaactcctgaccttgtgatccatccgactcggcctcccaaagtgctgggattacaggcatgagccaccatgcccggcccatgtactgcctaatcttaaaattcttgtgtgatagtccccagtccctcactatatcaatgggctgacctctgtctagcaatgaaattggtcctctccctactccagctcttccctcctctctagatgatcttaataataagtgtcgccaattaccctgcaaaatcagaccaaagcctaagaatcatccttggttcctctttttctcactgcccacatgcaccctacctgcaagtcctgtcgcatttacatccaaaatatgtcctgaatctaacaatttctctctagctctattgctatcactctagtctaaactattctctctcacctagactgttatcttgtacaactacctggttcttcctttatacttttgccgtagccacaatccatcttctaaagaatctaagtggcctttttcatataattgtcaaagtgactttttatcattaaaagtaaatcaagttatgttatccccatgggtagaatcctccaatgacttccaattgccactctgagtaaaatccaagcaacttatcatagcctacaaggccctcatctctggctcctgacccccttttcaagtttattttatactttcccatgagctcaatcagcagctggccttctttcagttcctggaacatacccagttgttttctccttcaggtgacttaaacttagctgttccctctgttgggaaattctcaaccccaggtctttccacggctggctcctttctaccattcaggtctccataaatgtcaccacctcagggacgccttctctaaccacatgcctaatatggccccactccctcaccagtcactatctaccatattaccctgtatttccttcacagtacttatcacaattttatttattaaatgaaatagaaaaattttatttaattattatatgtcttcctcattaaagtataagcttcataagggcttatatgtccatcttgtccatcaatcttcagcatctagcacaggatcaagtatgcatagatatttgttaagaatctcatgaataaataaattatacagacaaagatgatattttctcaataccccaaacctatagcagttctagaaagcaggtcagggtcaagcactgaaatattagatagaaaactaagcttgaataaaattattatatgactatatagtgaaaggaaatttattgaatgtggtttttgttgcagaaaaaaagaaagaaaaaatgaaatttaaattcattattctaattatgtatctataacttatacctttctaaaaccatttcatctcctaaaataaaaatatgtttgacccttagaattaaagtatataatcttccttagcaaaacactatctaagtcaagtgatgtactttcaaaatttttcttgaaaactccctggcccagcacggtggctcatgcctgtaatcccagcactttgcgaggtagaagcaggtggatccctttcagctcaggagtgagagaccagtctgggcaacatggggaaaccccacctctacaataaataaataaataaaaattatccaagcgtggtgcctcacatctgtagtcccagctcctcgggaggctgaggctaagagattgcttgagcctggaaagcagatgttgcagtaagccaagatcactcccctgcacaccagcctgggtgacagagtgagaaactgtctcaaaaaacagaaaacataaaaaaaaaaactttctatattatgccctcactgtagtctcttcacacttctattataacagctgttacattttactgaacatgtgtttttatatttattcattcatcaatcattcattaagtaactatttttagtgctcgatatcatagtagttgattaagaagcaattcctggccgggcacggtggctcacacctgtaaccccagcactttgggaagctgaagcaggtggatcactggaggtcaggagtttgagaccagcttggccaacatggtgaaaccctgtctctactaaaaatataaaaaattagccaggcatggtggcatgtgcctgtaatcccagctatttgggagcctgaggcacaagaattgcttgaagccgggaggtggagggtgcagtgagcttaggttgccccactggattccagcctgggtgacagagcaagactactctgtctcaaaaaaaagaaaagaaaagaaaagaaagaaagaaaagctgctgttggctgctgtggtcaagataagagatgaagctctgatctaaggctaggacaagaaaatgactgttttgagaactatatagagctcttgggaactaagcatatgggagggaggtagttggggaaggggaacaagaagttcagattcagatattttaagcatgagtaaccggattgatggtgataacaactagaatagaaaatgtgcaagaggagtcttatggaggaagcttgtggtctcatttttttgacacgttgattctgaggtatttgtgcaaaaaagtctctgggagtcatcaatatatgaaaggtagctgaaatcagaaaaggagagaatcatccatggagattcaaggaaagagaagagtggctacagccagtcaagaaagaggaacctgtggagatgacagagaaataatagagaaccagatgaataaacataaaggaatgttagaaaggaaataaatggtcagtggtgtcaaaagtcagctgaaattgtcactgatttttatttcagccatcctaataggtatgtagtgaaaacgaatcaaggttttaatttgtattaccataacggctaatgatgttgaacatctttcgcgtgcttatttgccatccgtgtatcctctatggtaaaatgtctgttcatatctttctttttgggaggagggggtttaaactgcactttatttgttaccataacattcttttttaactgatcaaccgtaagcatgcaaaaagttctcctctgaatgaaactgattccacagcctgttgtatagaaatgggtaaattataaaggtgattcagtttggagttctctccttttttatagcactcctaagctatgtgtgcgacacataccacagaggtagaaaggatcatctttaataaattatcttcttaattgtagagaatttctgaaaataaaactgacaaaatgctaaaccaagcctttgatgtgtcccaaaggaccacagatccatcgactcctatttgaagaagtaatcccctggagtgttctagcctttgaagggcacttgataacaagatccaccaaggctctgaacaactgcactaagaagccttctaaccgctctcatttgccgattctttgggccacccagtcctgctggcagagagggcagcgattgttctgtttcacccacagggacatgcagcagttgcggaaggaatgattacattctcccaagaccacaacacagtcctcttgtttgttttcagcttgacatctgagacaggcatccatcacctggactctgcagatggcgcacatatctcactccacggcccagctccacatggccaccacgttccacttcttgagctagaacatcttgtcgcctcccgacttggagcctgcgctcctggagtgagaggtcagggcgtagggttcctcgccgtcttccacgtcggccatggtagcgccgcggagccgatggccgacgttgggttggggaaagccggaggctgtggcggctctgtggctacagcgttaccttatctttcttctacctattttcttttcctttcttttttgagacggagtttcgctcttgtcgcccagactggagtgcagtggcgcaatctcggctcactgcaacgtctgcctccggagttcaagcgatctcctgcctcagcacccctagtagctgagattacaggtgtgtgccaccacactcagctaattttgtatttttagtagcgacggtttcaccatgttggccaggctagtctcgaaccgcccgcctcggcctcccaaagtgcttggattacaggcatgagccactgcgcctgaccgtttttacccattttcttttcctttttatttttattttattattttatttattattattattttttttttgagacggagtcttgctctgtcacccaggctggagtgaagtggcaccatctcggctcactgcaagctccgcctcccgggttgacgccattctcctgcctcagcctcccgagtagctgggactacaggcgcccgccaccacgcccagctaattttttgtattttagtagagacggggtttcaccgtgttagccaggatggtctcgatctcctgagctcatgatccgcccaccccggcttcccaaagtgctgggattacaggtgtgagcacccggcccgtttttacccattttctaatcagattttttgctttcatactgctgagtttaaagagttatttatatattctagatacaagtcctttgttggatagccaattcgtgaatattttctcccagtgtgtagcttgttttttcatcctcttaacagggtctttcactgagcaatagcttttaattttgatgaagtctaatttactgagttttaaaaaattttctgcaggaggctgaggcaggagaattgcttgatctggggaggtggaggttgcagtgagccgagatcgcgccattgcactccagcctgggcgacaaagtgagactctgtctcaaaaaaaaaaaaaaaaaaaaaaaaaaaaaaaaaaaaattctggattgtgctttcgaggacatacctaagaactctttgcctaggctagatttttctaaaagttttatagtttatgtttatcctatgcctttttctaaatttttttatagttttatgttttacatttacacctatgatcaatttttagttaatttttgtacaaggtgggagctttaggctgaggttttttttattttatggatatccaattgctttccgccattcattgaaaagactattcttcctccactgaatgattttcgcaacttagtcaaaaatcagggggatggtggcatgctcttgtagtcccagctactcaggaagctgaggcaggaggatcacttgagcccaggagctcaagaccagtctgggcagcaaagagagacccctgtctctaaaaaaaaagaaaaaagaaaaaatcagctggctatacttgtgtgcgtctatttctaggtcatctattctgttccactaatcaaagttttttaaaaaagacaggtagaggctgggtgcggtggctccgcctgtaatcccagcactttgggaggccaaggtgggtggatcacttgaggtcaggagttcaagaccagcctggccaacatggtgaaaccctgtctctactaaaaatacaaaaattagctcggcatggtggcaggcgcctgtaatcttagctactcaggaggctgaggcagaagaatcgcttgaacccgggagacagaggtagcagtgagccaagatcgcaccactgcacgccagcctagctgacaagagggagactgtgtctcaaaaaagagacaggtggaggtccaagagagagaagtatagaaaaaatatcttttggccaggcgagatgtctcacacctgtaatcccatcactttgggaggctgagatgggtttattacctgaggtcaggagctcgaggccagcctggccaacatggtgaaaccccatctctattaaaaatacaaaatttaggtgggtgtggtggcacatgtctgtaatcccagctactcaggaggctgaggcaggagaatcactagaacttgggagatggagtttgcagtgagccaggatcacgccactgcactctagcctgggcaacagagtgagactccatttcaaaaaaaaaaaataaataaataaaagaaaaaatatcctttgaatttggcagttagtagttattgatgacattcatgatgaagtgatggaattcctagaagccatattgccaagagcagtgggctcaggagtgaatgactgtatgcctggctaggaacaatgaggatactaaacacatacacgcaaatattaaatacatttggcaatttgtacattaaatatttattaatgttttgggaatgttgtgtatcagtaattatacctagtaaaaagaaagatccacatccaaattctccagaaacgggtggccaggtaaggaggaagaagagcattttaaaaaccaaaaccaaaacaaggaaaagctaaaaagagtttcttccaaatatcctgaattcatagaggttgaattcacatcttcagcctctatcccccaaagtgaattttaagggacttgagaagcttataccccatctgaaaacatgctgcatgatttcctctttcacgtctccagttccatacgtttctgttatcctttgctagtaaagaaattttagatgtttttgtctttccaccaatcatatcataagtcccctgttgccactcatgcagtcagtgtcttttttttttttaatctctagcacctagcatttggcaagcacataacagattctaaatacatatttgctgagtggctactatatcattatatcaatattagaatactcaattattaccctaatgaaaaagagagatggagttcctttataactgccactttgagttttttttcagttgtttggaataagaatgaaaatatttacgtaattaatctgcaaatagtgaatgccaacaaaaatgtaattcttaaaacccatattggccgggcacagtggctcaaacctgtatttctagcaatttgataggccaaggtgggaggatcacttgagtccaggagttcaagaccagcctgggcaatatagtgagatctcatttctacaaataattttaaaaattatccaagcatggtggcatgtgattgcagtcccagctactcaggaggctgaggtgggaggactgcttgagcctgagtggtggggctgcagtgacccgagatcgcaccactgccctccagccttggtgacagagcaagaccttgtttaaaacaaaaaaacaaaaaaatctatattgccatattgttgttcatgacatgtttgctcccttgggaagagaaaataaaaacctcagtttctaaatttatttattttctagaatgggacttagcaggtggtcttagatgaaactactttgcaataatttctttgaacattttcaaacaagaaatataaaaacttgaactcactcctttttttttcatttcactggtcatctgtcaaaaacaaacaggatataattaaatcaaggagaacattttaaaattaatttaaattgtttaaaaattaaatatatagtttaaatatatctattattccttttaaaaacatcagttatattgagattgtcttaactacaaattaaaatgatataaggataaactttttaacgagaaaacataaacttacagtttgaggataatcaggtggtggtaatagaggtgttcttttacccagtgttctgtctaaatttcttttggctccatcaattctgaaatttatagttagaaatatgactctcttgataacattagcataagttactaaaacattacaatttaagcatttttccaactatactaagagatattcaagagttatcttactgaattttttatgagaaacaaatcccaatagacattatcaatgagaccttaatttttaaataatgcatatatatgtaacagggtgaaactaaaaatcaaaatcaaattttttcaagtataacttactgaccatttaaaaattaatcccaatgaatagtgggcacttatatgtattatctctgttcaaatgtctgccggtctgtcagagaagcctccccgtacccccatattaagtagtacctccttcgatatccatcctttttatcctcacttatcttgcttcaaagcacttaccatcgtttgatatagaatattttgtaaactgttttattcactgtggttatcctcagtgcctagaacagtacctggcacatagtagctgctcaataaacagtttaccttcaaaactgttaagagattttttttgcattcataagatataattttctctttaaattaagttgtataatcctattgtataatcccttaatctgtcaataaatatttattgaatccctatattatgtaaatcacaatactagatcctattaaaatataacaacaaatctcaaggactgatgaactgtttaagtgagaagaaaaaaacagagtgccatataggtaccctgtggttcagagaggggacaagttagttcactttcatctgtgaaggccacatacatgttaccattagcaatgagctttaaatgaaagagaggatttcaggtggagacatagttttcctgggatctaaaaaaacaaagaccccaagaaacaggaaggcaaggaaaggatcaaagggggaaaaaggaagcaggggtcgttcaatccacccaaaggtgacagtgtcaagtggagataagtctggagaagtggattgaaatatccagctaaaggcctcaaaaacaagctttttaatccaatagacaatggggagtaatcgagaggttttgagcatggaaacatatttaggaagacaaatctaatagtctataatgctagatatactagaagagatggccaaagaaaaaagcatacaagggaaattaaaagagaattcagaaaaaattgtagggtgtcaagtacgacaggaatgacgaaaaacaacaattgaatgagcaaaggagataccatcaggtaggtaagaggagaaacaaaaaaaaaaaaaaaaagaaaaaaaatctgaaggaaagggtgtccactggagctataaaaccaaagactggtaagtagcataaagacaaggaccatgtctattttgctcactgctctccccacaccacttaaatagtatccatgaagatgtaggagctcaataagcatctggtgaatgaatgatcagaatagcatatttggaaatgatcttgcatatctagtttggtaccttacctaatagatgaatcctctcagcaatatcaagctgtacccatggtactccaggggcacagcttgagagaaccatgagagtactgtgagatgggtggggatgttgaaagagaggtggcagtcatcactttattttttaaatttttgtgggtacatagtaggcatatgtatttatggattacatgagatattttgatacaggcatgctatgcataataatcatatcaaggtaaatagggtatccatcacctcaagcatttatcctttgtgttacaaacaattcaattatacttttagttattttaaaatgtacaattaaattatttttattatagttaccctgtcatgctagcaaatagtatgtcttattcttttttttttttttttttttttttgagacagagtctcactctgtcccccaggctggaatacagtggcatgatctcgactcaccaaaacctctgccacccagttcaagcaattctcctgcctcagcctcccaagtagctgggattataggctcaggctaccaggcctggctaattttttgtatttttagtagacatggggtttcaccattttggccaggctggtctcaaactcctgacctcaagtgatccacctgcctcggcctcccaaagtgctgggattacaggtgtgagccactgtgcctggccttttttctttttttgtacccattaaccatccccaattccctcctctcatcttccccactaccattcacagcctctggtaaccagccttctacaatctatttccatgaattcaaagagtttaatttttagcacccacagataagtgaatgactttaatttttagtgcccacagataagtgaaaacatgcaatgtttgtctttctgtgcctgccttatttcacttaacataatgaccatccatgttgttgcaaatgataggttctcattctttttttatggctgaatggtactccattatgtatatgtaccaattttctttatccattcatctgggttttttgtttttgttttgttttattttttttaggtaagtttattagagaagtaaagaaacaaaagaatggctactccatagacagagcagcccattcatctgtttatggacactgaggttgtttccagatcttttttttttttttttttttgagacagagtctggctctgttgccaggctggagtgtggtggcgtgatctcagctcactgcaacctctgactccctggttcaagctattctgcctcagcctcccaagtagctgggactccaggtgtgcaccaccacgcccagctaatttttgtatttttagtagagacgggtttcacccagttggccaggatggtctcgatttcctgaccttgtgatctgcccacttcgacctcccaaagtgctgggattataggcgtgagcactgcgcccggcctcttttttgttgttgttgttgttttgttttgagacagagtcttactctgtcacccaggttggggtgtgggtggcactatctcagctcactgcaacctccgcctcccaggttcaagcaattctcctgcctcagcctcctgagtagctgggattacaggcacccaccgccacacccagctaatttgtgtatttttatcagagacagggttccaccatgttggccaggctcgtctcaaactcctgacctcaggtgatctgcccctgtttgctattttcatgtcttcttttgagaaatgtctatttagatcttttgcctatttttaaatcagattattagtttttcttttcctatagagtttgtaataggccattcttgcattgctataaataactaagacaggtgtggtgactcatgcctgtaattccagtcctttgggaggccatggcaggaggattgcttgagcccaggagtttgaaactagactgggcaacacagtgagactttgtttccaaaaaacaaaaacaaaggaaattttttaaaaagagagaaatatctgagactgggtaatttataaagaaaagaggtttaattggctcctggttctgcaggctgcacaggaagcatagcagcatctgctgttggggaggcctcaggaagcttataatcatggtggaaggtgaaggaagagcaggcatgtcacatggcgaaagcaggagcaagagcaggggtgggaggcacactttgaagcaaccagatctcacgagaactcactatcatgaggacagcatcaaggggatggtgcttaaccatttatgagacatctacccacatgatccaatcacctcccaccaggcctcacctccaatactgaggaatacaattcaacatgagatttcagtggggtcacacatccaaactatattagagttgttagagctctttatatattacggttattaatcccttgtcagatgggtagtttgcaaatattttttcccattctatgggttgtctcatcatgttgttatttcctttgctgtgaggaagctttttaacttgatatgatcccatttgtctatttttgctttggctgcctgtactcgtggggtattactcaagaaatcttttcctactccaatattctggagagtttcacccagtgttttcttgtagtagtttcgtagtcttagatttaagtctttttttaatctatttattttttttgagacagagtttcgctcttgttgcccaggcgggagggcaatggtgcaatctcggctcaccgcaacctccgcctcctgggttcaagcgattctcctgcctcagcctcttgagtagctgggattacaggcatgcaccaccatgcctggttaattttgtatttttagtagagacagggtttctccatgttggtcaggctggtctcgaactcctgacctcaggtgatccacccaccttggcctcccaaagtgctgggattacaggcgtgagccactgcacccggcctaggattgttttttctatatctgtgaagaatgtcattggtattttgatagagattgcattgaatctgtagatatttggggggtagtacagacactttaacaatattaattctgctgggccaggcgcggtggctcacgcctataatcccagccctttgggaggccaagggggggggatcccctgaggtcaggagtttgagaccagcctgaccaacatggagaaaccccatctctactaaaaatacagaattagccaggtgtgatggggcatgcctgtaatcccagctactcgggaggcttgaggcaggagaatcccttgaacccgggaggcggaggttgcggtgagccgagatcatgccattgcactccagcctgggcaacaagagctaaactctgtctcaaaaaaaaaaaaacaatattaattctgccaataaatgaacatggaatatctttccattattttctgggattttcaatttctttttttttgagacggagttttgctctttgttgcccaggctggagtgcagtggcatgatcttcgctcactgtaacctctgccatctgggttctaagcaattctcctgtcttagcctcctgagtagctgggattacaggttcccaccaccataccagctaatttttgtatttttagtagagatgaggtttcaccatgttggccaggctggtctcaaactcctgaccacaggtgatccacctgcctcagcctcccacagtgctgggattacaggcgtgagccatcgcgcctggccgatgaatgacctttttaatgtgtcgttgaatttgttttgctagtattttgttgaggatttttgtatcaatattcatctgtgatactggcctgcagtttcctttttttgatgtatctttgtctggttttggtatcagggtaatactggcctcaaaaaatgagtttggaagtattccctcctcctctatttttcagactagtttaagtagcattggtattagttcctctttaaatgtttaatagaattcagcagtgaagccataagggcctgggctttttttgctggaagacgttttattatggcttcaatctcattacgttattggtctgttcaggttttggatttcttcatggttcaatctctgtaggttgtatttgtctacaaatgtatccatttcttctagatattccaatttattggcatacagttgctcatcatagccactaatgatcctttgaatttctgcagtatcaattgtaatgtcttctttttcatctctgattttatttatttggatcctctctctttttttcctagtctggttaaaggtttgtctattttgtttaacttttcaaaaaaatcaactttctgtttcattcatcttttgtattgttttcttcattccaatgtcatttatttctcctctgatctttattatttcttttcttcagctaattttggtttggtttgctcttgtttttgtcatttgttaagatgcatcactaggttatttatttgaagtttttcttctttgttgatgtagacacttatagctataaatttctcttttagtactgctttcactgtatcccataggttttcatatgttgcatttccattatcatttgtttcaagaaaattttcaatttccttcttaatttcttcattgactcactggtcactcaaaagcatattttttaatttccatctgtttgtatagtttccaaaattcctcttgttattgatttctagttttattccattgtggtcagagaaggtgcttgatattatttcaaattctttgaatgttttaagttcaattcaaattttttgaatgtttaagctgggcatgagtcaccatgcccagccagtaataaaactctacacaccttgatttcatccccctgctttttaactttttgttgtttctatttatatcttattatactttctatgtctttttttttcttgttacagaacaataaacacctttattacataagcaaatacagaaaggatgaggatttatttgcctttctgggccttgattttccaaagataaaactccaactcccaggcctctagcacatagccatctgctgggccacactgctctggccttgatgtgatacatgccagatgcttgccctgctggaactgctcctccagaagactgctgattttggcattctttttcctttcatcatatttcttctaaatttttttagattgttttttgtttaaaatctcttcctcctcaggagtcagcttggcccccttcttgcagcccagggacaatgtatagtgggattttcaccactgtcagtagagtgtgctgtcactgagcacgatgcagttcttcaatagcatcttggtacggaccagtttgttattggacacactgtagacaacattgatgatccttgttttgcacctacatcacttggagccccaggagaaattccccacatccagcctcaaggtacagtatttcttgttacgtccctgcacacagactgtgtggacgcagcgggggccaatcttggtgttggcagcggggcactccagctcatacttccacttcttgtgggagggcttactcttgcccctgtcttgcagcacttgtgccagttgtcacgagagcccattgctcgacatctgtactatgtcttgaaaaattgttattgttttgattggttcatcttttagtctttctacttaagagtagtttacacaccacagttacagtgttataatattctgtgttttttctctgtacttaatattaccactgagttttgtactttcagatgatttcttgctgctcattaacatccttttctttctgattgaagtaccttctttagcatttcttgtaggacaggtctgatgttgatgaaatcctttagcttttgtttgtctaggaaagtctttatttctctttcatgtttaaagcatattttttccagatgcagtagtctaaggttccttcagcactttaaatatttcattccactttctcttggcttgtaaggtttccactgaagtctgctgccagacatactggagttccattgtatgttatttgtttcttctgttgcttttaggatcctttctttatctttgagctttgggagtttgattattaaatgccttgaggggccaggcgtggtggctcacgtctgtaatcccagcactttaggaggctgagggaggtggataacttgaggttaggagttcgagaccaacctggccaacatggcaaaaccccatatctactaaaaatacaaaaaaaatatctgggtgtggcggcatgtgctgtaatcccagctactcaggaggctggggcagaagaatcccttgaacccaggaggctgaggttgcagtgagctgagatcacaccactgtactctagcctgggcgacagagcaagactccactccatctcaaaaaaaaaaaaaaaaaaaaaaaagccttgaggtcatcttctttgggttaaatgttaaatctgcttggtgttctataatcttcttgtacttgaatgtcaattatctttttctaggtttgggaagttctctgatattatctcttggaataaaccttctatcctgtctctttctctacctcctctttaaggccaattactcttagatttgccctttggaggctattttctagatcttgtaggcatgtttcattcttttttattcttttttgtctcctttatgtattttcaaatagcctgtcttcaggttcactaattctttctgcttgatcaattctgtaattaaaactgctattaaaagaacgctgatccattcttcagtatttcaattgcatttttcaactccagaatttctgcttgatttttaattatttcaatctccttgttaagtttatctgataaagttcgaaattctttctctgtgttatctcgaatttctttgagtctccacaaaaccactattttgaattctctgtctgaaaggtcacatatctttgtttctccaggattagttcctggtgccttatttagtttggtgaggtcatgtttttctggatggtgttgatgcttgtagaagttcttcagtgtctgggcactgaagagttaagtacttattgcagtcttcgcagtctgggcttgtttgtgtctgtccttgggaaggctttccaggtatttgaaggaacttgggtgttgtgatctaagccatatctgcattagggggcaccccaagtccagtaacatcatggttcttgcagactcatagaagtatcaccttgtggtcatggataagatccagaagtattctctggattaccagacagaaactcttggtttttttccccttactctctcccaaacattcagaccctctctctgtgtgctgagctgcctggagctggaggtgggatgacacaagcactgctatggccaccaccactcaactgtgctaggtcagatctgaagccagcatagcactgggtcttgcccaagacccactgtatccactacctggctaccacctatgttcactcaaagccgtaggtctctacaatcagcaggtggtgaagcaagacaggcttctgtccctccctttcaggaggtgagttccccaagccccaggtgggtccagagatcccaactgggagctagggactggagtcaaaaaccttagaaatctacctggtgtcttattatactgctgctgggctagcactcgaaccatgagactcagtccttcctacttttccctcccctttcacaggcagaggagcctcaccccacggccaccaatgtcacaggcccatatggatcactgccaggctactcccaatgttcacttaaggcccaagggctcttcaatcagtttgtggtgaatgctgcgtggcctgggactcacccttcagggcattgggctcccctctggcccagggcaggtccagaaatgccatccaagagccaaggcctagaatcagggaccccaagagcccgcttggtgctctaccccactgtgccctacctgctacctaagacgcaaaacaaatttccctttactttttcctctgcttttttcaagcagatggcatctgtcaccatagccaacagggctgtgaatgtgcttggcctaacctggataatttcagacaagccagcatgcctcagagtctcactcaaggcccacagtgtactacctgagtattgctgatagttattcaaggcccaagggctctttagtcagtaagtgatgggtcctgccatgaccgcatccttcccttcaaggcagcaggttcccttctggccaacgatgtgtcaataaatgtaatccagaagctagggcccagaatggggttctcatgactctgcctggtgccctatcctagtgtgactgagcgggtatcccagatgcaagacaaaattctctttgctcttccctttcctctcttcatgcggaaggaagggtctcttttggagctgcaaactgtgcagcctggggttaggggttaggaaaggagtggcacaagtactcccttaacagcacctgctggtgtctcagtaggtcatgtgcccctgcagtccactggatctgagctcagctcagcactaggacttacctaggagttgcagtccttgtggcctagactgcctttcaagtttatttagggccccagggtactttagcactccatgataaggcttcccagaactcaagttctgatcactgggatgtgcgattcccctctggctggggctggcctatatgctccctctgtgggcaggcatcacctgagttcagctcagttttgctttccactgtgacaaggcagcattgagttcaatgcaaagtctcacaatcactgcactctccatccccaagtgcacagattctctctccatgccatgcagccactgctgggattgggggtgattggtatcagcaattcaagactctttcctgccctcttcagtgcctttcagtaatatgaagttaaaacaaggtattgtgagttctcatctgattttttggttcttatgaaggtgtttttttgtgtgtagaaaattgttaaattttgtgttcctgttgaggggtatgttcagtggagccttctattataccatcttgctctgttcccccaccccaccaccaccatgatcactttctgaggtagcccaatttattgttagctagctttttttttttttttttttgagacagagtctggcccagttgcctgactgaagtgcagtggtgtgatctctaatcactgcagcctccacctcccaggttccagtgattctcctgcctcagcatcccaagtagctgagattacaggcatatgccaccatgcccggctaatttttgtatttttagtagagatggggtttcaccatattggatagtctggtctcgaactcctgacctctggtgatccacccgccttggcctcccaaagtgctgggattacaggtgtgagtcactatgcctggccagttagctcatattcttagaaacaaatttcttatattgagctgtatgtttgtaacttctagtctctgaagctatacagaaaaaagtcatattctttgttcatgtttacttatctggttcctttaattattcctgtcaatgaattactgtttattatgagtttattatgttttaggcataggcttaagatctttatatgcatttaattctcacaacattcctaaaacatacacactatttctatctccatattaccgataggaacatgaagataaattaggtaacttgccaaattcacatggttaataagctgcagagatggtatatgaactcaggcctgattgatggcagagcctatagtctaattaagtgaatcagcttccttcaaatttcctcactctcctcttgctatggtttaaatgtgtcccccaaaagttcacgtgttggaaacttaatgcctctgtcctcatgaatgaattaatgggttaatgagggctgtgccctcatgattggatcaatgtcactatcaaagaagtgggctcattatcattggaatggctttgttataaaagcaagctctctctgactgtcttgccctctcaccatgtgatgctttccatcatgttatcactcagcaagaaggcccttacaagatgtcagcactatgctcgtgaacttcccagtctctagaactgtgagctaaataaacctctattttttttatattttattttattttattttttatttttaagacagagttttgctcttgttgcccaggctggagtgcaatggcatgatctcggctcaccacaacctccgcctcccgggttcaagtgattctcctgcctcagcctcccgagtagctgggattacaggcatgtgccaccacacctggctaattttgtatttttagtagagatggggtttctccatgtcggtcaggctggtctcgaactcccaacctcaggtgatcctcctgccttggcctcccaaagtgctgggattacaggcgtgagccaccacaccccaatttttttttttttttgagacagagtctagctctattgcccagctggagtacagtggctcgatctcagctcactgtaacctcggcctcccgggttcaagtgattctcctgcctcagccacctgagtcgctgggattataggcatccgccaccatgcttggctaatttttgtatttttaatagagacggggtttcactgtgttggccaggctggtctcgaactcctgaccttgtgatccacccaccttggcctcccaaagtgctgggattacaagcatgagccaccacgcctggcctaaacctctattctttataaattatccagtctgtagtattcagttatagcaataaaaaatagactaggatacttctgtagctattctagtttatcagtgtccctctttttatttttattttatatggaacacctcacaaatttgtatgtcatctttgcgcagacaccttactaatcttctctgtattgttccaatttttgtgcatgtgctgccaaagtgagcactcaaagtccctcttaaagtgtgatcccagaattccatatgtttgaccagtgcagagtgaaaattttctctcccatttcctagacatgctacatttattaaagtatcctaaaactgaattagcctttttgagcagcctcatttccctgttcaatcttactaagcctgtactaaactaaaactcctaagactttctcacatgaagtagaaaatgtgcctggatatcctcctcctttctttgttaatcttcaagacgttggccaggcttcccttcatccatcatttctccctaaagagtctagctctcagtgattgctacttccaaggaatttaccttatactttggtatgcactagttggcactagtcatagttagccttgcactgtaattatcccaacataaatatgcctgacttccggttctttatatatgaatgccaccctttaacatagcaacaatttctggagcatgttttctcctactggctataaataaaaagagctgggaagaacatacaagtgagccttttcactacctgactgtttttgatttgtatattagcgattataaacaggccgggtacagtggctcccagcactttgggaggccaaggcaggtagatcacttgagttcaagaccagcctgggcaatatggtgagacctcatctctacgaaaaaatacaaaaattagccaggtgtggtggcgcacacctgtagtcccagctactcaggaggctgaggtgggaggattgcttgagccaggaaggcagaggttgcagtgaacagagatcgcaccactgccctccagcctgggcaaaagagtgagaccttgtctcagaaaaaaaaaagagggggtggcaaaaacatgaataatcatagctaaactaaaaaattttgtaataaaatcaaataaataaaaacttgataatttcaaatgactgggtgagaaaccacatgcagtaaaggagagaaactggcttgaatcaagagatgaggtagtagctaaggaagaaggcaggctcattcttgagactctggaaagctacaaaatgatactggctcagccaagcattcccagggactggtcctagtagggggtccacttctgcccatgactctttacatcctacctcaccccaggaactccctctatccacagacttcactccacctttgaaaaagagaagtctgcgctcctgtcatctaacaggtgcagatagcaaggggatggagaatcccaaagtccatggccacccagaaagatatgtttgcagtttttttaaaaaacctttaattttatcaggtattttttaaaaaatggtttctaaaagtttttttttttttttgagacagagtcttgctctgtcgccaggctggagcgcagtggcatgatcttggctcactgcaacctccgcctccagggttcaagtgattctcctgcctcagcctcccgagtagctaggactacaggcatgcactaccacgcccagctaatttttgtatttttagcagagacggtgtttcaccatgttggccaggatggtctcaatctcctgacctcatgatccgcccgccttggcctcccaaagtgctgggattacaggcgtgagccaccacgcccggctgaaagtttttgcattagacctttggacagctaaaaatgagtttgaaatccaaggagaataaaccaaatatacttaaagtttttgaaagtagcgaaaagaaacacacacaagataaagttagttttcaaagaatgagcttattaataaggagaaggaaaaaaatgaagtggaattcagtaagaggtaaagtttagcaaagtgagcgctgactgaagtaacattttttttcttttaaatgaacctaacattgtgaacatatccaggaaaataaaacaaaaccaataattcaaaatgcatttttcccaaagaaatgcctagcaattctaatctcagtattaatacagcactatgcttcaggtaattttgaggcagtgtttttaaattaagcaccaaaataaaagttgtactacttacagatctgtataaagcacaataaaggcaaggttcttccctaaaaattcattcatcccttcattcattcatcaacaataacatgccaaaccctttgatttgtgttgagatccctctccttaagcatgtcaaagtggagaagacaacaaagaaaataaaagtacattgtgttataacatactctgtgcttatgacatcctgctcttctgcttttcctcctgccttaccagttatacttacactacctgctggttgacttttctccgcacatctaaccttttgccctaggcctttgcctttctcagttcacttgctcacttgcgctctctcctgtgttctctcttgcctaactctcactctcgctctctctgtgattccaacaattccctatagctttaaaaatcatctacatgctggtgactcccaaatttttacatctccagcctagacttcttctcttatatatccaactgctattaatgtatttccctttaaatgttatatggcacttaagctccaaaagagaattattgctttttaccccccacctcctggacttcctcaattctctataaatggtactactatccacctagctaccaaagctaacccaacagccaatcctactgattctgcctctgacacacatctcttgtaaacctactttcctcctccactgtctccagccttatccaaaccaccataagttctcatctatgctactgtagtggcatcctccctggtctctttgtgtccccctattcctgccctcttcctctccacctcagtctattcttaatagccagagtgatatcttttaaatgtaaatcaggtttcatgtcacttccttgtttgaaacatttcagtagtttccactggacttaaaaataaaatctgaattctttgtcatggccgacaaggccctacactatctgctcccacctccctctccatcttcacctgatactacccttccccaggttcatgatactctagagatgttggtctttgtcagttcctagaatgtactgaaagcattcacatttcagggatttcatgcttgctatcccctttgctagagagcttttctcatgtttacttagatgacagtcttcttctcattctctggatctctccttacatattacctccacaggcctttcctgtggtgctcctgggaatatcttctctctatcccactgtcttatttctttccttttccttttttttttttttttgagatggactcttgctctgtcacccaggctggagtgcagtggcacaatcttggctcactgcaacctccgcctcccaggttcaagtgtttctcctgcctcagcctcccgagtagctgggactacaggtgcctgccaccatacccggctaattttttgtattttttttagtagagacagggtttcactgtgttagccaggatggtcttgatcttctgaccttgtgatctgcccgcctcagcctcccaaagtgctgggattacaggagtgagccaccgtgcccggccccactgtcttatttcttcgtagcatctatcatcatctaaaaggttaacatgacttttttgttttttacatatttactatctgtttcctctcactagcatacaaacaacttaaagacacaatcctttctgttgtgttttcttttttcttttttttgagatggagtctcgctctgttgccaggctggagtgcaatggctcgctctcagttcactgtaacctccacctccccggttcaagctattctcatgtctcagcctctccagtagctgggattacagatgcccgccaagacgcctggctaatttttgtatttttagtagagacagggttttgccatgttggtcaggttggcctcgtactcctgacctcaggtgattcacctgcctcggcctcccaaagtgctgggattacaggtgtaagccaccgtctgttgtgttttctatggtctcctcagtaacaggtatctgtgtaacagcagatacttactatctgctaaataaactgttgtgagagaaatgcgtgcatgaaagggattaggagaaggctttctagaggaggtgatccataaactaaacctggaagaacaaggataagtattcaggcagacagtgcagtgagggaaattgcagagcgtatctctaaactgtgaaaaatacagtatatttgtgaaactgcaagcagttcaacatgataatgcaagataatgaaaagttatggagtaaaaacaatctaggcctgatgcagtggctcatgcctgtaattccagcactttgggaggccaaggcagatggatcacttaagcccaggaatttgagaccagactgggcaacatggcgaaaccatgtctcttcaaaaatacaaaaaattagccaggtgtggtggtgtacgcctgtagtcccagccacttgagaggctaagatgggaggatcacgagagtccaggaggttgaggctccagtgagctgagatcgtgccactatactccagcctgggtgacagagcaagaccctgtctcaaaaagaaaaaaaaaaaggaacaatgtataattcctagagaactcccttctctaaatctactgaaacactgaatagaatcttaggaatgaaggaggaatgcatctctccccctcccttttatttttttgagatggagtctcgttttgtcacccaggctggagtgcagtggtgtgatctcagctcactgcaacctccccatcccaggttcaagagattctcctgcctccgcctcctgagtagctgggattacaggcacctgccaccacgccaagctaattttttgtatttttagtagagatgggtttcaccatgttggccaggctggtcttgaactcctgacctcaggtaacccatccacctcagcctcccaaagtggtaggattacaggtgtgagccactgcacccggcctctctttttcttttaagactatttttgtctgcttgtttgagatagggtctcatgccattgctcattgctgggagtgcaatgatgccatcacatcttgcacactacagctttgacctcctgggctcaaccaatactcctgcctctgcctcccaagtagttaggaccacaggcatgccccaccacacctggctaatttttttttttttatagcgatgagggtctcactaccttgctcagactcatctcaaattcctgggctcaagcaatcctcccactgtggcctcccaaaatgctgagattacaggcatgtaatcttttttttttttctgtctaagtcttgaatacttaagcatctctaatagtacatatactgatattagtttatataccctataaatgtatatttaaatatgagtaaattattgctggactaatacaaatgtaaatctaaagaaggtatatgattaatagacctgtttaattgtaaggaaagtaaaattagcaaaaattaaaattattaaattggcaatgatacttagctgcaaaaaaaggtttttaaataaggccgaccaagaaaggaaagagaatgtagaaagggaaacagaaatccaccaaagagaaaacctcattttatagtttaagtgttggcttggaattttgtaaatgaaatccatgtatttttctttttatttatccctagaaaccagcagaatcggctgtctaggaaattctcagtaactgtctaattgaactgaaccaacctcatcacagcctttggcagcaggtacccaaattagttttaatttccactaaactggggggggggggggcggtgagtaggatgttgaactctgtttccttttgtagcaaaaaaatttcaaatataagtagtttcaagatattttattaagtatttgttcaaattgtaggggttcagttatttgattttactttcagggaccagtatggttataatatattgaaaggaggaataatgtggtgcttaaagaatgtgaactttagaaccagaccaaccaggtccaaatcccagctgtgcaaccttaggcaagttacttaacttctctatacctcagtatactcatctaaacaatggagctaacaatagtacctaccttataggattgttgcaagaagtataggcgataagaacaatgtctgtcagtgtacagtgtataatatttgctaccattacaattacttttcaattgtttttctaattaacttgaaaatagtattttacccatgaacaacctccacagttaaaactttttaggagaatatgaacactaatcattttacttgaattccaagcaagaattatctactaatatgctacttacactaactgattaattttctgctgctgctccttggatcttctgtattttagcagcttactttgtgttggtgtatcaacgcctatgttttctgggagatggacaatggggggtaacttcaagttcagagcttccttttctgctgcaatggcagctttgtttgcatctgacatcttgatcccctaaagattaaaatactctgtactctgaggagaaaaagtccataaagccattattatgtcagcaagcctcgacacattcataacatatctaacatatcaataccaaaagtaaaattctagacacttttggatcttcctcccaagtatggtattagtctaaagaatgacagttgaggtaagttggcagggattcctgttagaactctaaaactcacttatgaagcaatgagccagtcagttccccttcagggcttgtttcctaatggatgaaactaaggaattgaattagatgctctgtaaatatccctacagctgtagcattctgggtgcaaaattttcccgagatgcaaaccactaccaccaccaccacaacaaatccagttgttgagggatgatccccttcccagtaaaagctgatatttaacatcattaatggtttttttttttttttttttttttttgagacagattcttgctctgtcgcccaggctggagtgcaatggcgcgatcttggctcactgcaacctccgcctcccaggttcaagtggttctcctgcttcagcctcccgagtagctaggactacaggtgcgcaaccacgcccagctacttttttgtgtttttagtagagacagggtttcaccatgttggccaggctggtctcgaactcctgacctcagatgatttcccgcctcggtcccccaaagtcctgagattacaggcgtgagccaccgcccccagccaatcattaatatttttaaacatcagtatgatatcttagtcttgctgccttccaagaaagtgatgctatgatcaagcaaaaaataggcatacttgatgcatggcaaatataaaatgtcatgtaaatgctcaaaaattttactgtgggccaggcgcggtggctcacgcctgtaatcccagcactttgggaggccgaggtgggcggatcacctcaggtcgggagttcgagcccagcctggccaacatggtgaaaccccatctctactaaaaatacaaaaattagccgggcgtggtggcaggcgcctgtaatcccagctactcaggaggctgaggcacaagaatcgcttgaacctgggaggcagaggttgcagtgagctgagatcccgctaccgcacttcagcctgggcgataaagcgagactccgtctcaaaaaaaaattgtactgtgataacaactatatttgccatgaatgcctacaggatttggagattcctgccttgaaagagtgtttaagttggcacccaaatcgcgatacctgccctgggagagaaaggaagagaacagcagagaacaagtacctgattgtttctcactacttccccgctgcgcagacgccagagagagagagagacagtcagagcctctcctcaggtgaaaggcagggggataacgagggagaaacctccggaacgccaccggctctcaaacgagtagctggagaagggc

SEQ ID NO: 862 - DNA, 315459 bp, Homo sapiens
ccccggggcagcgcaaccgctggggccggcctcagtgggctgagtggtcggggcatcggggcccagagagcggctggtgagtacttggtcggagcgcgctgtgagcgcccggcccctgtccgggaggccctgatgcagccgggttccccgcccactttccttctttttaggggactggaatccacgctacagttcagtcctccacctctgttagttgaacccagggaacccctgcttcaaaaccccagctgagtcactaccctttgtcagtctctacactggacatctaagtgacttcacacccactccccgttttgagactagaaaaccaaataccgcacgttctcacctatgagtaggagctaagctattgctacgcaaaggcatccagaggggtatagtggacttcggagactcagaaggggaagggtgggaggggggtgagggatgaaacaactacatatcgcttgcaatgtatgctacctggatgaccctgaagtctcagacttcaccactatccaatgcatccatgtaaaaaaaccacctgtacccgaaaagctattaaaataaataaataaataaataaatatatatatatatatatatatatatatatatatattttttttttttttttgagacggagtctcactctgccgcccaggctggagtgcagtggtgcgatctcggctcactgcaatttctgcctccctggttcaagccattctcctgcctcagcctcccgagtagctggggctacaggcacccgccatcacgcccggctaattttttttggtattttcagtggagacggggtttcacagtgttagccaagatggtctcgatctcctgaccttgtgatccgcccacctcggcctcccaaagtgctgggattacaggcatgagccaccacgcccggccatatacctatatatttttaaaaattcaaaaataaaacaaaaaaaatgcctctccctccggcttatttcccgttcctctacccttctcattcccctctagcccaaaagtctcatcactgaatttaccacttttcccaagatagttgtgcctctttttgcttctctgcttttgtacgccactgttcccaccttctgcctataatgtttctctctcccatcctctcctgacaactcttctttagacccgactcgggtggtaccttctccgtcaagttttctttctttctttttttgtttttcagaagttttgctgcctgctaagctctcttagcccttcgttaattcacctgtcattgacattgaccatcttgtgttgtattcaatagtctgtcacaccaatttgattgtgcattttgctttggagaagtccttagtcttttatgtagccacagtggccagacatgcagaagacgttcaatattgctgaatgaactaatgcatttgggatagggttacagaaatgggtgcaagagaaaagggtgtggttgaattggctgtacccagcacacaggtatgcaacttgctcacttactgtagtattcctaggaggggaggagttcaacacctggaaatgctcctgaaaataaccaggatgcatttcttgttgactttgcagaagttcactgaatccttaaaatttaacttaagaagggatggtgggaattgaaaatgattgcatccagcctgggcagcatagtgagatcccatctctacagaaaaaccaaaacccaaaccaaaaaagaacagccaagtgtgattgtgtacgcctttagtcctagctacttgggaggctgaggtaggaggatcgcttgagcccaggaggtgaggactgcaatgagctgtgctcacatgactgtactccagcctgcacaacagagcaagttgtctgtgaaggagagaaggacccagagaaagtgaacaagtgttgatgccacattcactctgtgtgctttgcatcagcagaatgtgaatgcttgggggtagattcgtagggaatttcaggtcttatttatttattttttaagataggttctcactctgtcacccagactggagtgcagtggcgccatcttggctcactgcagccttgacctcctgggctcaagctatcttccctcctcagccctcgaagtagctgggactacaggtgcacgccaccacgcccggctaattttttgcatttgttgtcaagactgggtttctccatgttgcccaggctagtctcaaactcctgagcttgagctcaggagtttgtatgttacagtatatgatatgcacagatgtaatacaactaaaatgtacacatgattttttttttttttttagaaaagaaccatacagaaagttaggaaattggaaagtaaaaattcttcttctacttcccttcttcaatttctttcactcagagtgattcttattaataatttattgtgtattctccctagaaagcttataatgtactttatcaaatctaaactattactgattacaatttttttgcaattctgtacatgcaaattaggtattttatgtaactgcataaagaaaaaaatgctgagaaacaaaaaaatgctgcatattaaaccttcttaaagtatgcatcttagaattgatgaaataccgtatatacacatatacacactttaaaaattttatgcgagtggtgttattatgcaatgtgtcttgctttttatgtaacgatgtgtcttggagagttttacatatctgcatatatagctctacctcattctttgtatcgctaatgatgcattaaaattttattgaacaagggtagtacagaacaattagtgggcccttcattaagggacatcttggttgtttccaaggtgtgggtatgtgtctgtgtgttttcttgcttgtttttgctattacaaacatgttgtagtgaaccaccaaccttgtgtgtatgtgtgtctgtatatatattgtatatctatctatatatagttggtaagattttttcatttttgctacagtttttaggaattcctctatataaagtagttgcatacatcttctaacctaaaattaaataattgcatcactcttataagttgataagttgatcttttagtatttagagtttgttacctgccaagcaatatttgacactcaaaaaccatgtagaaaatgcatctcaaattacagtatttcattagagggaaagttatatgatttccttaaggaaaatctctccaaaatggcagtggtcatgtatttatatatttattttgggaatcttagctatatgatctattttaacaaaatttaaactataacaaattatttataatttatttttttctgagtcacaatagggattaatccctgattatcaattttcagtgttcacagacacttgtattcgcagaaacagagtctgtatgtcagtgttcacagtcacaaaagtctgcttgtataaaaaccacatttattatttatcttaacagattctgaatccttgctgtttgtggtcttttggaagaatgaatatgatatgatgtcgttctaaactttttttcccaaccaaattttccctgctttgacctgttcatagctttttatagtttacctctttacttctctgtttaaatttcttccctctgcttcttgttgactcctacttatcctttaaggccaactaatgttcaaatcctccatgaaatcctctttgtctattttgtccacgtttctctcttccttctttaaattcctttttcagcagaacatcacaatttaacattcttgattgattcatataggttactttatctcctaaatgagactgaattcttcaggaattcttgtctgggctggatttcaggcaagacatctagggggtgctacattagctgtggttgctgagcacttgtggcttgaagtagtctttttttctgacttttattttggattcagaggatacatgtgaagatttcttacaaaggtttattgcatgatgctgaggtttggagtatgattaaacctgtcacccagatagtgagcatagtacccaataggtagttttccaaccctaacccccatccttcccttccccttcttgtacccccagtgtctcttgtttccatctttatgtccatgtatccccagtgtttagtccctacttataagtgtgaacatgaggtatttggttttctgtttctgtgttagttcacttaggataatggcctctagctgcatacatgttgcttcagaggacatgtgttttttttatggctgcatagtattccatggtatatatttcttcatccaatccactgtgaagttgtattcttaagacaagaggcagggcttctccagagacctggagggggtgtagctaatgcagctgatcattacagctcattccctctagcatcagaggaatgcctgggctgctgtttcacagatagacgcctattctgcccagcattagagttgccaccaaagatttttactgcgaatgggctaaccattaagctgcagccctaaaaccctaccaagctcaaaaatgcaccctgacattgtgtttcaaaatggtggcacagaagcaagctggctgtttcttctcccttaccaccagaaaatggaaacaaatacacaatgttaagattatcaccaacaatatcccaaaactcagatataaggatgagatcatttccagtaccacagagaagtgaaaaaacctctaagcagatggtaagagaattggactttcatagcatgacactccttacctcagtctgcctggcaccaggcaaatggaaaatttctcccagtcttacggtttctctaatgggaaaagtgagattgaagtggacaaccaactttcctaccatcctgggtttcatggcaggagacctgttcttgcctcaaaccacaggaagtatcagcagtgctaaagggagaaatatccctgaggacagccagagatgaaggagggagataggactaccatccccattcctggaaactctgctctgtaacttggccaaagaagacaccaaatcagagttgctgtttggcagtaccatgctgtgggaagctcatcccacagttcccttaagcatgaacccctagccagcattcccacactgctgggataatccttttaggacttcccccattttggatgggcagcaatctgattgtttactagaaccgaggcaaacccaggcttaagccgacatctagtgctggaaatgagtcagtgacctagtgaaaaacaaaagaaaatctacaggtaaattgtaaagactctctaagcagacatatccaataaaaaccaaaaccagccagacagagaagactggagtaaataattaatccttcaacacaaagacatacacatacattcacaggaaaaaatagcaaacagaggatcatgacctcttcaaaaggacaaagcaagaaaccagtgactaaccctaataagaaggcaatatgtgaaccctctcaccaagaattcaaaatagcactgaggaagctcagtgatctccaagataacacacaaaaaaaattcagaaatttatcagagaaggttaacaaagagattgagattaaaaaacccagaaattttggaattaagaaagagatttgctgagctaaaaaacttattagaggttctcaacagcagatcaagcaaagaaagaatcactgaactcagacaggttgtttgaaaatgtgcagaggagacaaaaggaaaaagaatgaagatgaacaaacttatagaaaattacctcaaacgaccagatttaagaattattgagtttgtgaccagtctgagcaacagagtgaaaccctgtctctaaaaataaaaaataaaaaaattaggcatgtatcgtggtgcattcctgttgtcccagcaactcagaaggctgaggtgggaagatcacttgagcccaggagcttgagtactggtactgtttggcagtaccatgagaccagtctcagcaacataatgagaccttgtctctatgaaaaataaaaataataaacaaacaaacaaacaaataaataaattagccaggctggtggcatgcacctgtagtcttagctacttgggaggctgaggtgggagggtcacaagcctgggaggtcaaagctgcagtgagctatgatcacgccactgcaccctagcccaggtggcagcgtgaggccctgtcacaaaagagaaagagagagagagagaggagagagaaagagagaagggggtggggagagggaaggctaaaaaaaccctgctgataatttgggaacaatggttcatgttgacacattctaggggacagtgggtgggtaaactggttaactagcagctaaaagataggtcagtttgtccttgagtaggccaactaagtgtatcaaacaaacaattatagctgtttatgagttctctggaaaacttggagagagcagttgtggggcataggtgacaggctggctctgtgtagtatctactgttgacccatcataagaagctccatcttgcttaggccaggtctgcatctgtgtcctcagaatttctcactagaaacctctttttctgtcttcttacgtgtttgggaatgtatccttttgttctccaagtatttactattattctggtttctggattttaaccacatcctgaaaacatatttatttggttggaggcatcattattgtcctacaatatggtttttgtctgtaactgacatctccttttccactggcgtcccctaatttccatggttatgtgctcataacttctacacttcttcattattagagcttttctgtttaggcaggctagatttatgctctctatagtaccattgcctcaataaatagtcacaatcacttttcagtgtgaactttctgtttggacttggggttatttattttggctgctaagaggatgttttatgcttttatggtagatgagatggcagacagtagaatgtctgattaatgaactgtattgcattacatagttccttgaagcaaggaacctttagagttcacgaagttctttgcttggtctcttgcacagtgagtacctcggcagtgatctacagtctgtcctctaattcagtggctctcatcttttttttttagccctaaggcacctcctcaggtgccctccaatgaattgctggggttactatggcagggatgggatgtgtgtggagggacagtcccctagagccataacataatcaggaggagcacttaaagtctgaaaaagctcccaggtgggtgggggtgtgtgtgtgtgtgtgtgtgctgtcctcactaaaaatatcacctctccagccccataaactaagcttccttagataatatggcaagggagaacttaatgattttgctacttgtctagctaaaaggggagtaataaaaacgtacaacactcaatttactgtagttttaaacgaacctatgttataattctaggtttcgaagtataaagcattccgcacgacgggggatggagaaggatgctgaagatggcgccccttctgagggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggtttgcttctaatacgatttttcatgtgtgccacttttccttatcaaatacgaaatacttttactttacaaagtatgaaacagtttgatattttttcttcagaattgcaatttttgaacttggttttcattccttaggcaagatttagagaggcaagggaaagccgaagactgaaaattgacccttcatacaaatatatatttgaaattctagcagaaaatcttggcctggacatagtaactgttgaagaattaattttggattgcccatctgtaagtttaagtcttatcattatattttaattgccctttgagtaagtgattaacttaagaaaatagagttgtcataaacagcaacaacaacaacaaaaatcattcagaaagacaaagttggggcagggcacagtggctcatgcctgtaatcccagcactttgggaggctgaggtttggggattgcttgaggccaggagtttgagactagcttgggcaacatagcaaaactcctgtctctgcaaaaaatacaaaaattagctgggcatggtggtccgtacctgtggtcccagctactcaggaggctgaggtgggaggatctcttgagcctgggaggtggaggatgcagtgagtactccagcctggctgacagagtgagatgctgtctaaaaaacaaaaaagaaagaaaaaagaaaaagacaaaagttggaattttactgactagaggagaaggtttagtttatataattatagccagttgaatggtatttctttttaaatttaattaattaattaattaattaattaattaattttttgagacagagtcttgctctgtcaccaggctggagtggagtggcaccatctcggctcactaaccttgccttccggattctcctgcctcaggctcccgagtagctgggatttcaggcacgcaccaccacgcccagctaaatttttttttgtatttttagtagagatggggtttcaccatgttggccaggatggtcttgatctcttgacctcgtgatctgcccaccttggcctcccaaagtgctgggattacaggcgtgagccaccgcacctggcccagttgaatggtatttctaatcaggtttactgttgtggaggaagaagagaaaagttagcaactagaattttggctaaacttctaattcagaatgatgtcagaagttagaggcatagttgagtggtgacggtaggtaatattttacaagtacaggttatatgaactacatatgcaaatcacttgtagagaaaagctgcataaataagtcaggaaacagtgactattgtatgagtatacggtagtagaaatagtgatgtgattgcaggtcaggttactatatgtctcagtgtgccagggacagttctggattatacctattttcctggcatgattaacagtacctcctgacactactaacagttttggatgataaattgatgcggtcaccctaattatagtaatgtatgatacacttgtgtcatagcttccctcgcgatagctctggttctaagataattttcaataaaactaccactaggttcttgggctttttctgaaccctaggagtggactgggctggtatgccagaaagaccagtgagcaggtgcagactgctggtgagctgattgtctcactgaatgcactggtgagagagttggggtgaggtggggttgtggtgaggttgtcaccatgggggccatatcccctgcttttataggggtcatcaaacatgggcaaaactctttagcttgctctaggagccagggttctatggaaccgtgcctaaaagagctactcccggccgggcgcagtagctcacacctgtaatccaagcactttgggaagctgaggcgggcagatcgcctgagatcagaagttcaagaccagcctaaccaaaatggtgaaaccctgtctctactaaaaatacaaaaattagctgggtgtggtggcatgtgcctgtagtcccagctactcaggaggctaaggcaggaggatcgcttgaacctgggaggcagaggttgcagtgagccgagactgtaccactgcactccatcctgggcgatagagtgagactccaactcatataataataataataataataataataataataaagagctactcccttgcttgatacagtgcattgctaaattctgcaaaattgtctgcgcttcatgtcgtccagtatccttataagaatgtggtcctggcagttctctgacagtatgaatgggattgctcattttcttggtcctgttgtgtagctgtaacagtgagatggggatgtgattgatgcaaagacttcaatagctctaagctattataatgacaaagtatagagaatgcatggagatgtgtacgtaaaacaagaggtgtcacagcaagcaaccggaagtaggttgtggtttcccaggtcaccaaagttccccgctggaatttactgctgtggtcaaggctggcttcatggatatattggctgtgtagttacagaggcccctgtgcttagaatgtcactatgcttggtttgatgatcttttgtcaccattttgaagttcttgataattttttggtaaatgtctcccattttcattttgcactatgttcatcaaattctgtagctggtcctgactgtggacaatgccaaccaaatagtaagaggattttctttgccattcacaagttgggtttgtttgtttaatggtttcctttccccagtgactattctagtttctgtggtgactttggctacatgtctttctagcctctctaagcaattggtgcaaaacaaccttatacacatccctgagatggtgacaatgagaggaagggaaggccaatttctaaaaagtcatttcttagtaggcccaggctttaggcctgtcccgaggatcagtcctgcatttggctagggaggaagccagatgagtgatcaattttgtttcacctgaaaattgctgggccacagatttggataacaccacaactggaatccctagaccttctgcaaagagtataggcataggcattgcggcctgatcactgccttcatgaaagggtaactgctagaactaagatgtgggggggagatgggcatctgcagaactggtagtccaactttaagtatttgccatctgtatttctgggttggtattctctgtttggaggaattcttactggctagcatgctagtcaggaagtagaagtgctatgtgcctacaaacccttctatttgctattcctggggtatgtctcagactttgggtccatgtggttagattctacctttaaggccattatggtccaggactgacactgcttaggctgcaaggaatgggaaatgtaggcattaaggaagaatcaagctgcaaaaggtatttccttaagagttgcttgtgagtgagcaaagccatggtggagggaaaatcgtgtacccagtagggaaaccagtgtcaaaacctgaaagattagaatgtttatttggttgaggggaaaaggcaaggatatatgataggttggatcaaggttggtgaccaggtgagtaaagagatggaacaaggaacaaggggtggcatgatttggtgtggtgcggtttaggaaattgggggtatatggaaaagtattctttagttttttttttttttttttttttttgagacagagtcttcctctgttacccagcctggagtgcagtggcacgatctcagctcactgtaatctccacctcccaggctcaagcgattctcctgcttcagcctcctgagctgctgggactacgggtgcgtgccaccacacccggctaatttttgtatttttagtagagacggggtttcaccatcttggccaggctggtctcgaactcctgacctcaagtgatccaccagccttgacctcccaaagggctgggattacaggtgtgggccaccgtgctgggcctggaaaagtattcttttaatgtgaagcctggcatgcaatccaggatgaaagcagctcagtaaaggcaccacaaaaaagtggacaacagagggtatgatggttactttgtttgcctctggatccattctccctttgtctctgccctgctctgtggcatagaaagctgaactctatggaatctatcacctgggctcccttgttctctggtttacacttggttcagccactgggaggcacagcaggaaatgggagggcagaaggggagagaagctccccacttggccctgttcctgactgtggttctctgctcccatagttatagctccctgagcagcctgcatctccagttctcaacctggccctagtcattctatttcctctagctctcaactcttcagtccttgggggatcacggttctccgttgttgctagtcccattgttgctgctagtgctgcagcttctcttaatcctcctctggcctctagaaatagtcttttattgtataaataaaatagcctttttatttataaagttttttcaaacacccctttgggtgtgactccttttcttgctaggaccttgaccaatgcagatgtttctgcaacattggcacttttaccccttcccactttcctgcccccttcattcagcactgctcaagatagtctcttttctggcttactggcaatgttttccagtgactgggtggcagggttgtggtacatggaaggagcacaaatttggacacccaaagctgaggtccaatcccaggttctgtgctgtgcgtgtgtgttttgggtccttaagttaatttttttttcttttgagacagactgtcgctctgttgcccagtctagagtgcagtggtatgattacagctcactgcagcctcaacctcccagactcgggccatcctccgactttagcctcccaagtagctgggaccattggcacatacctctatgcccagctaatttttttggtatttttatagagaggagatttcgccatgtttctcaggctggtcttgaactcttgggctcaagcagtctgcccacctgggcctctcaaagtgctgggattacagaggtgagccaccgagcctggcctacttaaagtctttttaccttaattttctcttctgcaagaagggtataataatgccactttacctagttgatactcagattaactgttggtaaaatgttatgtaatataagtgaatttttaatgcacagtcatgattttggcccatgatctcacatttactttgctagtctcatgagtacaatgtatctaaaatgcaaggattcattgcatttgatattttgatgtctttttatcctagtcatgtgcactgcttttgagaatttgtatgatttcaaagctaaagggtcagcaagaaagtactgatggagctgtgcaagaactatgtggacagcttttgtcccttttaggtggcaattatgtgagacccaagtatatacgggaggtggaagagtagagaacaaagggctagagttacgcacatcttggtggctctgttttatctcccagggtggtggttctcaaatgtggtcccaggaccagttgcatcagcatcacctggaacttgataggaatgcaaatcattttgtgtttttaaaaagccctctatgtgattctctgatgcacactaacatttgagaacactgtcctaggaggagtggctttgctacacttgggatacttccgctaggcagtcagtaaattaagagatactcatggccaggtgtggtggctaatacctataatcccggcattttgggaggccaaggcaggagcatcacttgaggtcagttcaagaccagcctggccaacatggcgaaaccccatctttactaaaaatacaaaaattagctgggcgtggtggcagaagcctgtaatctcagctactcgggagactgatgccggagaatctcttgaacctgggaggtagaggttgcagtgagccgagatcgcgctactgcactccagcctgggtgacagagcgaaactccgtctcaaaacaaacaaacaaacaaacaaacaaacaaacaaacaaactctcactacccaagagaaagccttctgtatgggaataagtgggattaggtgaatgggtatatgactttgtatttcccataggatatttcagggctttcgtttatgttatctatttagttttctatttactaagatattacactgactcctaagtaattgaataaaaacttcatgctcataaatatggaagaatctcagtatgataatgtgtttttacttcagtttggtacaatacaggtcaaattacaatagctaaaaacataattgctcaaataattggtcaacaacacagttaatcaataggcaagttttctgttccccaagtgagcttttaagaatagtttatcttaataatacttcttttttaaaaatatttacctcaagttggactcacctatttaacccctatatgattctgtggggcagggtcaggtaagtggctgcccaaaactatatatgtaggtcattaatgtaggttcagaaatataattcaaccattactatattgcacagtaattttggagttaaattagtttgggttctaatcttgcctttatgtacctttgaataaactctttgagcttcatcttcttcatctgcaaaatactaagaatttttccttagtcgtttgattatcattttctcttttatttaacagctggaagcatttactaatttttttgcgaaagatggttgtaagacactgaaatttttgtaccaagaaggagatgtacctggtattggtaagaattttctgagggcagtgtgccagtaattagttcatgcacgttaaagtgcagcatattttttctcttatacatagataatcctttatttataaagaaaatgttaccagaagtttatgtataagaaatatagtgtctcaagaacaatacattctcagcccaaatacatatttcaggccttgctataatgtcttcaggagaaaacatccttgtagaaatcactggcctctgctgggaatacacattttcattagaatttaattgcattttccccgaaacaggtggagccattttgtccagatgattagaagtggtggtgaaaccactccagagccctgcagctaccccctgtggtcctatctcagcatcttgtgcctgctgcagctgtcacttggaatagctggttttccctactgtgcatattatgcctgaactaattaacatgctaccagcttgttaaaactttgttttaataactagatatgtgggtttcccttttggtctgagactactcatcatcagagtcctgtggatttaccttcaacacatccctcccgttgcttctttctcacttggttcctctgctgccttaggctaggccttccctggtgttccagattgaaaaccagtatctctgtaatcagattctccctctgaaattcgtactgtgtattcctgccaagtatatcttttattgttctgctgtttattggattgggtccacatctcatttattcaaggcctgctgtcatctggacacgcagtacttgtctagtctgatctcctactcttccagatgtgaatttgctgctccttttaagcccctcttcattgttttctgcatactagagttatttcttttccctttctctcctcacctggctttttcagattgcctttcttctctccactcagcatcccctacccggctccttcagaacacctccagcagagcccttcccagggtgttccaacccatagccatcactgttctccagatccctatctcatttacagtatccatgtaaatatagtacttgattgtgttcttctaccttcctctaattgtttaatatatgtcttgtttcttcgataaaatatgtaaactcgcaaatagtgactaggttggctttgtggattttctgtctctcacagttcctattgtaggaggattattgtgtggtctatatttttataacttgttaaaaattaaaacaatagctgaaaattatagaaagataaaatatctataattagaagcaaaatacagttccactcagttggagaaagcactgttaactccttaatgaatatttctctataactggtttatatacatattttacaaaaatgggatccaattctacatattattctatagtggctgtttaattttgataatattgtcttctttatgccaataaatacatttatccaatcaaaatgttaacatctgcattttatttcattaggctgatataactgtaattttccaaactgatctctcagtagaatttaggttgtttacaactttttgctccctgaaacaatgcctgagtgaatattactgaatacaaatctatgtggattaggaataaattttaggagaaattctcagaagggaaattgccagagcaaagggtacacatatttttaatcattatttttgctacttacaaaagtacatttatcagtttggtaaatattcatctacatttctttgttgttgctgttgtttttgttgaagcagagtctcactctgtcacccaggctggagtgcaatggtgccatcttggctcactgcagcctccgcctcccgggttcaagtgattttcctgcttcagcctcctgagtagctgggattacaggtgcacaccactgcgcccagctaatgttttgtatttttagtagagacagggtttcaccatgttggccaggctggtcttgaactcctggcctcaggtgatccacctgcctcggccttccaaagtgctgagattataggtgtgagccaccacacccagcctacatttctttcttatgtgcatgtgttaacatgtaaatgcttattatcagttaaaaatgtggttatataatacattttattcttgacttggtgtttgcatttgacagggtagcctagacatttttctgtgtcattacgtaaagatttacctcattcaaaaaattcgttatagtataacattccattatacagctgcattgtgatttttagaaatcattccctattgatggtcacatctctcctcttcatcaggaaaacttaagcttgtcttatgtcttatcagacagaactgtgtcacatggctatcctgggggccagggaggctgagagagcagttttctttctagggatgaacacaatgggacaaagtcaggttttcttagcaaagaaaaaggggagggtagtaaatccctgtggagcctctatgaatgggcatttgggctcttatattgctacgtaccatgtatcagggttctttggctgcaagcaacagaaataggtctggcttatatgagtggaaagcagtgtttcgggaggcggaaggtggataacaaaatttagaactagttgaacaatcaggtctcgggaaggacaagaatagagcatttccacagatttcagggcagtttctttaggattcatcagtagacttccatctctcaaatccctttttttctttatgtgtattcattcaaggtttatattcttgtagagtctaattagtctagttcttacatgcccacctttacagagccctggcactcgtatcctccagaatcacagggcaggaggaatctcccaacccccgtgaaaaagaaaggctgggcagacaaaacatttctgtggctttgtgatgtggattttctatttctttccttttttatttttttttgagatgggtctcactaggttgcccaggctggagtgcagtggcatgatcatggcttattgcactcttgatctcccaggctcaagtgattctcctgcctcaacctcctgagtagttaggactacaggcacatgccaccacatctggctaatttttaaaaattattttgtattgacaaggtcttactgtgttgcccaggttggtctcaaacttctgggttcaagcaatcctcctgccttagcctcccaaagtgctgggattataggtgtgagatgctgcacctggccaattttctatttcttttattacattttaaattggctattgctgcaaatagaaggctgttgatttttgcaaattaatattgtgaccaactatctaacataattctcatatttttaatagtttttctaattaaaaaagattgataattaaatgtttaattttcatggaaattagttcaaggagggatttaatagaaggtggatacaatgagtgtatttggtacaggaactggaccttcttgggggagtcagtgaaggcttcctgagatggtggcatttcagctgagatctgaaagatgagtaggaatttgtaggtaaaaggttggggatgggataggagaacaggttgtataaggccctgaggccaggccaaaaggaacagaagtacagagttcagggaaaggtacccagaggaggctgcaatttaagatacaattattagctgggcacggtggctcacgcctgtaatcccagcactttgagaggctgagccgggcagatcacttgaggtcaggaatttgagactagcctggccaacatggtaaaaccctgtctctactaaaactacaagaattagccaggcatgatggcgcgtgcttgtaatcccagctacttgggaggctgaggcacgagaatcgcttgaacccgggaggtggaggttgcagtgaactgagattgtgccacagcactgcagcctgggagacagagctaaaaaaaaagactccatctaaaaagaaaaagaaaaaaaaaagatgcgattattggccaggcatagtggctccatctaaaaaaaaaaaaaatgatgcaattattggccaggcatggtggctcacacctgtaatcccagcactttgggaggctgaggtgggcagatcacctgaggtcaggagtttgagaccagcctggccaacagtgaaaccccgtctctaagaaaaaataaatacaaaaattagctggatgtggtggcacacgcatgtagtcccagctacttgggaggctgaggcaggagaatggcttgaagggaggtggaggttgcagtgagctgagattgcactactgcactccagcctgggcaacagagcaagactctgtctcaaaaaaaaaaaaaaagatgtaattattggcatcttctagtagacccccccccaaaaaaattattctatgaccgtattgaaaacttcttacaataaagtaaaacaggaaacaatagtgtaagagccacagtaacttatctcatttgattagttgtgtgattatacgctaagttcttgacttttgttttcagaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggtatgtttaaaaatttccccaaatacatagttaaacattgaatatatttttgtagtcacacttatgctttactttgctttccctttttaaatataggactgaattgagttccaagaaaataaatgtattcatatattaaaaaaaactgagaaattgactgtaatagagcttagttatattgatattttagatactgctttcaatttcatgaaaatttcatttcttgatggtgtgcaaataacacatttaattttgttgatgcaaagtattagttactttatttaacttcctcttcactcaatattttaactcttttatagttttaaaagaagaagggagagttgtcctagagcctggacattgctaagctagttctgggaaggcaggatgatggaatgggaaaagcaagaattttagccagagagaccgaaatttgcctcttagcttcaccactgactaatcacttaaatgtgtcctctggaaagttgctcatcctttctgcgacttagatctctacgttcttaaattgggaataataatacacacctggcaagattgtagtgacactaaatgataatataaataaattcttattatattgcctgacatacagtaggctctcgacaaatattagttctctttgttattcttagagagtcttaataccttttacaatgggaaagggaactgaagtctaatcttgttccttttctgttatgataaaagattgcttgaagagagcttgtttagcttggtttaagattttaggttggcagttatttttccctgaccccttgtaaatatttcatggtatttcttgtggatgatgagagcactcctgttagtgtaattcataggtaatctgtctttttttctttctgtttgcttttgcttgttgtcttcaaagtcctgtagtttcaccacaatgcctctatgtatggatgtttcctcaatctgccttccatttcattaattctttcttcaacttatccatgatttcatccattcatttttataatttagcttttgttttagttcagttatgtgtgcatataaagagagaaaaagtccttttatgaaatagtataagtctttcataaccgaaaaactgacttctatgctattctccagaagcaactattaaacccttttaatggattcttttatttacctgtatatctctaaataatatgctcagactgctccttttgtcagtttagacattatctgtggccagtcgcagtggcttaccctgtactcccggcactttgggaagcagaggcaggcagatcgcctgagctcaggagttcgagaccaccctgggcaacagagtgaaaccctgtctctactaaaatacaaaaaatcagctgggtgtggttgtgcactcctggggtcccagctacttgggaggctgagagaagagaattgcttgagtccccaaggcagaggttgcagtgagctgagatcacgccactgcacttcagcttgggctacagagtgagagaaaaaaaaaaagacattttctgtggacttttctctctggaaggtgataatttcgctctttttctgccttctgacccttgtttctccatccctctattcttccaacgtagttatattctagttaacttagctaaatatttgtttacatcattagaactaagtaaatgtaatcacagatgagccatgtggtgtaacagtggttcttaaagtcaaacctattttcatcagaatactaagatgctagttgcccttttcaccaatgttgacatttgactgatggcgcagaagcaatggtgggaaaaactactgataccttaacacgaatcaagacgacaccaaactgtatgagtagtaattttatacttcattgccacacactcacagttaaaaaaccagaaatcatttttttttgtgaccctagacaagttttttaatcttaattttctggcttgggatttctaagtcacttaagatgtatcaattgaaaggtcacgcatgggtggtgggcttttgatttctgggcttttggtttcttacggctggtaatttattccaccaaacttctaggcaagggcttttcaccagaaaaaaaaaaaatcatggacagggcaactttcaacggaggattttctttacgcaggtttggttccacgtccctcaccttgaataggctccaggctattgttcctttcctatgcagaaattaaagcatcaaatgaaacatcactttgatgagcaaatatgggaataattaaattgggggcagaatataagtttgttgactttagaactctaaggttcataaccacttaagattccctaatagtttataaaatgtattagttgtctatgtttattgcaatataaaacaggttatgatttttcagttctttagtgggattagcatgtaaaataacatttaaactccaccctttcaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtaagtataaaatttaatgtttagcaaattgcaaaaaagaagcaaattaactaagatatttcataaacagagaaaaagtttctatcttaaaagatgttaatccaagtaattatgagacttagaggcaagaaatgaaatcattagaactcatttttgaggatctttggtggagtaagatatattttctttttaattttacgttatagcaggaggaatctctttctataatattaatgaaaattttcaccatattaaaatatatactttattatgaactcttaaaaatctatacttttattttttcatattgttaaaatgtacaattttatcagtaaattatgaagtcataatctaatgattaattagaattatatttctgtaaagtattagatctttaacatttcagtaattagagcttaaaagtacacattgacttttaacacattgacattaaatacttcttactattaaatattatttaatatttttattaatatatttaaaatatttaatatataaattagtattaaatgtcttttttttcctttttaggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtgaattgactcaaacaattgcatctggactagtagttttcatgtgcatcctagccattgtattttgtctctaacagcaaagggaagaggtgtctcctttgactttcttccagaatctagtttgaaactcagccaatttttgggtctagagcaaaatcattcttctttgtggaccatttgaaatcaattttaagatatttctcacttcaaggaagaaaccataacaatatgggttgagaatgaaagaatgaagaatcaggaatagccaacatttatccccaataatgtttaaattgttgatactctccataaaagagagagggagaggacacagtgaagagccagagtgctagacactaaataagtacctcttgttcgatcagtggagttgtctgtgctgtcaaagaagttcagactaggctgtttcacatcagcatcacagtggcaagcctgcagctctatggtcaaattttttctggcagtaaggaaagtagtgataggaatacaacatatgtcaaaattatgagaggctccaacttacactataaacactgtgaaagaaaatcggatattacataattgccctaaacagaaagaggattctaggaaccgccccccagatctctagttcatcagcacaggacagcagaactaaacaagaaaatcttcagttatgtgaggatcaaggggaaaaaatcttgaccaggcaggaggtacagaaaagcgtttccagttttacctttctagaactatgttaggaggagggctgtgcagttagagtggcaaaaattggaggactcccctagggtctagagtgctggccacagcatttgcttccaggtgtcactagattattgaaatgggtaattgcccactggataactcttgcagccaccgtgcccagccaagacttcctatttttttttgaaaaatctttggttacacttggaattgtcagatttttaattgttgccaatatgttgagtgtgaaatgatatcttggtttacttggtattaccctaaatactattgaggttgagcatatttaatggctattttggtttcctctgtgtagaattgcttgtttatatcatttacctgtatcatttacccatatcattgcctgttcatatcatttgcctatatcatccctttatttttttggatggcttgatgttatcatactacatttttggaggttaaataatattttcctgatattaatcctatgttggtccccattgtgtcatgtttcatttggtatagtgcctttagtcatgtggaaatttaagtttttaatgtagataaatatattaattacaaatgttaatccagcctcaacctagctatccccagtgactataaatataaactctgtgctttttgtattttacttattaaatgctttcctactccagtgttacaaaggcattctcttaaattctttatttattttaaatagtgaatataacacaaaaatgaatatgatgaaaggaacaaactgtaaaatgaacacctgtgtaacctttgcacaagttaagaaatagaacatggctaggcatggtggctcatgcttgtaatcccagcactttgggagcccaaggcaagaggatcgcttgagcccaggagttcaggaccagcctggggaacgcagtgagacccagcctcaaaataaataaataaagaaaagaaaaaacatagaccattaccagcgccttaaaatgtccttgcgtttctcttcccagttttaaacagcttttcttccccctagtggtaactattatcttgataattatgcttttcaattccatgtttttctttctagttttaccctgtctcctacattttcttttagaaatgttaccattttatttttaacatttaggtgtttaatccatctggaattgtgcgtgtgtgtatgatgggaggcagaaatctaattttgtgtttttcatgtacctgtagttagccaattgtctcgatttaagattctctgttaaattgtttaatagtccatttttttctaacatatttgtaatataacctctgtcatatataaagttgttagacccttttgtttgtctcactggtgtatttatttattttttatactatgctgtactgctttaattctgtagcgttttactaaaccaacatttggcatgccaagtcttttctctgtttttcctcaaaattacattgactgttgcaggctaattgtttttcaaaattaattttaagactaatttttaaagtatcatgaaaaaccctattgagattttgattagaatttcattgaatgtgtacatgaatttagagaaaactgccatctttgtataattgaattttccatccatgaacatgatatacctccccatttaggtaggtcttctgtgtgtgtaaaataagttttaaaattctctccaaaaaggttttgcatatctttcattagattaatttctagttatcttatcactgtttttctttgctgttgtaaattgtatctttttggaaattaaattttcagattgcaagatagcttgtaaagaagtgatactaatttttatgtatagatctagcaactttactgaattgctcacgtttattaattgtaaaaagtttgtctttagtctttttgtttttttttcttttctttttttgagacagggtctcattctgtcacccaagctggagtgcagtggcatgatcatagctcactgcagcctccagcttctgggcttaagtgatcctccccgctcagcctcctgagtagctgggactacaggcatgcaccaccacatccgactaatttaaaaaatttctgtggagaaggggtcttgccttgttgcccaggctgatcttgaactcctgggctcaagcagtcctccacttcagccttccaaagtgctgaaattacaggtgggatccactgctcccaaccttagatatgctagtttaaaaatgtagcaaactatatcatctgtgattatgccatttttggttttttatttccaattcttaatgccttctgtttctttagttaccttgttctgggatatctattaccaggtggaatagaagtgggtggtgattgtggcaaacttatcatgtccttggttttaaagtgatattttctaaaatgtcacctttggccaggtatggttactcatgcctgtaatcccaacactttgggaaactgaggcaggaggatcgcttcagcccaggagtttgagaccagctgggcaacatagtgacatgctatctctacaaaaaattaagaattagctgtctgtggtagcacttgcccgtagtcctagctactcagtaggatgaggcgggaggattgcttcagcccaggaggttaaggctgcagtgcactgtgattgtgccactgcactctagcgtaggcagcagagcgagaccctgcctcaaaacaacaaacatacaaacaaaaaaaccccaaaaccaaaaaactacctcccccccgaccaaaaaaaaaaacccaaaataaataagagaaactgtcacctttaaatattatgtttgctggagaattttagtagatagtatctatcatattgaagacattctcctctagtcttcatttactgagagtttttaaacattatttggtattgaacattatttatactttcagctgccttcaaaaagatgcaatcagattttaacaaagaagaatgtaacatttctatattttataaatttttttgactgcaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaaggtaaaaggctttttatttaaagtttggtatacttcagaacaagcaactagaaaattatcctattgaactacttcttagtataatatactggaatcgtgtttagaagtgttagcctttgagtaaggcttttacatatatcacagttatttccagaagaggaaatgaagatttatttctcaggatttcgcagaccaattttgaccatactactatggggtgatttttaggaaagtgatcatcttttatttttaaattgtttttgaaattgtaaatcaatgaagaaatcaatataggctcactgaggtaaacaactgcatatagagtcaaaagtaaagtacatctcatccccatgattctacctcctttcctagaggtcatctttatttacagtttggcttgattctagattcttttcttttctttctttttgaaacagggtctcgttctgtcactcgggtggggtgcaatggtgtgttcacagctcactgcagcctccacctcccaggctcaagcgattatcttgcctcagcctcctgagtagctgggactaacaggcatgccccaccaccacgcccggctaatttttgtatttgttgtagagatggggtttcaccaagttgctctgggtggtctcaaactcctgagctcaagtgatccgcccacctcagcctcccaaagtgctgggattacaggcgtgagcaaccgcacctggcttctttttctttctttctttaaatgtatttctttctttgcacagaaaaataaactaatacttttttggtaatagatttaagcagtacgaataaaacaagtctctcttaatcacatacccttagccccaccacccacaactctgtgtcctgaatagtaagcacagaaagacaactgcacttttctattttattttttcctcaacatcttctgtggtatgtatgtgtgagtttactatgcacaaatgacatagtttagttttgtgtttctaacttttaaattaaataaatgtcatagcataatatttttcaacttcccttccccacccctgatagtatatcttggagagttatgcctgttagatcgagcttgagcggtatggttttccaaaaaaatgttgttgttgtgctttttttttttttttttttttttttttaaagacagaatcttactctgtcacccaggctggagtgcaaaggcatgatcacggctcactgcagcctcaaccttccaggcttaagccatcctcccacctcagcctcctgagtagctgggactactgtcatatgccaccatgcccgactaattaaataattttttaaaaatgttgtccaggctagtcttaaactcctgggctcaagcgattcttccacctcagcctcccaaagtgctgggattacaggtgtaagtcactgtgccttgcccaaaatgttaatgtagcatattaggttttatctgatcatttccctgtttgtggaccaattttcccctttctttttttgcaagtctgagttataattcacatactatttattttatccatttaaagtgaacaattcagatatttttagtgtattcatagttgcacaaatatcaccacgatccaattttggaacattttcatcacctcaaagagaaactctatatccttcagctctcaccttcccatttccaacattcccccttccccccagccctctgtctagatttgcctattctggacattttatataaatggaatcatagattctttgcctttcgttactggtttctttcacttagcataatgttttcaagtttcgtccatgttgtagcctgtatcagtatgtcattcctttttatggctgaatcatattctgttgtatgaatataccacattttgttgatcagtttatggacatttgggttgtccctgtttttttggcaattatgcataacgctgctatgaacattcatgtactgtacaactttttgtgttgatatatattgtcatttgtcttggttattatacctggggtggaatttctgggtcacatgttaactctatgcttaactttttaaggaaaatggttccttttctatgtgtttataaatattgctgcagttgaagcttttatatgtccatatgcaaatatttccttaggttggacactccacaacttttcagtactaattatcagttaagttattattattattatttttttgccaggcatggtggcctacatctgtagtgtgagctacttgggaggctgaggcaagaggattgcttgaactcaagaattttgagctgtagtgcactatgttgattggctgtccacattatgtttggcatcaatatagtagtgatgtcccaggagtggggtgatgagggtgcctaaggagaggtgaactgatcagggtcagaaacagagcagatcaaaactcttgtgctgatcaatagtgggatcatgcctatgcatagccactgcactccaggctgggcaatgtagcgagaccctatctcattaaaaaaactaaaaaaaaatttttggggggccaacctgacatatggagaatggcttgttttattttgttctttccttgttagtagtgaagttgttcagtttttgctgcttactggctattcatatttcttttgtgaattttctttttgtatctttcccttatttagaaaaattcagacattgttttgtactgatttataggagttctttattttttattttttttgagacaggcttctcttcgtcacttaggctggagtgcagtggcactatcatgattcactgcacgctcgacctcccgggctcaagtgatcctcctgcctcagcctcctgagtagctgagactacaggcatgtgccaatgtgcctaactaatttttaaacaattttttttatagagataggatcttactgtgttgcccaggctggtctcaaactcctgggctcaaggaatcctcctgcctcacactcccaaagtgttgggattacagacgtgagccactgtgcctggccacttggagtcctttatataatatggatattaatcactcgttatatttgttggatgaagtaattcactatgactcctgggcatctctgcacattttcactatatatgaaaagaatgcaaggcccatactgctctttatctgaacatctctcagagttgtgtttgcagtgagcaaccttgaggggtcagttcacgtgtcccccagacaaagagcagaattacttaccgcttactgtaaaaaggataaattcccctaaactcagtattcctcacctgtaacacaacctactgcaggtgcaagcatcagtgtgtggatatttagggtcatgggggaacaaatgcaacttaatgctcatgccatttgctgtgatgtaataaaatccttgtctctgaacccaaatctcatgttttctcccttcatccataaaacaataaaaggctaatgcattaacttctaagcagggtaaaatcccagacccccatatgcactttgacaattacaatgcaaactttttcctagtctgtggcttgtattttttaaaacttcaacacttgaaatcattttagacttatggaagagtcaaccaggatagtacagagagttcctgcctgctcttcatctagcttcccctaatgttaacatcttaaaactattgtacaatgatcaaaatgaaggggtaacattagtacgatactattaatgatgctacacacaatttatacttctccaggttttccacttatgtatttttatctgttctgggatccaatccaggatcctatttacatttgactgtcatgtctctttagcctcctccaatggaacagttccttagtctgtagttatacttcatgagcttgatacttttgaatagtaatggtcagttatttaggagaatgtctctcaatttgggtttgtctgatggtttctcgtgaatacattgaggttatgcatctttggtaagaatgccagagttgatgtgctcttcccagtacgacttaccaggcggtccattatattgatgtgccttattactgttttaaaattgatcatttagttagggtggaatttgccaggtctctgtactgtacacgtatcgtattttgtggaaaataaccttaaactacatgaatagctttcataggtgggtcttgactgcggccgtcattactgtgttatgccaatggtggttttctagttccctcattccttccacgtttattaatcagaattcttatgtaagaaaatgttgtctcttctctcactgtagttatgtatttgatcgtttattttcattaatatagcctcatgggtatttatttcatgcttttggttataatcgaatactatcattatttagtttgttgctcaaattgtttcctctttggccatcgggaaatctttcaggttggcttgtgtgtttccttctgattcccttactctgtttggaccacttctttactctctaacactagataaatgcttaaggctcattttgtatttgttctgccctagtcctgggatcagcacttctccaaggatcctgggtttattttattggagagtagtatttaggaaccaaaatctggttgccagatgtgcttatttgttgcttgtattttaatttttttttaaaatggaatcatttataatgaatttttttatatttagatgaattaattttttcagccttttattgcttttgtctttcatgtattgtttaaaaataccttcttaagaagaataaattggttgggcgtggtggctcacgcctgtaatcccagcactttgggaggccgaggtgggtggatcacctgaggtcaggagttcgagaccagcctggccggtatggcaaaatcccgtctctactaaaaatacaaaaattagccaggagtggtggtgcatgcctgtaatcccagctattcgggaggctgaggaaggagaatcacttgaacccgggaggtagaggttgcagtgagctgagattgtgccactgcactccagcctgtgtgttgggagtgagactccatctcaaaaaagaaaaaaaaagaagaataaattaaggttaacctaaatttaaaatagaattgcccttttcttctatttctagggttttatttctttatactttattcttcagttaacttggaatttatttgtgtgaatcatgtaagatttaataataatgataataatagcagctaacatttattgtgtgcttactatgtgccaagcgttgtgttcagtatcttacctataacatttcatttaatcctcacatcagctggatcaggtggatcttattattatcttccccattttgtatatagaacagtgagagattaagtttcttgttcaaggtcacagagttagttggaggggaagcaggatataaggtcatgcacttacctcttgagctagcattctttttcccaaatggctggctaattttctgggcactgtttgtcattttctttttttctttttcttttttttttttttttttttgaggcaaaatctcactctgttgctcaagctggagtgcagaggtgcgatcttggctcactgcaacctccacctcccaggttcaagcaattctcctgcctcagcctcctgagtagctgggactacaggcacatgccaccatacccagctaatttttgtatgtttagtagagacaaggtttcactatgttggccaagctggtcttgaactcctgacctcgtgatctgcccgccttggctgcccaaagtgctgggattactggcgtgagccaccgcgctcagccactgtttgtcattttcttgtaatcatcataacttttgtacatctactctttgttcttcttttccagatttgtcttaacaattcctatgttttcatcctttggtacacattttgaaataagtttatacagtttttttctccaaaataccaaattttgagacttagttttatatatttttgaaatgtatgtaaatggagtcatatcatatattctgcaatcaacttttactcaacattatttgtgagaattcatcatgttaatgtgtgcattattattcatttgctacctttgtttttattgctgtatcatattctgttgcatgaatgcaccacaatttatttatctattatcccagaatcgacatttggattgtttctagtttggggttattgcaagcaatgattcaaaggacattcttattcatgtctcctggtgcacatgtgtgagaatttctctaaggcatattcctaggagaaaatttatgaatttgtggatcaaaggcatatacaatttaagctcttggagagaggtctctaatgatctgccatagtgaccttcagacattttgtattaaaaatattaatctctagtctttagaaaggatacaaagcaaatgtggtagcaaatctatgaatgacattgaggagggagggaaagaaatatattggatgacaatgtaaagatccaagaaggtcttcagtggtaagagtgggggtgccatactgatatcccaacctctttgttggatgggtttgttgacaaactgtttggctcccattgtttttcaaaatggttttgttcagagcatattatttctgtttttgctgagtagacctctccatttcatgctctcttcatctctgaccaattctcaagcaggcacttgattttatcatccctagtatgtaagagtggtcagttaataataagataacagctcacgcctgtaatcccagcactttgcgaggctgaggcaggagaatggcgtgaacccaggaggtggagcttgcagtgagctgagatcgtgccactgcactccagcctgggtgacagagcaagactccgtctcaaaataataataataataataataataataataataatataacatttattgagaataggttaaaaatcctgaaagaatttgaaggagagaaattgatcaactttggataaagacttaacagttttagttgaatccattgatagaatgatattactgatgcaagtcaacttgatcctaggctgctttatgagaggtatagtttccaggaaaaaggaaggtgatgttttggcttttctcagcattgaccagatcacactgaaggcttcctttcattcctgaggcatatgtatttagagtgatgttgtgtgtgtcccaagtagaaaggccaagaggttgaagctattaagaccatgtccttggaaccaacccaaaagctcatcaatgatagactggataaagaaaatgtggcacatatacaccatggagtactatatggctataaaagggagtgagatcatgtcctttacagggacacggatgaagctggaagccatcatcctcagcaaactaacataggaacagaaaaccgaacaccacatgtactcactcataagtgggagttgaacaatgagaacacatggacacagggaggggaacatcacacactggagcctgtcagggggtcagcggggaaaggggagggagagcatcaggacaaatagctaatgcatgcagggcttaaaacctagatgaggggttgataggggcagcaaaccaccatggcacatatatactatgtaacaaacctacgcattcttcacttatatcctggaacttaaagtaaaaaaaaaaaaaaaaagacaatgtctaattaaatgactaaaggcacacagattgctcatctttgaataaaagacttagtgatgatatggtaaatgtcttcaaacatttgaagggttgctgtgtgttcactaggctccattatgcaaaactatacagatgagcagagattacaggaagaactttctcataatcagttatttaagcaggtactatttgatgaccacttacaagaaactgttgatttcagattgacttcactttgctagtaaggttttgttttgaataatgttcttttttattttttattttttttgagacaaagtctcactctgttgtccaggctggagtgcagtggcgcgatctctggctcactgcaagctccgcctcccgggttcatgccattctcctgcctcagcctcctgagtagctgggcctacaggcgcccgccgccacgcccagctaattttttgtacttttagtagagacggggtttcaccgtgttagctaggatggtctcgatctcctgaccttgtgatccgcccaccttggcttcccaaagtgctgggattacaggcgtaagccaccacgccctgccataatgttctgttttaataacttgacccattcttgaagacccagagtaatataatgtcacaaataattaacctgaaaaagtcattcctgttagaagcaggtccagttcaagcctacagacaggattttaattacaaacagaatgagtcttcagttttagtaattcatttaaggtgcttgttgtaactttgtctcaagtattataagaaaaacatatattaatcacacttaaatatctaccattttagtatatgtatgattagggaagactgaatttcccgagtaaactttagcacactgatatatttggatgtttcatagaattcttatacctttttttcttagaattggcgtgatttggatgcaagaatcactgatacagcaaatgaatccaaagataatgtcagatatttgtatactttggaaaaagtgtgtcaacctctctataaccatgacctagtaagtatgcttttaaagtacaattttaaactgagggcagtggctcgcatctgtgattctagctactcagaaggctgaggtggaaggatcgcttgagcccaggagtgcaaggctgcagtgagctatggttgtgccactgcattccagcttgagtgacagagcaagaagaccccatctatataaaaaaaaatagtacaatttaagaaactgacttgtataattaatgcattaaaaatctttaatatgtgtatattggggaaaaacatcctgccaaaagttatttaaaatatacattttcctcttatgtgtttatgaagaatgataaactatatttaatattttaacccatatttaaatatatagtgaatcattaatatagtatgtgcaagacaaatattaatatattacttatactttgctgcataacaaataacctcagaactgagtggcttaaaaacaatgagcattcatcatgtcagagtttctgtggctcaggaatccaagcaaggcatagctaagagcttctgcttcaaagtctctcatgaggttgcccacaggctaagtgggggaggctgactggggagagtcttcttctcagttcactcatgtggttattggaaggccccagtcccttgccacgtgggcctctccacctggcaacttgcttcccttggagtgagtgttccaagagtgagcaagagaatgagagaacacccaagttggaatctaccttcttttaataacctaatctctgaagtgacagcccatcatttctgttgtattctattggctagaagcaagtgaatctggttcactctgggtgggtaggggagtatacaagggtgtgagtactatgtgggtgagcatcactggggccatctttggggctgcctatcaaggtagatatttccccatttacagattaggaaaccaaaactcatcatggtgaggtgactttgccagcatcactcagctaatcagggatgcaggacagaacccatcttctaatttctagcctactcttctcataatatttccatagagatcctttaaagaacatgttagcactaccatttgcttttattttttagaagtttatattaacttcaaatttataatctggtatttcataatatttcatataaaatatgaaaattaaaaaaatctctatcctttatttaatagaaggagaagtcaaggaagctagtagttattgagaacttagagcaggatttccccatttttcctggatattacttcttttgtaaatcatttgtaggcaggagggctgcccagacagctgcatttttaaagatgttcccaggcttgagaatccttgaacttttgttataggcattgtgctacatgctttaaatatgttttcattctctatgcacaatgaccctcatttcaaagattaggaaaccgagtttgaacatttctatgatgatccgtgatgggaccaaattggaatctagctatctgtagcattatgggttgtattatttttccactttactatgttgcttcttcaaggtattctctaagttgaaatgcttcctctttccttcctccccccaccccaccaccccgggatggagtctctctctgtcacccaggctggagtgcagtggtgctatctctgctcactgcaacctccgcctcccgggttcaagcaattctcctgattcagcctcctgagtagctgggattacaggtgcatgccaccatgcccggctaatttttgtatttttagtagagacaaggtttcgccacattggccaggctgctctcaaactcccgacctcaagtgatctgcccgcctccacctcccaaagtgctgggattacaggcgtgagccatcgggcccaacactttcaaattaatttaatttgtgtctgatatctgtgtcagtattcttcactctaattttttaagaagtagtcaaatcttccatataggtggcagcactggccacatggttttgttgaccaaccttcttgggtcaatgtaggtttcatcccagaggcagggagaaggaaagaggttatggcctatatcacttagacttggagaagaaggaggtgtaaaggcagtttataatctttccaagagagtgttagtagtcaagaagtttaatatgaaaggggagggaaaaatgtcagttgagagtcttggacaagtgcatttcttactgccatgaggaatccattatccatcagggagcaccatgagaggggacaggaagactttagaagcagagtcttttaattgagtccataaagagattgtcgattttatttaaaacttattagtattatttgcaaagagatgactttttgaaaaattacagctttattttagattcgggggtacatgtgcaggtttgttacatgggtatatgacatgatgctgaggtttggggtatggatgctgtcacccaggtagtgagtacagtacacaataggaagtttttcagctcacacctctctcccttcctccccaccaagaattatgactttcttaaacttcattcttctcatttttacccctgctactagtagctggacttgtgttgtgaacctttgtaaaatttgtttaatataagaacatttatactatttcttaggtatttctgtgcacgtgaccccaagtaaagaaaatcaaattgtatatggtgttggagaagtaaggcctttgcttggcttacttggcagctcaatgacttaattccccaactttacaatgtgagcaattaaaatttctgtccaagaaaaattaaaattattacatgtcacaagcatttcagattgctcacaagatttgaagatgcaaatatgaaatacacataatacctaaagcctactccagggctaccgcaagtagctcttgatgtgaaaaaataatagatgaagtgaatatggcacaacgttcacgtttgtcaaatctaatgatgggagtaggtggtcattatatttttctctgtacttttctatatatttaaagctttttattataaaaagtaaacttgaaagaaagaatactcttcattgctatcaagactccaaattttaaggtatactgatttcaacttcttgattcaaaagacttgttttaattcatataatttaaaaatcatttagttctgatgtttttttcatcctagtaattttaaaaagctttgttcaattactctaaccatggatgtgccttattattgttattttgttgttgttgagctttttatattctctgatgtaggaaggtttcaagcatcaccttttgaaatgacagaagtactaatagcattgagtcatataattgcttcccactcatacacccactatatctgtactttcaacaattcctttttccccctcattttctttattctgattaaaagtaaccagcaattgctgtttagtttataactgtcatttgggtaggaaaagtgcaggggattcatgcttccatttctggttcataagttttatgtatgtttcatttttttaatcaccctggtattgtgctttaggcatatcttactattatatgtttgacatatgagatatctgagcactgtatatagatggacaagaacagtgcactcaaggagctactattgtaaataatgatgtttaaagttcagatgaaggacgttttcctgaaggacccatttgatgccatccctgagccctctttattggagtttagtggtactttgtagacatgacttaggaagggtggaagggactctttctaggcatatttttattaggatctttttgatctacagataccatatataatatgaattctggcctagaaggttaactataaagtaatggtgttaatttccataagccacataaaactgatttaattattccatagttataccccacacctaggacataccgtacagtaatcggtagttgtttttcttggctgtatttcttccatcaccattaaaaacacattttatatattttatcttgtcttatcaattaaaaggaaagttccttgaagggagggatgccattggctttgtctgttctcctgtagtgatttgcatcacggttagaagcagggtctcaaaatctccactatgtaacttacagctgttggatcttaggcaagggacttaacttctctacctctctgttttctcatttgcaaaatgggaataatgataatactttattttatagattctaagactttttttcacattttaatatccctgaactcaggacatactttagtcagttaggttttgtgaatcattgtggatgtgacttgatactaccttaaattattagttctctccttgagggtgttttttttgttttgttttgtttttgattttggtgccattcgtatgaattcagactgcagttgagtacctgtgcatacattctcaaagaagtttgatttctttcctcctcctggtagcatgtacattttgtttctctctttttctccatggttggtttatttcatgtttaccttaacagggaggacccactggtggcctagtattatgtaggagttagattcctcatcttgggtgtcttttttctttcttaatagcacagaaaataatggtgcaatcttacaatccgtgatgttttatatctgatgtaatcaaacctaccttcaagggttgttgtcagcatatcttagaataatatgctaacgctcttagcctagtgcctggaatatagtaagcagtcagtttatgttcaggattgttttatatccttgttgtacttgttctgctttgctctacctttttctacttgttttacttgtttgtgtttatctcttctgctctgttgtgagctactcatgaataggtttggatttcttccaatatcttcagagcctaatggcacttggtaggattgctaaaacacgaactgagttgcataaaagaaaatgaatgctagtctgatttctattttagctgggcttatgaccttaagaaagtcactttacccctcaaggtatcagtttcttcacctttaaaaagagcagaatgaactattaaccttaaaatggctctcacctctaaaatttaattttagataaacttttaagttcagatttacagaaaagttgcaatgatagcacagaattctctttacccagtttctcctgttaacatcctgtattaccttagtttgtttgtcaaaactaatgtcctgttatctgttccagggtctagtctagaatactgcattggatttagtaaaatttgactttaagctaaaaatgctatactattttgtgtacctttagagttttgagtattatagaatattggttattaaaactatatgcatatgatggaattcacttaatttgtttcaatgttaggtttccatggcacatggaatacaaaatttgattaatgccatcagaatgattcacggtgtgtcaaggtattataatacctcagagagaatgacctcattgtttatcaaggtaagtttctgtgggaggaaattacatgtcatcctgtgaaaaagttagcaaatctttccttctgagccctaggaagggaatttggaagcctaagtgcctctcagagttttaatacttccagtggacaagaagagaaaggcgttgactggactcagttgtacttaattgaagggagtaattggtacttttctgtttatcagatgtaagccccaatacttaaagaaaatgtgcctggtggttttttaatttattcatttcaaatagttttgattctacccaagagataggagtgtgtctactattaacagtgcttctttagctactcccatgaacactatagtttgtgtaaaattttcctgtgtagcgccgcatggttaattatttaaaataattttttaaaaatgattaaacaatatatatttaaatttgctagccaatgtcattcttttttttattatacattaagttttagggtacatgtgcataatgtgcaggttagttacatatgtatacatgtgccatgttggtgtgctgcacccattaactcgtcatttaacattagggatatctcctaatgctatccctcccccctccctccaccccatgacaggccccagtgtgtgatgttccccttcctgtgtccgtgtgttctcattgttcaattcccacctctaagtgagaacatgcggtgtttgtttttttgtccttgcgatagtttgctgagaatgatggtttccagcttcatccatgtccctacaaaggacatgaattcatcgttttttatggctgcatagtattccatggtgtgtatgtgccacattttcttaatcccgtctatcattgttggacatttggcttggttccaagtctttgctattgtgaatagtgccgcaataaacatacgtgtgcatgtgtctttatagcagcatgatttataatcctttgggtatatacccagtaatgggattgctgggtcagatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtatcttttggctgcataaatgtcttcttttgagaagtgtctgttcatatcctttgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagttcaattagatcccatttgtcaattttggcttctgttgccattgcttttggtgttttagacatgaagtccttgcccatacctatgctctgaatggtattgcctaggttttcttctagggtttttatggttttaggtctaacatttaagtctttaatccatcttgaattaatttttgtataaggtgtaaggaagggatccattttcagctttctacatatggctagccagttttcccagtgccatttattaaatagggaatcgtttccccatttcttgtttttgtcaggtttgtcaaagatcagatagttgtagatatgcggcattatttctgagggctctgttctgttccattggtctatatctctgttttggtgccagtacatgctgttttggttactgtagccttgtagtatagtttgaagtcaggtagcgtgatgcctctagctttgttcttttggcttaggattgacttggcaattttttgccagggctcttttttggtgccatatgaactttaaagtagttttttccaattctatgaagaaagtcataggtagcttgatggggatggcactgaatctataaattaccttgggcagtatggccattttcacgatattgattcttcctacccatgagcatggaatgttcttccatttgtttatatcttcttttatttccttgagcagtggtttgtagttctcctcgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaatgccctttatttccttctcctgcccgattgccctggccagaacttccaacactatgttgaataggagtggtgagagagggcatccctgtcttgtgccagttttcaaagggaatgcttccagtttttgtctattcagtatgatattggctgtgggtttgtcataaatagctcttattattttgagatacatcccatcaatacctaatttattgagagtttttatcatgaagggttgttgaattttgtcaaaggccttatctgcatctgttgagataatcatgtggtttttgtctttggttctgtttatatgctggattatgtttattgatttgtgtacgttgaaccagccttgcatcccagggatgaagcccacttgatcatggtggataagctttttgatgtgctgctggattcggtttgccagtattttattgaggatttttgcatccatgttcatcagggatattggtcttttttaaaataatttgagaaattactcaagcaacacatgagaccaggcatggtggttcaggctgtaatcccagcgctttgggaggctgaggtgggaggatcgctggagctcacgagtttgagaccaacctgggcaacatagagagaccttggctctacaaaaaaaaatttttttaagttagctgggcatggtggtgtgtgcctgtagtcctagctattccagaggctgaggcaggaggatcccttgagcctgggagttcaagaatgcagtaagctgtgataacaccatggcactccagcctaggcaagagagaaagaccctgtctcaaaaaacaaacaaacaaacaaacaaacaaacaaaccaccaccaacgaaaaaacccacatgaatagaatttatttgtaaattattcaagcataacgaaatatataaagtcatagtcacattttaagtttttttaaaaagcaaagtataggcttaatcactatgtcctaaatacgacaagactctcagaatccttcctctttacctgtctctctcattcttgccatatatgtcccacattgagatcatttttagttctgacaatgattctttgcttggcttctgaatcttctggtaggcccacctttgcactttctagtgaaatctagtttgagcaaagaaccctgctaagtcagtttagcaagaaccccccattcttgatatctgatgactctagatatctgatcaggttttcattccccccaaccccccaggtgttgtctgatcactttggcctgtcttcagcaagaatcctgttaggtcagtttaaccaaaatcccccttacctctgatgtttcctcttaataattttccacccactgactcccatcctgccccttggctatacattcctgcttgcccatgctgtgttcagagttgagcccaatctctctttcctgctacaagatcccattgcagtggtccctatacctatcacaatggtcctgaataaagtctcttgctttgcaagtatcactgaataattttttaacagttccatattattcttaacatttttttcaacattgtgaatcaacaagtattcagactaaaatccaagtattgctaatttatttatcaccactgttttgtgattcccacatctttttccttcttggattcattatttcttttgctgaaaaaattctttcagagaggtttcagggtggtgaacttcctggatttctacatgtctgaaaatcactttcattttgtctgatcactcaaatgctagtgtgacttggattttaaattcgacatcattgtctcctgggaagttgaagatattgctcaatcattgtctagtattcagtattgttgaggagaagcttggtgctaatatgattcttgtttcctttgtaggtaactagttttattctcccaggaagcttttaggattttttttctttatctttgaatttctaaaatctcaaactttttttttttacatttatcttgttctacacttgctgagttgtctcaatccaaagactttcctttctctttattcctgagaaacagtcctcttttgcctgggattatttctagctcactgatatggtttggatatttgtcccctccaaatctcatgttgaaatgtgatcctcagtgttggagatggggcctggcaggaagtgtctgggccatgggggtggatccctcatgaatggtttggtgccctccttgtggtaatgacttcatgcaacagctgattgtttaaaagatcctggcatctctctcttgcttgctctcatatgaggccagttcccactttgctttctaccatgattgtaagcttcctggggtcgtcatcagaagcagatgccggtgctatgcttcgtgtacagcctacagagctgtgagccaaataaacctcttttctctataaattacccattctcaggtattccttgatagcaatgtaaatggactaacacacctacccattcaatttattctctccccttgcatctaacttccatttctcttaatttttttcttccatctttgcccttttctggctcactcatttgctcttcattttttttttggattgtattttatttatttattattattattttaaattttattattattatactttcagttttagggtacatgtgcacaatgtgcaggtttgttacatatgtatacatgtgccatgttggtgtgctgcacccattaactcgtcatttagcattaggtatatctcctaatgctatccctcccccctccccccaccccacaacagtccccagagtgtgatgttccccttcctgtgtccatgtgttctcattgttcagttcccacctatgagtgttgctcttcatttttgtaccaattgatggtcagttcatcaatagaatttgttttaaaattctgacaatgaaaattccaatttcaagttctctagtttttttttaatgttattattattattttttatttttagagacagggtctcattctgtttcccaggctggctttgaacttctgggctcaagttaccctcccaccttggcctcccaaagtactgggattacaggcatgagccactgcacttggcccataggtttattctttatcatatttttatgcttgtggtttgaaatttatatataaatgttatttctctttttacatataattattttgtacctatatttatttcaggtaacaaatcaaatggtaacagcatgtaaagcatatattactgatggaggattaaaccatgtatgggatcaggaaacgccagttgtactaaagaaaattcaggtttgtagaagtacttttattttcataaactaaatcttttcccatcctgcccaattttactttgtttattcacaaaatatgttaactgaaaaaacttcctacagagtagtgttgagaatataaaaagaatacaattcttattatctatttccctttatatttagtgcttctctgagggtaaaatttaattctcatctcctccatggctgcctgtgttagactcctgtgtgccatttcatacgctctggcccctacatctcattccagcctgttacaattaaaatttttgcctttttttgcattggttaggattaccatgtatccttaaatagacatggtagtagttgccatcctaattttgatcctggtttagaagacaatgtttctaacgtttcccccatttagttggatgcttttgtaagatttaaatatatctttgatcagattagtttagtaccaagagatattttttaaagttatgaatgggatttggaaaattttcttctgcatatatttattgagatgcttatagaattttgctcctcagtctgttaatgtgatagatgacatttttagactttctaaaattaaactgtcctaacgtttctgggtaaactcaacttggtcgtggtgtaattatctttttaaaaaacactcaaattcagtttgctacagttttgtttaggatttttggaagctgtattggtgagagagagaacctgtaattttcctttcttatgctgaccttgtctgtgttttggcatcaatgtctcagaataaatggagggtggggggaagtattttctattttctgaaaaagtttgtataaaattaaagtgacctgttcattgaaagtttgaaagaaatggccacagcaggaaggctccatctggaagtggttattggtcatctctgtgtgcaggttccctggtcttcgtagtgccaaggtgtgtggcttgaacagggaggtcaagtttgaaaagtggcccagtgccctccacccaggatgggaaccattattcccacaggcctggtgctgacctgccatcctggccagggcactgctatcacccttgctctgacctctgaactggaggataagaagaggaagaattgcagttagtgtttctcatgctgaaaacagttgatcccaaggactggaagaatcaggatcattatgcagttcttggacttagccatgtaagatacaaagctacacagagacagatcaaagcagctcataaagtagtggttttaaaacatcatggaaagcagccagtgaaccaataaaagaaagggataatgactacttcacttgcatcactgaaattataaaatgtatgacccagtgaaaagaggagcatttaacagtgtagatcatacatttggaaactcagttccttctaaaagtgaagcaagggatagtttctttgaagtgtttttcccactattcgaaaataattccagatggtccaaaaaaagtttctaaacctggtgttatgaattcatcattttattccttctggtatagtttttatgcttggacagagttttcttatttaaatacagaagaaaaaaaagcagaatattgtgacaagagagggattgaaaagaagaacagagcaacaagagctcaaagaaagaaagaagaaatgaattgaaaacattagttgataatacacatagctgtgatacaaggataaaaaaattcaaagaacagaaagccaaggccaggcatagtggctcatgtctgtgattcttgcactttgggagaccaagacgggtggatcccttgagcccaggagttcgagaccagcctgggcaacatgatgaaaccctgtctctacaaaaaacttagccaggtgtgttggtgcgcacctgtagtcccagcaacttgggaggctgaggtaggataattgcttgagcctgggaggctgaggctgagtgaggtgagccgtgatcacaccactgcactccagcttgggtgagagcaagactctgtttcaacattaaaaaaagaagagaaagccgagaaagaagcaagatggaagaagcgagaggctaaagaaaaacaaagacaagctgaattagaagctgcttgaatagctaaggagaaagaagaggaagttaaataaggagcattgttggcaaagaagggaaaagatatccagaaaagagttgttaaaaggaaaagacaaaccttcaaaattcaaggaagacctgaaatcactttttctgacaataagtggagcagcttaaaaaggtggaagaagtggaaaaactttgtgataggcttcaactagcaagtttatagcacttcagtgaaatacctcatctacaaaaacactaggaatggctgctctcctaaaaacggaagaaataaatgagccaattagaacagagaaagaggaaggggaggcttgtgtgtgacaagcatctaagaatgcagagaaatcaactgtcgaaggtggaaatggcagtaaaaattggtcagaggagcattggtctgcagttactaattaaagccataggccccttttctgcatgaacaaattcaatatgggaagttattaccaattatatgaacacacattctttttttggagtcaagagaactttttggcaaagaaaattgagcctctaaaaacttgaccctcacaaaaaaaagatgacaaaaaaggctttggataacctttaaaagaacatggaatagtctctcaagtacatgaagtaggcctccttcagatgtacctgaagatgaggaaaaatagagggagcagtgcctggcaggacaaaagaggacctcaggaaacaatataaggaagttgttgaggtggtaaaggcaatgaaatgcccaggagcaactgctgaatgcaaatggagccgagaaatgacttatggacagtctttgttgtgtatgcatttaaaaactaaaactgataattggagatgctaagcaccttttcaaatgcctgctggctatttgtatgttttttttttgagaaatgtcttttgaggtcctttgtccattttttaaatgtttttttttgagacggagtctcgctctgttgcccaggctggagtgcagtggcacagtcttggctcactgcaacctctgcctcccaggttcaagcaattctccggtttcagcctcctgagtagctgggattacagatgcctgccaccatgcccaggtaatttttgtattttcagtagagacaagggtttcaccatgttggccaggctggtcttgaactcctgacctcaagtgatcctcctgcctcagcctcccaaagtgttgggatcacaggcgtaagccactgcgcctggcctcatttgctcattttaaaatcaggttatttattttcttcctattgagttgtttgagttccttatatattttgggaataaacctctattagatatatggtttgcaaatactgtcttccagtctagaggttgtctcttcactctgttttcttttctgtgcaaaagctttatagtttgatacaatctcatttgttttttttgtttttgttgcctgtacttttggggtcacgtccaaaaaatcattgccaagtagcttttccccgacattttcctctagtaattttacagtttcaggtcttatctttacatgtttaatccactttaggttgacttttgtatgtcatatgaaacgatggttcaattttattgttttgcatgtggatatccagttttcctaagaccatttattgaagagactgccctttcctcattgtgtgttcttggcacctttgtcaaagatcagttgaccataatgcatggatttatttctgggttctccattctgtttcattggtctatgtgtctgtttctatgccagtactatgctgttttgattactatagcttggtagtatataaaaatatactacagtataaaatcaggcagtgtgatgcctccagctttgcaaattaaaaaccacaatgaaatatcagctcacacttgttagaatgcctactacagaaaaagacaaatgatagcaagtgttggtgaggatgtgcatgctcttggtaggaatgtaaattagtgtagccattatgaaacatagtatagaggttccccccaatattaaaaatagaactaccatatgatccagcaatctcatttctgggtaaatatttaaaggaaatgatataactgtctcaaagagatatctgcattcttatattcattgcaacattattcacaatagccaagatgtggaaacaacctaagtgcctgttgacagatgaatggataaagaaaatggggtatatagggtatgtatgtatatatgtatgtgtttgtatgtgtgtgtgtgtgtgtttgtgtatggatacatatatataatggaatattattcagtctttacaaagaaggaaatattgtcatttttgacaacatggctgaactttatttcattatgctaagtgaaataagccaggcacaaagacaaatactgccttttttcacctctatgtggaatctaaaaaagtcaaactcttagaagtggagagtagaatggtggttaccaggggctggagagggatggcacaatgacgagatattggtgaaagagtacaaattttcagttatgcaggatgaataaattctggagatgtaatgtactgtatgatgactatagtacacaatactgttttgtttttgttttttgagacaaggtctggctctgttgctcaggctggagtgcattggtgccatctcagctcaatgcaacctccgcctcctgggctcaagccatcctcccacctcagcctccctagtcactgggactacaggcatgcaccatgtattgtatacttgacatttgctaagaaagtaggtcacacccccaaccccaaaaagtaattcacaccccccaccccaaaaaataactatgtgaagtgaggatgtgctaattagcttgattttggaacatttcacaatgtatacatctttcaaaacatcatgttgtataccttaaatatatataatttttatttgtcaattatacctcaataaaactggaaaaaaataaaactggaaatactgaacaaaaagcaagtctgatagaaatcatctgttaagcatctaggatcgacattttctttgtgaaaagatttttaatttcctgcttctctttttgtataattaaaaatttttaattatgataaaaatagcataaaatttactattttaaccatacagttcagtggcattaactacattcacagtgttttgcaaccatcactgctatccatttcagaactttttcatcattctaaactgaaactctgtagccattaaataattccccaaactcaggccagacgcggtggctcacgcctgtaatcccagcactttgggaggctgaggcgggcagatcacctgaggttaggagttcaagaccagcctggccaacatggtgaaacaccgtctctactaaaaatacaaaaattagctgggtgtggtggcaggctcctgtagtcccagctactcaggaggctgaggcaggagaatcacttgaacctgggaggcgtagattgcagtgagccgagatggcaccattgcactccagcctgggcaacaagaacaaaactccatctcaggaaaaaaaaaaaaattccccaaactctctgccctagcccctagtaacttgtatttactgtctctctttatgaatttgcctattctaggtacctcaaataagtggaattaaacaatatttgttcttttgtgtctggtttatttcactttgtgcaatattttcatctacgttctagcatgtatcagaatttgattccctttatagctgagtaatatattccattgtatgtatagtccatatatttttatccattcctctgctgatgcacatttggtttgttactaccttttggctattgtgaataatgcggctatgaacatttggtgtgtaagtatctgtttgagtccctgctttcaattctgctgggtgtattcctagaagggaaattgttgggtcttatggtaattctatgtttaactttttgagttcctgccaaacaattttccacagtggctgcaccattttacatttccaccagcaatgcaggagggttccaatttcttcatctccttgccaacactttttattttctattattttgataagagccattctaatgtgtatggagtgaagtgacatctcattgttgttttgatttgctttccctagtggctagtgatggctgagcatcttttcatatgcttattggccctttgtatatctttggagaaatatttactcaggccctttctccatttttgaattgggttgtttgggttttttgttgttgttgttgttgagttgtaggatttctttatatattctggatattaattccttatcatatatatgctttgcaaatacactattgcttatttgtctatttatttattttgcttgttcgttttgagacaaagcctcactctgtcacccaggctggagtgcagtagcctgatcaagttcactgcctccttgacctcctgggctcaagggctcctcctacctctgcctcctaagtagctgggaccatgggtgcatgccatcatgcttgggtaatttttttatttttgtagagacaaggttttgctatgttgcccaggtggtctcaaactcctgagcttaagccatcatctgccttggcctcccaaagtgctgggattacaggcatgagccaccacacccggcctgtttattaaaaaaaaaactatttgactatactttctgtttcttcttgagtcagttttagtaagttgatattcttggggaatttccccaatttgtctaaaatttgtaatttattgacttattgttgataatattatcttactaaactttgtcttactatataagatgtctccttatttactaatattatttatcttctttctgttttcctaatcattcttgctcccctcatacccagattcaaaacaacttatcatcttcctaggagtttctcatttctgttgtttttattgctacttgcaggattccatgttttcctctagagcttctcttgttatttttgggaataggagtcagaaattactccccccaaatttgccaattggcaggaaccataactctttacatagaatttagcaatgtagtctcattattcttttaaggtcctaaagattactagccatttactgactgaattagaaatgggaacttggttttctgaattctagttcaatgtttctattacatctgaaatgttttcaggaaactttcagtgtatactttttaggaataatttttggatgagttggaggaaacaatgagaattgttactcagaatcttatctgagaactgttattcagagccaactcatttaaaaaaatttttttattatactttaagttctgggatacatgtgcagaatgtgcaggtttgttacataggtatacacgtgccatggtggtttgctgcacctgccaacccgtcatctacattaggtatttcttctaatgctatccctcccctagcctcccaagccagctcatttttgttgaatgagtgaaaaataatcagagacctcaaagagagcaatgataattgttttggagattgtgatagaggaaagaatgaggccaattattctcagatctgaatatttataggaatcactataggagagctagttaaaaatatagatttctaagtcccacttgcagaaattctgatttagtggctgcagtgggcagaataacggcccccaaagatgtctgtgtgcttatcctcagaacctatccataggttatgttacatatggcaaggggtgattaaggttgcagatggaattaaagtgctgatcagctgatatggggattacccaagtgggcccaatgtttaagggttcttatgtgggcaagaggaggcagaagagtcagaatctgagaaatggtgttatgataaagatttgactgggtattgatggtttcaaaaaagtttaacattaacaaaaaagatttggtgtttaggaaatgttagcttgacataatagttaattcctactctacccagcaatcttattctcttttttatttctattatgttcacaaaccagaccagtatatctgtagtcaaatattaggatttcagcaatgtactcatcaaagactttatgaccctcttttggaaaaatgattgtcagatgatagcttcgtatgacagaaacttcatattttatatacctgcgcataaagaatgctgattctaagatggatgcgaactgaatagagatgtcttgatagataatttctggacctcttgggagttctaattgtcatgaaaatgtaaaaacaaatagtatatggtatgctttgatgtaggataagagttaaaggaaaacaatgaggatgaataaaagtgaggttgaaatgaggatgaaaatatggtataaataaaaaaaaactatacagattttcacagtttgatcagttctgtgtgagggtagagtttttgaattttcgattcctgaacaaatgtctcactttcttttccctatttcttttacttttctcataggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaaggtaagcattatgcagtcatcgtaccccactccacaccacacctttttggtgattttgtactttatgtagtgccattgagaattattgttcctgatctcttgtccactattgttatgacttgtctaatattacttataggtcactgcattttattataacttattttttcattcctggttactgccttctgccagtaacacaaacgctatggtcaactttcacatctctcaagacctcagtttacctctacctatgaaacttcaacttaaaaggctctgcttttaactgttatattaggctgagaaaaagtatgagatgaaatacctgcaatgcctgatagaagtcagtagttgtggaatctccggatgtataagcatgtcctctttctgagccagtgtatatggtgtatacaaaaacattgtgcgggtgatatcttttctggacagacataggtttgattaatttattaggactggttgggaaggagtgacatttttttgggggatataggccagcccatatcagagacttcttggagtcatcctttgaaaagtctgtaaagatctcatttaggtattcttcccccaacttcgctaattccctggatcctgctagtatttagaatcttgttcatcatttgttggaaagtaatgcggaacattacataggttgaagacctagacatgtttggaagcctatttttattagtaacttcctgatcaagccaggacaggaaagtatgagtaatgaacagaaccaagttgctgagtgggatccttcatacatacttctttgaagctgttttttaaatttgtttctttaacagctttattgagacataattaatatactatttacccacttacaactgtacaagtcaatgttttctagtgtattaacagggttgtgcaatcattaccacaatctaattttagaacattttcactcccactaaaagaaaccttatgtccattatcagtcacaccccattctctcctctccccagttttaagcaaccactaatctactttctgtctctatagatgtacctcttctggacactttatataaatgaaatcatacaatatgtggtcttttgtggctactttcacttagcataatgttttcaaagctcatctatattataccatttttcagaacttcattccattcatcattgaagaatattccattgtacggataatatcagtttatttttctactcatcagttgatgaacattgggattatttcctctttttggctattatgaataatgttgctatgaacatttgtgtacaagagtttgtgtgggcatatgttgtcatttctcttgggtatatgtgcagaagtagaattgctaggtcatatggcaaatccatgtttaactttttgttgataaccccaactatttgccaaagtagctgcatcattttgcattctaacagcaaagtatgaggtttatgatttctttttttttttttttttgagacggagttttgctctttcgcccaggccagagtgcagtggcgtgatctcggctcactgcaagctccacctcccgggttcacgacattctcctgcctcagcctcccgagtagctgggactacaggtgcccgccactacgcccggctaattttttgtatttttagtagagacagggtttcaccgtgttaaccaggatggtctcgatcctctgaccttgtgatccacccacctcgacctcccaaagtgctgggattacaggcatgagccaccacgcccagctgaggtttatgatttcttcatatccttgccaacatttgttattatctgtccttttgaatttagccattctactgggtatgaagtggtatctcattgaagttttgatttgcatttccctgagggctaatgatgtggagcatattttgatgtacttttgcccatttgtatatcttcttttaaaaaacatctattcagattctttgcatatatttaactgagttatttgtctttttattgttgagttgtaggagttctttatatatgctgggtataacttccttatcagatatatgatttacacgtattttctcttatttttgggttatcttttcactttcttgatggtgtcctttgaagtacgatagtttttaattttaatgaagttcaatttatcatgtttttcttttgttttctttgtgtttttaatgtcatatctaaggaagtgttgtgtggggctgttttatgcacaatagatttttttaaacatttttatttattaaattaaaaaaattgagatggggtcctgtttgtgttactcaggctggagtgcagtggcatgatcatagctcacttcagccttgaactcctcagccttctgagtagctgggactacaagcatataccaccatgcctagctaattaaactttttttttttttttttttttttttttgtagagatggggtcttgctatgttgatgagctggtcttgaactcctggcctcaagcagtcctccttcctcagcctcccaaagtgctggaattataggcatgagccactgtgctcagccaatagggatttttttgggggcaaatgttcagttaggctactagcacaagtcaaattaataaataggtctcattggtcaggacaaagatgcttaatgttctgactccactagagcaaaaacctggaggtgggtctcagttacccctacccctattttcctggagccagaacccttgcccacctgggtgtcgctttgaaatttgtagtttcaggactaaaccttattagtggtaaagatctttgggggtgggtctaatgctgagtagaatggtcatccatctgtgaaatagcagcccaggaattcctctgatgctagaggaagtggtctgtaatgaccagctgcatcagctgcacccactctggtctctggagaagccctgcctctagtttgaagaatacaacttcaagccacaagtgctcagcaaccagagctaaggtagcaccccctagaggccttacctgaaatgcatcctgattgctaggttatcccagctcctctgtgctaagaacgacagaccggcatctttcccattggataattggtggatattggtgtccagactctcaaaggtggggctggcgaacttaaccctgaagtatgtccaggattttacataatccacaagaggtggttactgagctgcccaggtgggcttcctctgatgagtggggtacggaaggggcaactgtttgactacccttgtgaactcttgcatagatgaagaggagagccacaagtgtgcactaagagcctattagggaaggccgagattcgaagttggaatgaccaagtggcaaagtcgaagggcagacaagactgatgttggggttggagagctgagatttcagagttagacagatatgttggggcccttcgaggagtaagtgaagaaggctctagtgtgtcagtgttaggatgcctgaaacacatctttttatggcaggtatagacttgatggtgcactgaatcctaaatagcaagaacgaaatgtgtgcaacagtctttgcttcttcctcttcctgccatgtaaattttggtgaatattggtgtttcccagagctctatcttcagttttgttttcttctcaccctgaacatttgtgggagagaagagaaaaggtggagagctggtattgctgggggagatttgaggatctggagctagtaggtgaggtagggtctccactcatggtgatgctgagatgagggaatcacagcaagtcgagaactggaaagggtgcaaggttggtgagccggaggagagactctgcattggtggtgagtactgagagattgaacattgatagagagatgttgaaaaagccagggccaggacaaactagcaggagcatggtcttggttgattcccacagctggctttatgttgctctgtgtggtatggggacagagggtacactggctaagtttgaagggcaagcatgggactgaccaccatgtctgcctcagatgacccctcatccaaccaatcaacaaaatagaggacatgttagtgacaggaattttgtcctagtctctggctgttggagccaggtggtagagtaatgaggtaaggggtaaaggaaacagtcttagcaggttagaataacagagcaagccagtagtagtttgcttttgctctttaaagtaggtgagtggagtatatgtgttaggaggagacccagatagttcctgtgtttatatagagcatgcgcagcatgctgtaaatcccagtggcctgtatttcctccatgtttggagtggcttctaggatgataatggtttttggaagtgtatggaaatagtggagtaagagcaacagttgctttgaaaatagtccttctgggtggccatacacagggattcatatgaattctgctggctatgtaggaggatcagtggtggtgtcttcatggtgtgtgtggtatttggaagattctctgaaaataggtttattccctttctggccattggaccagccctggagagcattgagcattgttctctaaagcagaagtcaaaatggggaagcgtaaggaaggagtagcctgtggacatgaattttttgtttgtttgttttggtgaagtaggtggtgtcaggttgagacaaagacagccatttctgaaatgaagtccactgtgagggtttcccaggtctcatcaggggtcaggaatgattgctgccattattcaagcttcttggaccagtcttttaccagaacacaggcggatatgtgctaatgttaattgtcagaactatagtgagggccaaacagcatggtggagcttttgagtccagtaatccagtgaaatgattttcagaaaatcctcaagagaccacaggatgaagctatttagtcaagctccccgccacccttgaaagacaagctgattgaactctgaaaaaggttgtgaactctctctggatatgatagaacatcttctgtcttagtctaagagtaagaatgacgggtgacagagatttgtcttctgttttatctcctctggttggttttagcgaaattattctaggccctgtttaatggtttgtgttttatatcaatgattcattaagagcttattttagggaagttgcctgctatctcatttaaaaaagcaaaataacatttctctttttaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtaagtaattatacctacttttacttagtaaagctgaaaagtagtcagtagtactatctggtactttttgtaaatattcacatgtagtaagtgtttctatatttatgatttaagttcctctttcacattgaccaaacatatttgcagtgtgagtaacttttaaactactccactaaaggatttttttttgaatgaatagtgagcatatccaataaaagacatcagagagtaactagaagcccaaagggcttttatagctaggattcttttttttttttttttgtgagatggagtctcactccattgcccgggctagagtgcagtggagcgatcttggttcactgcaacctccacctcccgagttcaagtgattctcctgccccagcctcccaagtaactgggattacaggtgtgtgccaccacgcctggttaatttttgtatttttagtagagacagggtttcgccatgttggccaggctggtcttgaactcctgacttcaggtgattcacccacctcggcctcccaaagtgctgagattacaggcatgagccactgcacccagcctcatttttaatatacattaaaatttgtatttgcttcttgtgcctaggagcacaagagagcatttgtaaacattattctttatcaagtgtgatgagatttgagaacagattaggaagatggatcactcttcctgtggccttatgctttatgcctgcattctctctgcagctatagagggcagctctgaagaggcattcatatcctgtgtgtcatagattaagagacaccagatggatgaagggtagtcagaaagtatgtcagatgagactgtaagatgtttttctctcaccttttgggctatatgacctcagttactctctactgttaactgaaactactgttaacctacgtttagcccaagggaatggtttcctcttgctgcagaatttcctggagacacaagcagggagaagaatatactttgtacactttttaagtctgatatccttgccatgaaagtgagaaaaatcagatgtttttctcaagtatttaaaaaattctttaaaaactacattacacgtaacctgggcaatataaatacataagaaagatcctaaaattctaccattctaacgataacactttttgtgttttggcatagatttcctttcagtttttgaaacttagactctttgatatgaagatatattatattttaattattacttttagtgtttggctggttaggtagggtggagtttacttccaaaatgcttcgaaagttaaatctttatggcaatgggaatttttgaaaaacttgttatctcttaaattatttttatgatttattaagaaagattatatgttataaaggctttattgtggacttagattcaaattttagctttcagtaaattacagcaatattaaccttttaatagttaaataatttacttgaggcatcagtgttttaattttaatttttcttcgttttccaatgtttgatttatgggtgtggtatatattaatagaccataccaatatgatctatacatacaaataatttgcaaagaatggttcagttccatcttttgggtaccgggagtttggagttcactgttagggatggtgggaatatttatttatttttatttttatagagacgggttcttgctatgttgcccaagctggtcttgaactgctgtcctcaagctatcctcccatctccccccacaaaaggctgagattacaggcatgagccaccactctgggccaatggtgggactcttgaaagaacattttctacttcttgtacgtccttagcagtggcaaagaggtttctgagagcagcaatgtcagaaaatgacatctgctggccctggtgtctatagcgtcactacactactctacctgaagttctatatatcccaaagaaaaatgcttgtaagggaccttcactccttttgtaaattctctagatcagaaatatccaattggtaatgacctgcaaaggcaaaccacatgtcactttaatttttctagtagccattgaataaaagtaaaaagaagcaggtgaaattaattttaataaagactctattcaacccaatatgttaaatattttaatgtcattaatatgaaatctttaatgagatatattgcattctcttttttgtactaagtctttgaaatctggcatgtattttacatttatagacatcttgcttctaagtagtgacatttcaagtgctcagtagccacatgtggccaaagtccatcatactggacgatgcagttcttgatgcttagatggtagatgtgtttgaggcttgaggctatcttaattctgtaggaaaagcattaactgttgttaaacaaaaccaatctctttaacaccaaaaatcatttaaatattaatattttattttaggtacaaatacaggcatttatgaacagtagttttgggaaaatcttatcttctcagcaggctcttcagctacttcaaaggtattcataacactttaagcagagtagtttctggggggaataactttaaatctaaaaatacaatttcaaattaggatgttgttggaaatctgtcctacataaaccttaaaacttacaaacataaacttttcaattaccactaaatagactggtaaagatttgaaataaagaatgatatgttctaattgcattgttttggtagcagaaagtctttcaacaagaaaatgaaattatttctcatgtttcccctccctgcccccagccatgtcatatgtttggggttaattttataggtattgttggaaagggaacaaataatgtttacttctacatactgaaagaatttctgaaagtgagattatctaagaataatagattccaaaactttccattttccctcctgagggctcctgcaccttaaaagaaattgtgtatacttaaggtgtataacatgatatttttaaatatgtagtgaaatggttgctacaaccaagccagataacacattcatcatctcaccgagttatctgtcccccacatttttttgtggtatgaacagctgaaatcttctctcctttagcttcctttccctctatcctaacagcactactctctcaaagggcgaggaatcccagattagagggctgagcgggactagaagcctttccctttcagcacagggagggctcaagacctgtgtcagggacgcttgtggaactcttccctgagagccagcggatctagtgttgggtctggctttgcatggttccacggctgtaatgatggagacctggtgagaccattgtaaaaaaagtcaaaacagaaataacataattttgacatgtgacagtactgcacagatggcaggtaccattttcttggcgacttctgtctctgtctctctatttctctctgtctctctctttctgtctctctctctctctttttacctgtagtatgctgatgtcaattcattttattaccagaatgttgtagtttttagtatttcctgtgtgtcattcagtctctgaatggaagtgacatttagctgacaaagttgtttttgtgattatggttaaatggttatatggaattatatggaattaacactggcagagggagagtcaatgtgttctcttccatctttgctaagccatctcctcactcatcttgtaatctgtttgtcattttctcagggtgtcttacttgaatccccagacttgtctaggtctctcttagttataggcatttctgacccatttgtaatttaaataattatttttgttactcttggcagatgtctgtcttttccataagataattgtgggttccaagagaaccaggactgtacctcctatctcgttcattgctttgtcctaggacaacgaatgagggctggtatgaatatttgtcaaatgaatgaatggatggttagtatgacagcaagtcttaagtatatttctcatttactttttaaccattcagctttgattacttttaggtttcagaagctgaacattccctgtctgggattagaaataaaccacacaatagagcgtattcttcagtactatgtggctgaacttgatgctactaagaaggcaagtgtcatgtttataaataaaatggtacattagcacaaaaagaaaaaaaatctgaaaatatttgccatcattgtctcatgccaagcttttcagagtgattctttctctgctaaggagcattgacgctcccttctgtgtgggaaggtgcttgacagtgtatattgctggacagccagatttactcctctttgctgtgatcttaccagttatcccaccattatttattgagtaggaagtccttttctcattgtttgtttttgtcattgctgagtatgtacccaaaggaatacaaatcattctgtcataaagacacatgcacgcatatgttcattgcagcactattcacaatagcagagatatggaatcaacccaaatgcccatcaatggtagactgggtaaagaaaaggtggtagatacaccatggaatgttatgcatccaaaaaaaaaatgaatgagatcatgtcctttgcaggaacatggacgaagctagaggctattatcctaagccaactagtgcaggaacagaaaaccgaataccacatgttctcacttataagtgggagctaaacattgagtacacatggacacaaagaagggaacagtagacactggggcctactggagggtgggagaagggagaggatcaggaaaagcaactaatggacactaagcttaacacctgggtgatgaaaaaatctgtacaactaatcctcatgacacgagtttacctatataacaaacaaacaaacaaacatgtaaccctgaacttaaaataaaagttaaaaaaaaactatcatattgcccccgttttctggtgtgtgtatagcaaagcccgtttaagttagtatttttgcctatagaaatatgggctctagatactattatgacagatattaatatgtagctatgtgctccgtttgaatacctccttgaaatttgggataagggcagaaaaaaaatacatgtaataggaaataaaggtgaagagaaaattaagtgtcgtatatggtcaacatcattgtttcaaaatctcaggttaccttggatgtgcatttacatatttattgactacctactgtatataaaacatgaataatgataaaacaatacaaatatagctgtatatattttttgccttctcccttgtattgaattcaaacattaacatcagatttttaattacagctttatcattctcagaaagatgacccccctcttgctcgcaacatgccccctatagcaggaaaaatactctgggtgaggcagctctatcgccggataagtgagcccatcaattatttctttgtaagccaagaattaaattttaatatgtggattttggtggttttaatataacaaatatatcatatcctataatatttgtgtgcattaaagtagccaacaacgagccaattcttttaccaggcaaggaaaatttagtttataaatatacttgagagagacaaagtcaattccttcaggtttagtagataagccagtctaattacagttatctcaaagtcagtgaatcttataattttatgtcttttaataacacaggacactttgtaaagccttttaaaaagtaaaaataaaaaatttgaaaacaataaagtacaggcctagcacagaagcttacttctgtgtatgggcagataggtcactgatacatactcagtgaaggtgaagataaagccaaagagtgtattcctgtatgaagaactgccactgagagcggaatataatacagttgattcattctctatgtccttcagattattagatttctgaaaaacaggacagtcttgggccctgttggcattctgaaattgccagtttgtcttttctttgtccttattattttcttaaattttatttaagagacagagtcacaaggtggagttggtttgcttgatctcgtgccctttgctgaaatatagaacaatataactacaaaacagtagttttgcaagtaattgtattatttcagcattattaaatatgaagattctgttgtttctcttttgctgccatcatttgtgtcattgttctgaatatcaaaaaaaaattaaaaccctgagtccctactcgggggactcagttgctgattgactttgtggtgagagggcagagattgccctgtttgacatgtgaatcgaaacctaaatcttttgatttttaaataaagaaattttatttattttttaaatatttatttatttatttatttattatggagttttgctctctcgcccaggctggagtgcagtggcgcagtctcggctcactgcaacctccgcatcctgggttcaagcaattctcctgcctcagcctctggagtagctgggattacaggcacccactaccatgcctggctaatttttttgtatttttagagagacagcgtttcactatgttggcgaggcaggtctccaactcctgacttcaggtaatccacctgccttggcctcccaaagtgctgggattacaggcgtgagctacggcacccggccaagaaattttatttttatcgtttgatacatggttacctttttttgcgtgctggaatttaggaatttgccctgttattcatggttcaaggaacatcagtcaattatatcttgtccagaacagtgggatgggatcagaaaaggaggtagagacactgaatgcctggggcaggctgtggggctggaggcctctctctttctaaaccctttgtttccttttccagtcttccctctatatactgataacgtttccctacttctgcttcttgctgatatggccttccccatctctgttttactgtgaggcagaatctaaactggtagcataattatttgatatcattttacatataagtactttcattatttggatataaaaacattcagcagtcttttaaagtaaatcttttcccttaaaaaaacagaaaaactcagacattttatcaagtccggacggtaaagctgtcatccgtcagtataacaagatctcctatgtgctggtggaattcgaggtggtctatcacacagcctggatcagagagatttcacagttgcattacggtgtgtataacactgccatgagcctacaaagtagggattaggtgattttgaatgagttcatagttctggagaactttttccatcccttccacataatcttaggatagttacaatttagatttagggatgctacagtggtttatttgtttacagttgttaataatattctgattttataagtgaaaatgatcatgaccttgaagatgacatacttaacttaggactttctaccaaaaaccagtatttgaaagtaaaaatatctttagggatatttctccagactttatgaaagtgttcatattcagttgtatcatgatatagattcaaatctcagtcccattctggagagaaaaaattgcatcctgccttctttcctctctccctgcttcccttccttcctgtgtctctcctttactttctcccttttttattactgaatttaatttcaggtttgagctccagtaaatgaagcgttttagtgcactgtgtctgcgtgcctctgaggggagggcttatgtgttgccaaggctttgggcggagttaaatgtgagacgggatggttcttagccattatccagccctcctggatgttgtttttgtgtgggctcaatggttggtcagttcagattcctgctttgtctcatcttaaccttaaactcttagttataatctcaaccctaaactcttatacgtgaccttggtggaccccttactgggtcccttggtagaaaggtttctccctcccaaaccagcgtctccacctcagcagagcacagcattgcaggcgcaggaagcacaagttctgcaggtgggttgctggaacggtggtgagaggagtcactcctacttctgcctcttggttccagaactcatgtattttagctgtgtggggacacagcacttatttacaggccattgattcacagcatacctgcatcctagaggacagtgccccaacccccgcagggtgtcgtccctaacaggaaccgtaggtaagcctttaataagccacttttatcaggccagctgtttctgggtgctgtgctatatggtaggaccctgtggactctaaagaaagcctgtttatggagcagaactctcaaaggagcttcgagaggagcttaaaactcagactatggaaaaaggcaaaagagaatttttaacaactgaagcatatactggttttgttttggttctacaatgccgcgcacttaattttctttttctcctggtggtttttctacccccaataccctttctcttatctgcacatattcaaaaacaagctctacagtcacctgtttcatacagcctttccttattcttcctggcagaaaataataattcctccagagcccaccatatactttatctgtagctctttctcaggacacttactgctttatagatctaccttgtgtcccctacaccttccaaggttaccctctatgtctgtttcatctgatatcctttaaaaaatggtcatagctaacatttatacagtgctcaccatgtgccaggctttgtctcagcacattacatgtattatgcaaattactttaatcctaacagcaaacctacaaggaactattattagccttgttttacagatgagaaaactgagacactgacacattaagtggcttgcccaagatcacacagctcattcaaattcagatagtctggcttccaaatccgttctcttaaccatttaaaatactgtactgtttctaacagtgtcaagaatgatgccaggcatgcttgggggctcttaaaatattttaaaaatgtccaataagtagacattagacaatcttgatgagtaataattttatcaagttttcagaagagtttgttccccttgagaacatcagttggcctctattgggtgcactatactcattgcagtggattgatgtccaggagaagtgatcacatacaaacaatatgaagtagaattctttcatactttcaatatgaagtagaattctttcgtgttttttcacaagtaaaacaaacagtcagtagaattctttaacttctttcatttcatttcagaaatgaattgctctggaaggcttcctttgtcctagtgatgtgactgtacttggccacataggagcttctagtaataattggatatgtagcatcagcctcctttagttggttgctcagtaaagtttctctgatggtggttcacatacgatgaaatgcttgtcttgtcctggagcagacttcctgactgtcattattggtctgttttagttgtcttgacctttttgtcttttcaagcaagctcagtacagttttaaggaagacagatttaaatgttcaaaagttcttttggaatttccttggtaggataagtgatttatttatttatttatttttattttactttaagttctgggatttctgcacctgtccacctgtcatctagattttaagccccgcatgcattaggtactttgtcctaatactttccctccccttgctccccaccccccgacaggccctggtgtgtgccgttcccctccctgtgtccatgtgttctcattgttcaactcccacttatgagtgagaacatgcagtgcttggttttctgttaggataagtgatttctaatccatcttaaaaagattctaagcgagttggataaaattttaagttgaaattgtcatttagcttgaaaacctgcatcattaagggccatatcaagactaattttatctgatgagtaaaagtcaactaacttcaaagagatatacaaactattttattttactagaagtttgatgtggccacattcaacaaaacaatgtgaggtttggaagatttggtaattgtgataaaattctcatgttagtagtgtttgttaatacaagatgtaattcaaactagcacatgcttgtctataataagtgttttattattatgcctgtagaagttcttcatgttaagctaacaaataatctaaggctacccagtaagaactgcttgggcttatgtatttcaattcataataaaatagatatctgaaaatgcttgtttatatgaatgatgtttatgtgagatgtagtgtaaaacatcttccctcctttccaggatttcacaactcaatggtatttaataaatatttcttactgattttgagcctatttatcagaaatacaggatggagatttaatttaaataagcctctttaaagaagacagtttggggtctgagtgggaaagagtttgaaatgaggtggggcatcttttgtgattctaaccatcttctggttctttctcaggggtgaagtcataatccataagataaactgacatagacctattcaacccactcagaaaaatattgcaattcatagcacaaagcaccattcttggtcaatgtttctctccctggatctgattttgtggctttgcagacactcttcattcatttatcttagttttgagtattcactatgtgccagacgctgtgccttagcacctggggcatccaaaacatttcctttgccctcaagaagttagtaatccagggggcaagacagaaatataaacacagctggaagcagaaaggaaattcagaatgagtaatgtcaatcattatttatttgtagctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcaggtaagatagattatgttttctaattatttttgaaggagttttttggtaaaaaaaatatgtatatatatatatatatccctgcagttatgcttcatggcattgagggaaaatttgttaatatgttgattcttgatagaattaaaatactgacttgcaaaccaaagaaaagattggaaatggaaagcaaaaagtgagaagattatcagaaatcagatttaggtttctggataatgactgacgaaatagcaagtttcaaaaactattcttaatataattttatagatcttgtgcattaaattttataatatacttatcctagaatatttataagatataaattaataaagtggggtgactatacaatacaagtagaggtgattctcaacattgtggggcaaaaaggagcattatttcaattaaagttcactagtgcggcaaagtaaaatctaacaaaatgaaaatggtaggcaaaaactgacattaacatgtactgccgggtgcagtggctcatgcctgtaatcccagcactttgggaggccgaggtgggtggataacttgaggtcaggagttcaagaccagtctggctaacatgacgaaactgggtgtggtggtgcacgcttgtaatcccagctacttaggaggctgaggcaggagaattgcctaaacccgggaggtggaggttgcagtgagccgagattgctccactgcactccagcctgggtgacagagtaagactccatctcaaaaaaaaaaaaaaaaaaaaaaagtgccatcaaaggttgatgattgattcaatctttgattcaaaggtcgaatcaaagtatattcagatcctaacacattgtttctaaaatgtttgacaagagttaagtaacatgagaaattctttagaaagccagttaaaacagcaagctgcattaactcctcttctttgcttttcttggcaggctgtggacatgtattttggaatgcaggaaaatatataaatgcaaggacattttttttccagtacaattagtaatagcaaaagactggagtctaactccaacaatacagaactgattaaatatgagttataagataactatacagacattaatggaacagctgattattcaatgagaaaatgaactctattcctgtggtacaacatttataattttataatcaataatataataaataaatttcagacttttcctgtttttttttttgttgttgttggagtcttgctctgttgccaggctggagtgcagaggcatgatctcagctcactgcaacctccgcctcctgggttcaagcgattctcctgcttcagcctcccgaatagctgggactacaggtgtgtgccaccatgcccagctaatttttgtatttttagtagagacggggtttcaccatgttggccaggatggtctcgatctcttgaccttgtgacccacccacctcagcaacccaaagtgctgggattacaggcctgagccactgcgcccggcctattgtttgtcatttttatgatagccctcctggtgagtgtgaggtggtatctccttttgattttgtttcatttccctaatggctggtgatttttgagcatcttttcatatgcttactaaccttttgcatactttcgttcagcagcatctattcagatcctttgctcatttttaaattgagtatttgtctatttttttagttataaagttcattttaggttttaaatactatcccttatcagatatatgatttgcaaattttttctcccattctttgggttgtattttcattttcttgatggtgttctttgaagcacaaacattttaaattttgctgaagtccaatttatctactttgtcttttgtgtttttggtgtcatagctaagaaaccttttttgaatccaaagtcatgaagatttgtggcgtgttgtcttccaacagtttaatagtttagctcttaccaaaatagtatttaattgtcttttttttgaaaaaaactggagtaacgttggtattgtggaaactggatttggcatcaaaagccatgcatgagcttttttactggctagctgtgactttggaggattaggtttaaatgtactgttataaatcgaagctaatatagtttgcattacatcttgcaagattttagctagtattgaacaatatcaagaaagtcaaagttctttagccagtgtcaagtagaaataaaacttcaactacaagtaatgtataaaggggaaagaggaatcaagagctttgaaactattaggtaaaaattgaaacagtttgaaacagtttaagattattaatttggagataaagtaactcgaatctgcatttcccacaccacagtgtagtaaattacaaaatagtaaaaaattgatcatcatggatcatctctaaaacaacatctaagagataacataaaagcttattctgtttgtgtggaaaagctaaatttattttgactcgagaaagcaagtgtggcatcagtgataagatgaggatgttttaatgtgtcagaagataaggaacaaaagaggaaatgtgtaatgacagatatcacaaaaagataataattcaaactacttaatatacatctagaaagacaagtgataaatatgaaaaatgaagatgtagaaattgctactgacttgtttaaaggagatgctcaggtaatttacaggtacagagaaagtgtggtaaatcagcataagtttaaatgggcagctgtcatgatgacaggactacgaggaaactgggattatgaaaccttcctggaatgaatcaaaatgtgactgctactttaaaatgaattaaaataaaacatgccatttcaacttcctacagggtcttctgcaatattatgatgagttatgtcaggaagtgccttctgtgtttgtcaatctgatgaccccaaaaatgaaaaaggttggtattgctgaaggtttgtattgattttcctgttatttaaaattagatttcggttctataaactatggattttggaacatctattcttctttagaccctccatctttctagttcaattttatagctctgttttttttttttctgcagaatttcttgtctaagtttcgttgcctttgaaaaaacaactaaatctaaatcatgagcattttttctgaaaattcatgattgtttcctggacagccaaagatggttaaaaataaaaagtcatctttattaggtgtaatagagggaaaatacatgtaagaaaatataacatataatatttgtaggtgataaatcctcttctataagtgcagatgctcctgttgataatagaagcagttgtgtttttaccgtttctaggtggaatctgtgttgaggcaaggactcacagtgttaacatggtcgtctttaacactggaaagcttctttcaagaagtcgaattagttttggatatgttcaatcaacttttaaagaaggtatgatctatacatttaaaaagctatcaacatatatactcaggatataagtaatagtttgattattatgaaagctctttaaagggtatgacttttaactaaaaggacatccgttaggtttaaaatatcatgttttgggctgggcacagtggctcacacctgtaatcccagcactttgggaggccaaggcggatggatcacgaggtcaggagtttgagaccagcctggccaacatggtgaaaccccgtctctactaaaaatacaaaaattagctggacatggtggcgggcacctgtaatcccagctactcgggagtctgaggcaagagaatcgtttgaaccagggaagcggaggttgcagtgagccgagatcatgccattgcactccaacctgggcgacagggcaagactccgtctaaaaaaaaaaaaaacaaaacaaaaaactttatatttcttttactggattggggtcttcatttaagtttgctttattcttatccctgaattaccttgcatttaatatgttgaaatgatggttcaacttcacactgtagcttagaatatggggtaattatagactgtcaaaagtggcagaggagagtgcttaaatattaatattaatgtatttaatattaactagatgagatgatcatcaaattgaagattgtctattgatttctgacatattggctacatagaacaagcctgtcattttagatgtgctggtctgtgtgtcatggcagcatggtgtagtaaacaaactcagaggctttggagttagataaacctgggtaggattctctgcctgttactagctatgtgttccttcccaggttgctttacttctcagagccttggtgtctttagttgtaaaactgggatatcagtgcctcctgtgctggaatcaggattaaaggagataacacaaataaggttatggcacatgttattgctcaagaaaaatttagttttatgtcaagctttctttgcagatgtcctcctaaaatgttcaccaaattatgcttggctcaagatgcaagtttctagacttagccttctaaattaatttataactcaagcctcttttggatgaaaacctagctctaaaggaaagaagagtttttttttcttacatttttcttccttgtagatcagtgacttgtgtgaaatgcatattgatacagttctgaaggagatagccaaaactgtgttgatttctctgcctgaaagtggtgctaccaaagtagaagatatgttgaccctcaatgaggtatgcatttgttcattaaattagaatcacaaaaatattggcctataaacctaaaatgtgaaatttcagtctaaaagtagaaacctgggtcagtagcatttagactttttttttttgttttttgtgaacattctctgctccaaggactttcatgccttcaatagcaagagccctggccacaacctagactaacattttgttgatatcctcagcctaatgctggcgtttcctggggctctgtaagtggttcacagctctcttccactgtgcatggctaccagggccatatcatttttctcatggctttaactccaacatactttccctctaagtcactcagaaacctgggaatcatctagacttctttcctcaccccttcatttcctatatccagccagtcctgagaggcttagccaggacttttttttttgagaggaagtttcactcttgtcacccaggctggaatacaatggtgtgatcttggctcactgcaacctctgcctcccgggttcaagtgattctcctgcttcagcctcccaagtagctgggattacaggcctgtaccagcacacccggctaatttttgtgtttttagtagagatggggttttgccatgttggccagactggtctcgaactcccgacctcaggtgatccacagctttagcctcccaaagtgctgggattacaggcctgagccacaactcccagcctaggatttttttcttacttagattttgcttgagtttcagcctgttctttccctttctaggtcaggtcgttactgctcattttgactttagcaattcatttggtgatccaactggtctcgctgcttccatgtttaccctgacacatccatccacattgccatcaaatctgattgtgaaatgccccagcttaaatccttcttggcagtggcacatagtccttgcaggataaaatgtaacctcttcagcattgttatgttgaaactatttagatacctgtttatcctccattgactcaaaagcacaaagacaggaaccctgtctaaacattttcaaggaccagcacataatgcaacctctcttataaattcaagacatacatttatgttttgaactgaactctttctttttttgagacagggtcttgctctgtcactcaggttgttctgcagtggtgtggtcatggctcactggagccttgacctcctgggctcaagtgatcttcccatttcagcctcccaagtagctgagattacaggtgcataccaccacaacttgctaattaaaaacattttttttgtagagacagggtttcaccatgttacccaggctggtcttgaactcctgaactcaagcgatccacccactttggcctcccaaagtgctgggattacaggtgtgagccaccatgcccagccttaaaattatttgttctcagttttggggtcttgactataactgagacaacactaaacaacccattacattaaattagttaattaatttagttttttgagatgaggtctgccacccagcctggagtgcagtggcaagatcatggctcactgcagactagaattcctgggtttatgtgattctcctacctcatcctcccaaagtgctgggattataagtgtgagccaccttgcctgtgagatgacccgttttaacatcctgttcttggtgtgttcaagtttaagatgattatatcttctggattgggtgttcctctatcattattaagttttttatccttaagttattttgtttgatattgatgtaattataccagcttttttcaggttactatttttcagatgtgtctttttccattttatgactttcgtcctttttggattctcctattttagattttgttcttgtaaagaacatttaactgtgttttatttttaatctattctgaaagtctgtttttaaaaaactggtaattttgacctatttacattaattgtaactattaattaatatttttggaaatacttctactccctgccctctttttaaaatttattaacttatctatttctagatgttattttatattctttttcaaatatatgtgatctttttctcatgtctttattctatttttctttagacattaaaaaatattttatattttacaacataatttcactatctgaaaaaaatgggggagtctaattctgctctgtgctgtttctaccaactcttgcccagagtggcttgtttcttcctgttttttacagttttggattgggagctaatgcacacacatctatttgtgggaatgctggacagccttggttgagaacctgtttctttttatttatttctatgtgatgcctaggagttttaccaagttgggacaactttatgttggtttctcagaggatagaatttctaaagcttcatagattgtataaactcaagccccaaacctatgtaagggtaaactagttgtaaattcccaagggagaatttgctccccgccagcccagagcctcaaccaaggtagctgactttcctttctcgtccactctttccctgagggcctagcccttgatttacctgatattaagcaagggtggggatggggtaggtctcatttctagcctctcacccttgtgagggatccaaggccttaattttttttttttttggttatgaaaaaacaaagcccatagaagctatggtttcaggttgctttttattttagtttctatgctttaaaaaaattgagatgtaacatatactcagaaaagtgcacaaattttaagtgcaccattcaatgaacgtttacatatgatacacccttgtaactgtctccatgatcaagatatggaacactttctgtatcccaagtgattcctttgtgctttactccagccagttacacttccttcccacccctaaaagtaatcaccatttgacttctatcactgtatattagtttcgcctgtttttgaacttcatgtaaatggaatggtgcagaatatattctctatttctgacttcttttgctcagtgttatatgtatgagattcatctttgcagttgtgacacattcgttctttcatttcaacttctcattgctgtatagtattacataatacggatttagtacagtttatttgttcattctactcttgagggcatttagattgtttatagcttttggttatatactaagaattcttgtaaatttttttttgtggacttaagcactaatttggtggatatataccccaaagggaaattgttgagtcatagattatgaatatatttagctttaatagaaattgtctttttagagtttgtctctgaactaggagccagacaagttcacgcattacatttgattgaaatatctctttaagttttaaaaatcatttcccactccccactctttgttttggctgacaacttttttattgtgataaaatatactaacatagcatttaccattttaaccattttaagtgtacaatttagtggcattaggtacattcccaatgttgtataaccatcacaatgatctatttccaaaactttttcatcatctcaaactaaaactctctaccaattatacagtaattctccagtggtagtgctaagactcaagagtgtaagttgctgggcacggtggctcacgcccgtaatcccagcactttgggaggccgaggcaggtggatcacgaggtcaggagatcgagaccatcctggcaaacacggtgaaaccccgtctctactaaaaatacaaaaaaattagccaggtgtggtggcgggtgcctgtagtcccagctacttgggaggctgaggcaggagaatggcgtgaacccaggaggcggagcttgcagtgagctgagatctcaccactgcactccagcctgggcgacagagcgagactgtgtctcagaaaaaaaaaaaaaagagtgtaagtcaagatgcaggaggcagaattctgaagagcatgcttgtcaagcagtatgcccagtcacttgccctggagtgatctaagatctagtaacagttgggctgtcttctcacaaacctaccagcaagtggcgttatagtgaagccagagtatgatttgtaatgacagggcaagttggatcacactcctgactgcaatcagttttggaaacacaatatatgtaacattaattttttgagacaaagttggtttgggccaaactgtggtttcagatcgtatttgggaatcagggctatttgcagtcagggcagtgttccttgtcttggcgcatccaagggtggtttaggacagattatgcgaattattaaaaagctttcttctgttagtttccagttgttctttctgtcctgtgatcctagggctgatagtactttcctccttggccagctgggtcccttttaggatttaccaatgggtgtgctagaaggatgctggaggagagagaagggacttgctctttcctgatttgcctcctgttcctgacactactgcacccacaacaactcttcactctgccaacagcacttagtcacagccctggctttcccagcccttccagagccagccccgtgtgcctttcacggtaccagcatcatgaggtccctctctgagctcctgagatagcagtgctggctgggcagccccctcacttctctgctccaggttctaataactccatcctcatcccaagtcctagggatgctagcttcttcctgctgtaactgttatatctctgtgtgccgtcagtgtccctgtaagcattttgggtccttttaagggaggagaccacccctcatattgtcttatgcccaatttctgcctccaaagaaagaagtaaaaactaaaaggcagaaatgaaatccacaggcagacagcatgcaccacaccctgggcctggtagttaaagatcgacccctgacctaactggttatgttatctatagattccagacattgtatggaaaagcattgtgaaaatccctgtcctgttctgtttcgttctgattaccggtgcatgcagcccgcagtcacgtacccactgcttgttcagtcaatcacaatcctctcatggggacctgcttagagttgtaagcccttaaaagggacagcaattgctcactcggggagctcggtttttggagacatgagcccgccgatgctcccagttgaataaagccctttccctccacaactcggtgtctgaggggttcttgtctgcggcttgtcctgtacactttaactgtgtttaacccatcctccatattaaattctctaattttatttgttacaatagctggtgtgtcttccgttttcctgactggagcctaactgataacttctgtctcgatagatctaccaatggaatagaaaatcaaggaaatgttatgatccaagttaaacactgttaaataattaatgagtattagcaattctgtcaacaaaatcaacttggggctggacgcggtgactcatgcctgtaatcccagcactttgggaggccaaggcaggtggatcacttgagcttaggagtttgactccagcctagccaacatggcaaagccccatctctactaaaagtataaaaattagtcggggggcggtggtggtgcatgcctgtaatcccagtgaaaggagaggccagctaggcttcttaagtcgagtaaaggctcagaaagctgtgaaactcactcatttcctgcctcaagccttactttagtcctagataaataatagtgaagatatatgcttaaaatattcctaacaccagggtttgtgcatgttttcttccctaagaaagctataaacagtgaaaattttgctgtaagcttccctgtgtcctctctccctctctccctttcccctcccctgaaactaaaaggaattttaattgcccgtttgtttgtgaccagcagaccttatctatgcttccaattccaattccttgtaaaaatactgtgagatcctgtctcctttactacgccgctgcaaagtcataaagtagatgaaacctaagttgcaattcaggttttcctcaagatctaagacatgttaattgtctttgtttctcactctagtaacatctccccgctgcacatatttcccaccttaaaaagtttaaaaagtgatcaaagaaggtaacgctggctaccggctgaagaccccttccacgctgtggaagctttgtactgtcactctgctcaatcaagcctacagctttttttctcttagtcggtgtctccatcactcgcagctgccacgccaattcttcggcttggctaaggcaaaaacctttagcattacaccagctacttgggaggctgaagcaggagaatcgcttgaacctgggaggcggaggttgcagtgagccgagaccgtgtccactccagcctgggccacagagcgagactccgtctcaaaaaaaaaaaaaaatcaactttgctctatagagacaaaagcacattagtggttgccagagctgtggagatggggaaatggggtgactgctaatgggtatagggatgctttctgaggtgatgagaatattatggaattagatagtggtcatggttgcacaagtctgtgaatatactaaaaaccagtaagttacacacttcacaaggttaattttgtagaatgtggattatatcttaattaaaacaaaatttaaaaatcaatataactgtctcctagtccctggcgtacccctaaggcacttctttagtattcagtctgtttcttactgagttttaagaatggtcttagtcctcaaggagtagcgagtcttctcaagaagagatggagtccttattaggacaggatgctttactttgtgtggcctcaactgttcatgacgtgttatagaggtagtatttgcagtgacattattttgccacttgttgaacataagaggaaggtggctgagccattgggttgccagctgacacaggacatctgtgcagtggaatgtgtatgtctaagtttcttacccttggtattgatggcagtgtgggtcgttgtgattatctgaagtggcccaattcagcaaggattaatgaagtttgttttgcacgtgttctttgatcagagttcagacacagggttggagttgaggcacagggattgtgtatgggacagtatcagtgaagatcccagcagggtgagataccgcaggagtcccagtggtgggaagtcatcaccaccactagggctgaagggaccagggaagaaaattgtgctttcagagcccagtaaaagctgaagccatgtggcagggctctaccagagatgcagcctccaagcaaggagggaatgggaaagaaataccccaccttctctctcctatagctctcctgtcttctcttggtgcctcctcttgggttaaacccaactggaagtcagagaatgagggagtcccacaacgtagggcgtggcagagaaaagtagagaatggttggcaggacatggagtgtctggcaatatggctttgatggagtgacagggattattcataattaaaatcatgtaaataatttccacaatcagagctcttggcacattgctgactgctgctgcatccatttttccttcctttgggttctatggagaaagtttccacctctcttcaaaactgaggtcctccaaatgggctgttgattccatgcctacctgtcttctcggtgaccttgttccgccagttttcctttctcctgtatcctcagcgttgtcctctccactgggtccttctctccagcagtatcatatgctctcatgctttccttgccgacagacactttcccacttcttcctttgcttctcatttacaaccagacttctccaaatgctcgcacatgctatcttcactttcccatctcctattaatttttgtttccccaatttctggctcaaattatttctggcacaaattattattttttagcagccttattgagataaaattcacataccctacaattcacccatttaaagtgtacatctcaatgcttttcagtatatttacagagttgcacaaccatcactgcaatcaatttagaacatcttcatcacccaaaagaaacttcgtcctcattagtcattctccatttcctctcaaccctcccagccccaaggcaaccccaaatttcctttctgcttctatagacatgcctattctggacatttcatacaaatggaatcatacaatatatgttcttttgtgactagcttctttctcttagtggagtgttttcaaaatttattcatagtagcctatatatcagaacttaatttcttttttttctttttaaagaaacaacaatgtcttgccctgtcacccagactggaatgcagtagtgtgaatatggcttactgcagcctctaattccaaggctcaagcgattcccctgtctcacaaaacttcatttctttttattgctgaataatattccattgtatggttatgccacattttatctatccattcaccagttgatggacatttgggttgtttccactttttggctactgtaaagaatgctgctgcgaacataagtgtctattttttttttttgtggacttaagttttcatttctcttgggtatgtatacctaggaatggaattactggctcccaactccatgttatactctttgaagaactgccaggatgctttccaaagtgactgtatcatttttcattcccaccagcatgtatgagggttccaattgctctacatccatgccaacacttgctattatttgtctttttggtgacagctgtcctggtgagtgtgaagtggtatctcagggtggttttgacaaatgtttccctattagctagtgatgttgagcatctttcatgtgcttatttttatgtttttgagacagggtctcactctgtccctcaggctggagtgcagtggcgccatcttggctcactgcaacctctgcctcctgggttcaagcgattctcctgcctcagcctaccaagtagctggaattacaggtatgtgccaccatgcccggttaatgtttgtatttttagtagagagggggtttcgccatgttggccaggctgggctcaaacccctgacctcgaatgatctgcctccccctcaagtgcctcccaaagtgctgggattacagacgtgagccaccgtgccctgcctcctgtgcttattaaccttttgtatgctttccttcagaagtaggtattcagatcatttgctcattttaaaattggatatttgtctttttatttttgagttgtaataatgttttatagatactagttccttatcagatatatgatttacagttttttttctcccagtctttgggttttcttttcaatttctttatggtgttctttgatgcacaaaagtttttaattttgatgaagtctaatttatcaatttttttcttttgttgttctgcttttggtgtcacatctaagataactttgcgtaatccaaggtcatgaagatttatgcctatattttcctctaagagttttttttagttttagttctgaaattttacgtctataatccattttgagctaatctgtttgtatggtgtaaggagaaggttccgtttcattctcttgcaagtggatattcagttgtcccagtaccagttgttaatcccattaactttactattatatggtattggaaacgtatggaaaaatttgtatgacattctcccatttgttttgtgggtatattcttttcaaaagattactgtatgttattttgtcgaggtttctggatatatcatggggatgccaagataaacatgtgtgttcattctgccaagttaattagtgtgtctggttcctgaggggatttcaaagctgggatgtataaacacatatgtccaatctgccatgatcagctggaattgtctacttgcttaacacttattttccctgttagactgaagtggcttccagcctccgttaccattccagtgtttagcactgcattgaataaattgaaaaggacaaactgaatgaatgatggagcaaggtcagaagagtcggtgggtgtggagaggatcacagaatatccttggatagaaggagggacaccatgtctcctgggactaaaaaatgatgagaatgcattcagatacagattagacagtcaagaaaggaacacataacacatgggggcaaaacatggggaatatgggacttcccaaggcttttctggagagaagtttgcatggacagacttgggatcctctgcagttgtgttcttgaaggcccaaagtggctgctcctatgtacatttttttttttgagacagggtcttgctctgttgcccaggctggaatgcagtgaacatggctcactgctgcctcctgggctcaagcaatcctcttgcctcaacctcctgagtaggtgggaccacaggcacgcaccaccatgcctggcaaaattctaaaaaatttattgtagagatggggtctcgccatgttgcccaggctggtctcaaattcctgggctcaagcaatcctccatcctcagcctccaaaagggttaggattacaggtatgagccactgcacccggccctgatttacttttacgttttttttttagagatgaggtcttgtgctgtcacccaggctggagtgcagtggcgcgatcatggctcctgcagccttgaactcctgggcatgagcaatcctcttgcttcagcctcctgagtagctgggattataggcacaagacactgcatccaactacttttctttgtcctaaaatgagtgtattttgtgggcatgtcaaaagacttattgaactttataaactagttttcttttctgaatttgactagttctcaacttcttcctaaagcatttgctagtagaagagtttagaaagacaaagtgcaggcattttgaatcagacaaaactggtttcaaatagtttttccaactactgtgtgacctgggaaaatttcttactctttctgagcctcagttttctctgctgtgaaatggggaccataatattactcaccccattactcatcccaagatcagtgtttaactaaatgagttaatatgtgtaaagctcttaaattgatgcctgttatacaacaccatgctcaattaaaaactttatctaatttaactctccaaaccaatactctggattgtcttcttttgaaaccacatctcagtttcaacttctggcatcatcttctctccaccccttcagccttctttcttttcacctatgtgaatatcaaggtagatttctatgtgtgattgagtcagggataggtcaaagatggactttttcatctttctgctgttctttgggccttagcagctatgcttttagccattgacaattttgaatctgaagcattatgccattttcagctatctctagctttttttttcaagtgaagttaattatagttttataaattaaagtcataggactaattttcacagtgttacttttaagtatctggaaaataatagtcatttctttatttaacagacatacacaaaagaatgggctgacattctaaaccacaaaagtaagcatgtggaagaagctgtcagagaacttatatcaatatttgagcagatttatgaagtgaaatacactgggaaagtaggaaaacagtcaggtaacttttctcgttactgtgtttgaattacaagatctacagattcgttcttatgtaagcaccttctgcttagcaggtactgaattccagaccctcccttccccagaagcaaagaaggtgttcagcataaatcacattgtttgtaccaacagtttaagcccagagagttctttttgttagttcgggaatggtgggaacccctctcaaatccaagttcccaaccccggtccagcgttgcaagttggccttcctatggatagcagtctcaggcctgctatgctaactctatttttttttttttttctggtgcagcattcttatcaagtcactttgactatttgatttattttactttttttttttttgagaaacataaaccaggaaaaggtaaattctataattttcttgaatctggaaaacttaatctgggtgaaaccatgttttaagactttttttttttcttttcctagatccttctctgtgtagagtaagctatgaattcctacttacaactatctttggggtttgggtacagataaatggtacccagttgaagagtgcactctcaaggaagaaaacatgatatggaagcatgtattctccaccatccattccccctcccatgattaaaggatgccctaaaaggctcctaacttttgattctgcccacaccctcataaccttcattcagttggcttgactgggactaagagaaacttccttacttcatcacatctgttcaggcaaatttgtatgacaaggtgcctgcattatttaaagtggatgaaataatttttaccctattgaatttcctgttatctcaataggttctaatagtttcagttttattaataagcccgagagagaagctgttgaatttgaatcccctttatcaggggcagggaattttaagaaaagattccctagtaggggagtgttttgcttcctagattatggtttaagaacacgggacttttagctttgctcagattattgtcctgtcctagatataacaaatctttggataaattggaagagaaagacatatttcattttaaagttttgttttcaagctctaaataagaactgattaggtaaaactttgtagttggaggttttacttgttagtattgtaaggggatgtgcctgtcagtcacgatccctgtttactacgcacctgctcttctccccagctgctgctcagggaagtagtgtgaggctggcttcgagcaaggctagccattgactgcaccagtagtaggtcactgacacagagtgtgccacccagactctcgaaggagacctgagagatggcactgccttacagggatgaagttaattagctaattaccaacatatttgaagtagggaatctgtgggaagctggctttttggagtgagagaacattccagtcaagcagagatcccatgaaagtgacatagcaagaagagagagagagagagagagagagagagagaaagagaaaactgtgcctggaacagtggttcttaatgggactggaagggattttgcccccaagggaatatttggcaaggtctggagacatttcagttgtcacacagtgtgtgtgtgtgttgggggtggccgggggggagggggtgggtgttgctactggcttctggtggataagggccagggatgctgttaaacatcctacaggacagcccccagcaacaaagaattgacccacccaagatgtcagtagtgctgaggatgagaaagcctcagcctagaatgagtatgcacatcacatctttcctcttagagtttttccacttagtttaattagtttcatcacaagcgtcaaaaacacaaaaatattatttcagtcaagttggaaaactcaaaagatagacagataatttacaaagataataggtaaaactctcttaaaacttttctgaattctagattgtatatttacagagtgtatttcttagtagaatgacaattctattgaggtggataatttaaattgaattcaaggatgactcctagaggaacaaatgcgaaaagcatttttcaaaaaacagttttaaaagtaagagctttttaaaaaggaacttcctaagaggatttggccatgtagaatacagacaatgctaaaaagtcaaatgttatatttttgttttgtcttttgtctatagaacagcggaaacacgttgtttttggaagtgaaacaggagagggtgaaaacaatgactatgaagctaatattgtgaatgagtttgatactcatgataaagaagatgaatttaaaaaggtatttattgtggaacaacttcatgcaattcacagaattatggtttataggattatagataaccccatatggtgctttttccaggcagttctgcaaccaatctaatttctaacaaaatacagaaagtataattttcaattttatactgtaggatcaggcaatcctttaagttttccccagtatcacagcttttgatgtgattctgtcaattacagtttatgtagtcacctctcctcattgtgattgaccatgttttctcatatagtaaatgtgacgtcagggattggagcagctgatccgtttgactcagaatggagaactttgttctcagttgttgtgtttaatggttatctgtattgcaagtccagattgtggttcacttggggctcagggatctgcattttaaactagcattatggatgaccactctggactctcccccaggagaagccctagataggcagattttcacattgagttgaaatgtgttgagaatgaaggttcagaagggggactggggtttctttttccttcttagtcctcacccttctggtcatgcatgagctctgaatgtcactgtcacatttgcactcattcctgctttctcctccccgggtcagttttcttttaatccttcatacccaccttcttttcattctttttctattttacccacttttacacaatctgatgcagttttagaaataaacagcacccatttattccactttcaccttcttgctcaaggatgatattgccagataattgggaaacacttttctgcagcatctagatttctgcagagtttaggcttctcagtaccatgcaccaggcagctgttagcaaccagcaggtgtcagctggagcactcccctctcagaagtgcctgtctttcagttgcattaccttttgacactggctgaagtccttagagcatgactgagtaccctcagaacctctccagttgggggatcactggagctgtgctagtggtcacctcataaatagcctctgcctcgcaaattcatctctcacattgctgccagaacggtctaacataaaaatctgattatgttcaggaggatgaggcaggagaatggcgtgaacccgggaggcagagcttgcagtgagccgagatcgcgccactgcactccagcctgggcgacagagcaagactctgtctcaaaaaaaaaataataataataataaaaatctgattatgtcacatctgtgctttagcttgatagttcactagccctgactgtaccccactgccacatggaaaatcttgatattcctctttgttcatgccttattactctctcttctgcctcaccaacccagtctcagaggggccgggttctagagcagtgaggaacagtatggccagagccttgccccgatgtatgactcattgtgtaagcaagacatgggcccacatctctgcctaccaggctcaaaacctgtcctgtgctctgatcaataaacttggctacttctcccaagggaaggaagggtgtggagagagggtcaaaccgctgtcccagagggtggaattttcatctcatatatttgagtattgcacattttaaaatacatttatccaccaagctgagcttcttgaggatggagactagttatcttcttgtgcccatgccgttaatcattgagaaatgtaccacatttaaagtgcttcaattttgttaggtgaaaattgagtattgagcaagccaggattactctgaacatactgtttgtgaattttggtttttgaataagtccctctggtttgctagggtgtttatgcaaacacatttttcatgtattcttatttgtctaaaaaaaacagacaagtaatttaggactgaatttatttctacaatatcattgaaattgtatagtttattatttgttgcctttcacatgccacatctaatattctgtcattgttttggggatgctctaggttttttggaggagagataccaaatttaatctgatttcttattacaggagtgtaaagaggtctttgcttttttctctcatcaattactagacagtcttcaaaaagctacacggttatctctggacacaatgaaaagaagaatatttgttgcaaggcaagttgaaaatatgctaattatgtctggtaatcatacttataatgtgaatagcacctcttataaatttattaattaaaaaaactataaaatttaaaatatagcattcattaaaagactgtatgaaagtatttgtgtaatactgcaagaactgtagttaaatgaacacccatattcccaacaccctgcctgagacaaaaaaaggctaccagtcccctcatgggtcctctcccttctcacctaaaagtaaccactatcctgaacttggtgtttatcattgtcttggttttcttcacagtttactatgcttttgtatccccaatccacgtatcatttaattttgcctgtatttgaactgtgcttggtataatgtttttgagattcatccatggggtatagttttttacacttctatgtagttggagtatacgtagtctgtttatccattctactggtgatggtgatttgggttgcttcagtttttgctatcatgaataaagcttctgtgagtacctgccacctgttgcacctgctaggagtgggtttggtgggtcctaaggtatgtgcatgcctcattttaccaggcagcacatagtgagagtacccatggcccctcatccctacagacagtattattcggttaaaaaattcttgccaacatacagggtgtgaaatggcatctcatcaggattttggtttgcattttcctggttactgatgagattaaatatactttcttgtgtttatgggccatttgttgtttctcttccttaaaagttgtgttcctagttcaaccactgtggaagacagtgtggcgattcctcaaggatctagaaccagaaatactatttgacccagcaatcccattactgggtatatacccaaataattataaatcattctccaataaagacatatgcacacgtatgtttactgtggcaatgttcacaatagcaaaggcttagaagcaacccaaatgcccatcagtgatagacaggataaagaaaatgtggcacatatataccgtggaatactatgcagccataaagaagaatgagttcatgtcctttgcagggaaatggatgaagctggaaaccatcattctcagcaaactaacacaagagcagaaaaccaaacaccgcatgttctcactcataaatgggagttaaataatgagaacacatggacacagggaggggaacatcacacaccagggcctgtcagggggtgtggggataggggagggatagcattagaagaaatacctaatgtagatgacgggttgatgggtgcagtaaaccaccatagcatgtgtatacctatgtaacaaacctgcatgttctgcacatgtaccccagaacttaaagtacgattaaaaaaaaaaagaaaaaaaattgtgttccttttttggcctgtttttctatcgaattggattaattcataagtattcttagtatattacattattgatgataatataacaaatgtcttttgtcagttttgccttatcttttcattttctttattaattttcattttccattgctgagttttaaaaatattcaaatttatcagttttagtgatttgtgatctgtttaaagaaaccaactcttccctacttcataatgtcttccaaaacttttgtagttttgacctttatatttagggttttaatttacatggtattgatttttatgcttagtgtgaggtagcaaattaatatatttttttccatatggttaattagttgaccaagcaaaagttgttgaaaaatcaacttacttgtgaggtcaggtgggggagttatttaagttgcattgtatctatagatcaatttgaagagaattagcatccttacaaatattgagtcttctattcagaattatgtattacctcttcattgatatgtcttctttaatatctctctgtgacgttttataaatctctgtgtaaaggtcctgcacatttttgttagatttattccttggctattcattgctgatttttaatttaattgtactgttcaattctcccagtgtgattgtggatttattaaactttccttttgtttcggtcagttcttgttttatgtattctatggctgtgttgttaggtgcatacaaggtcgtagtagctaaacctgcttaagagcacttttccttttatttttatttggcaaatccctttatctgtattaattctgattcctcacaatttagtttgtcattactttaccaaccttttttgtgtaattgtttcagtctctttacttaagcctttctctgtactttttagttttacctcttaaaaatattttatacctgataattttccttcagtctcattatttctgtcttagtgagttcaatttgtttgcatttattgtgatttttgatatagttgcacttaatttatgacattttattttgtgttttcttctcaacattctttttctttgattcatttcattatgactgttgtctttgcggtggataattttcaccatttattctcttttctgtacttcagttctttaagtgattacccttaactttagaatgcacatattttgctccaactaaaagaagtactggccaggcgcagtggctcacctctgtaatcccagcaccatgggaggccgaggcaggcgaatcacttgaggtcaggagtttgagaccagcgtgaccaacatggtgaaactctgtctctactaaaaatacaaaaagtaggcaggtgtggtggtgcacgcctgtagtcccagctgctagggaggctgtggcaggagaatcgcttgaacctgggaggtggaggttgcagtgagtcaagactgtgccattgcattccagcctgggcaacagagtgagactccatctcaaaaaaaaaagaaaaaagaaaaagcactgtccttagttttgcagttttctagtcttatttctgactacaagggccttggcaggctttactcactgaactgtacatattttattcctgtttgatgttttagttttacttttttgtaaacactcaaaaataatatattaaaataatttatttactggcataatttattaaaatctccaggttctcatgtagttttttgtatcccattggttctttagtgaggatctgtgagaggtagactcttttatccttttttgtaagtctgaaaatgttttgccctcatactttcataacattttggctggatataaaatttttctttgtcttttagtacttggaaagtatttcttcatttttttctgagttttgttgctgctgatgagaagtctgcaagagtctaactgaatattctcttttaatccttaatgtttctgcagttttctttaccccgtgtggatttgtctttatttaatcctgctttgttctcagagtgcactttctatttgagggtttatagctttccttaatgctagaaaaaacctcagcaattttccctttagttattgcttctaggatattctttcattgtcttcttctggaactcctattaattgaatgttgggtagaatgaccacataacttattgttccaactatggaacttttgtgagtgaaggagcactgtccagatgaggtgccaggacacagtgaatctggaactgtcctgggcacactggacatgtggttatttcatatgttggggcttctcattctcttctcgttgtctcctaatgactctgtcatctatgttatctttttgcctttctgaactacattatgggcagtatctctgtatctattctaaagattttgtcatctgtggcatcttaaatatttcaagaaaaaatactttttccttatcctccagatatggtattatttctgcctttttagtttagcaaattttttatttttttggaagagtcttcatatatcactgaacattttcccttactttagagcttgttatctggacattaatttttatctagagtgagtttctgtttcgtttttggatttcgttagctctctttcttacccttagacatattcacgcatacttgggttttaatgtgcaggctctctttgagcgagagctttgtttttgtgtttctttttccttctctctctccctatctatgagtttcacttttgcctctaaatgacacttggaaccctgagtacagaaccaggtcttatttcttcacagttactggcccctggagagatactgggggtatggcaggtttggctagggagcacacgggtagcctaacttagttacttatcagggaatttgtggatgtgcttcttttgccccaggtctgcatctcctggaaaagccatagctgcaggaagtaagttgacgcattttgtcttgcagcatcatctgcaagacagatgggagagcatcatcttagtttttggccttaagtagtgaggctggccgaggccccatccctcattgagtcctgtccatcctctatattccaccagagccaacctccccacggtcactgcctctttccagcccggaaccctggctaggctgtccttgagtttctctccatttctacttcatggagatgcttaccttgtatttgagcattctcatgtcctttatctcccatccatgattgtgatgagtttggcaaaaagaagcttttttgaagtatgaactcactatgctacattgatttacaagttctgcggcaatttagcaatttttgaggaggcatacatgaggatagtactaaaaacccttacttgtctaaaatgtctttctcttatgcccacacacgaacgctagcttggtcttctgggatcagaatccctttctgtcacgctctacagaggctgctccattggcttctttggtttcagtttttagaggagagttctgctgcgaatccgattttcctttccaactaacaacttgtatttgttttgatgctgacaggatttctcttttattcttgaaattcacaaattgtatgtttagatgcaggtggatttccccccattaatcctgtcaggcacctagagaatctcttgaagatgaaaaaaaaaagcctattcttaaggttaaaggagtgctttgctttaatttcccatatctacacagtattcacgtgccgtatctaggtagtaagcatctctgagcggagtgactctctggaaattacttagcctctccctaccttggtttccttatctacaatatggaaagaataataatcgtagggtctgcctcacagaattaatgtgaacatgaactggtaatctatggaaagtggctggcatacattaaaacattcaataaatgttacttattcttaccttttctctaagtattttctctctctttgtattttgcacctgaaattttggagaataccttcagctgattctctaatttgctatataaggtaccaaatgatctagtgcactgttcactgcctttattattcaactgttcctttatactttatgaaaactctttcttattctcaaattacacactttgaatcaatgcccacactaattttattgcaacatcttgaatttcactgggacactatgaattgaggggttttgtttgcttgctttctttttgttcagtcctttccaataatacgtttatctgggaaccattggccctgagtgctaaaagttgggtcttcacttttgaactgtggcctctatgtttcttgtgatcccctcccaccccccatctgcttgtatttagaaatggaggtgtaagttttcagtaatgacggtatttcttgcactcccagagaaaaagagaatggacagtttacatttattataattttgcctgggataggggtggaggttaagacagagggagctatgctagccagactaatttgcagctctgcatgtgtccttcataactggactcaggcgtctgtgctgctgtctgtgcatgagtgatattgtttaacaacgcggtttttggaaagcatggaccagaaacttcctgtttaatcttgtgaaaatatagataaagaagcatataaaagtatatgctggtgatctcatcttgtatctgttgcagggctgggaacaaagaatgcctttagtaaacattgttaaaggttattactgagaaagaacaacattaaaatagtagaaaatgtatatgagattactattttacttctaagactattgggtcattgtattttcttagttctctgcaatttagggttctgttataagtaatattctctttgtgtaatttggccttttaaaaatgatctttattgttcggactgaattttgtagcataataaactaacaatgaaattttagggtaaggttcatcagctaaatgtccatctcattgcagcctttatgggcgaaagcagtcagaagatattatttcctttataaaaagtgaagtacatcttgcaattcctaatgtggtaagtattattaaatacactgataatttgataaggtgcttaagaagtatagtactagaactgagctttcatttaggtaacattttggtcctatgtcttttttcactttccctcactatttaacaaattggaaatgtcatttatatctgttatgaaaaagctacttctgggatgggtgcagtggctcacgcctgtaatcccaacactttgggaggccaaggcgggtggagcacctgacgtcaggagtttgagaccatcctggccaacatggtgaaaccccgtctccactaaaaatacaaaaattagccagttgtggtggtaggtgcctgtagtcccagctacttgggaggctgaggcaggagaattgcttgaacctgggaggtggaggttgcagtgagctgagatcatgccactgcactccagcctgggcgacagagcaagactctgtcaaaaaaaaaaaagttacttctgtattagctcatgatgtattgaaggactcgtgaaagaattgagttaggcatctgttctgccagcagttagcaagcaccctacaaattgccttgctttttcttacttcagacattaaattatctaaataaaatcatcacagttgtccagatccctacctcaaacacatgactgtgaggcaacgcactaaggtaaggatggcagaagagaaagacaaaaagagcctgtgccctgagcatctgaatcacccgtgtcttcccatggcacttatctttacaactaccccagctgctgatgggcatctggaactccaagccacatgggatggctgagctgcattctgcgatgggtcaaaggataaggccaggcagaaacggtccgtgactcacctaaaaccacctttacatggtctgacctcctgaaggataccttcttagcttatttggcacatttcaaagaactgaggtcagaatcttggtggtgtagcttcttcagttactttgtttcatagatctctaacacatagtctgtaatttcccactgcattctgccaccctcatggggaaaaggatgacaagtactagtttgacctttttaacaaaatcaaaatgtcatttctatctgttattaaaaagttacgtccgcattagctcgtggtgtaatgaggcttgcaggaatcgatagcgggaaaacttcaggatagagaaaatctgcatcctccccatcttcctctatcattctccccctcaaatcagccttgcactgggccagccgaggcttgccccactcagtggggaatggaggtggtgaaaattgagggatggactgtatgtgccggcagtattacacatttgtttcttctttccacaggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagtaagaatgtaaaattagtcaatgatcttactgatcctttttggatttgatagcatatagatttttaaattattttatatgtttgataccttttgcatttaaaaaatagtatgtttcatcttaaacataacgtgcaggcattttttcctggctttgggtggtgggtgaaaaggatttttaaatcacttttctactatgatgatcttaagttaaaaattaaaataaaccttagcactaattttactttctgcatgatagtaggttggataaacttaaggtaaacataaattcgtcacttaagtagttatgaatatgatatgatagtgacccaaaatgttatgaacatttttttgacacttcctgtatagaaagaaactggtttcttttttattttattttattttgttttattttattttattttattttattttagttctagggtacatgtgcaggatgtgtaggtttgttacataggtaaacatgtgccatggtggtttgctgcacctatcaacccatcacataggtgttaagcaagcatgcattagctatttttcctgatgctctccctcccttcacccccatcccccaccaacaggctccagtatgtgttgttcccctccctatgtcaatgtgttcacattgttcagctcccacttacaagtgagaacatgtagtgtttggttttctgttcctgcattagtttgccaaggataatggcttccggctccatctatgtccttgcaaaggacatgaactcattctttttttatggctgcataatattccatggtgtatatgtaccacattttctttatgcagtttaccattgatgggcatttgggttgattccatgtctgctattgtgaatagtgctgcaatgaacataggcgtgcatgtatccttataatagaatgatttatattccttcgggtatatacccagtaatggaattgctgggtcaaatggtatttctggttctaggtctttgaggaattgccacactgtcttctacaatggtcgaactaatttacattcccaccaacagtgtaaaagcattcctatttctccacagccttgccagcatcttttgtttcttgactttttaataattgccattctgtctggcatgagatggtatctcactgtggttttgatttgcatttctgtaatgatcactgatgttgagcttttttttatatatgttttttggccacatgagtgtcttcttttgcaaagtgtctattcatgtcctttgtccattttctgatggggttgagaaactggtctcttcaactggtctctttaactttttaatggggttgagaaactggtctcaaaactatgtcacttccactgtgatgcagggaaaggcaaattgaaaataacaagataccaggtaaggcccagtgtggtggctcacgtctgtaatcccaacattttgggaggccaaggcaggtggatcatcttaggtcaggagtttgatatcatcctggccaacatggcaaaacactgtctctactgaaaatacaagaatattagccgggcatggcggcacacacctgtaatcctagctactggggaggctgaggcaggagaatcacttgaaccagagacagaggttgcagtgagctgagattgcaccactgcactacagccagagcaacagagggagactccatctccaaaaaacaaaaaacaaaaacacccccaagataccaggtaagctacacaaccaggtggctcagacccctatggcacctttctatgttgcactaacattgctttctcagcttacatctgtggtctcatggggtgttccctacaaccagctaataaaggatgaaaaatctcaggactggtctatctgaattggcttgatgtgttggtgtcagctgaaaatggacttctgtttcactacagcccactcaggagtggccctaaaggagagtgaaaaggggaattccccccagagggcagagcttcaagtagtataccttttttataaggagagtggtctgaagcaaagatatacatggactcttgggcagtgacgaatggctggactgatcattcaggacctagaaagagcaactttggaaaatcagaggcaagaagagctagggaaaaagcatgtggatgtatctatgaatttacataaaatacctgggaagataaatattagttccttcaagggctgatcatgatcttgaaagacacaatccaatgccataatctcaaatgttgaaatcccaaaagatcaaaatccaaaaaatataattctggaaaaaataattattattttaataaacagttcttttaaatatatttatttacatttttaaagggggatttgattttcagaattttagacatggattttatactttcgggatttagattttagggattttgagcttttgggatttctgagattatggtgtttgggattgtgttttctgagattatgaatcaaacccagttctttcttcagagaggttaaataatttttccaaagtcacaaacctaataagagggctgggaattaatccatacaagaagatcagtatctaatttttttatgtttagtccaatgtttgccattattctttattctctccctagtccattctatatatttttctattattgtagcaggctaaacataaaactataaattgttagatgcaaaaatctccttggacttatcaacaatcttgcaaataagaattctattatctgcaaaattatcaaccaagtacgatgtaaatagacattttcagacatgcagtgtcttttaaaatgtaccatcaacacatgcttttccataaagttactgaaggttgtagtcttccaaaataagaaagcaaaagcaaaagcaaaaaaaaaaaaaaaagaagatatgggatattggaaacaggaataaaacacagcagacaggtgaagggaatttcaaggtgaatgttgaagggtgattgtgcagtgatagttatgttctaagcatagagggcaaccagtgtgacttaggaaacaggtgagttttgactgctctcaacaaatgctggatgccgttatatatactgtcttttaacttgaaggcagaatgcctgggtaaacctggtctgtattcttgtctggactttcttattctcaccatgtgctgatgaagttgttgctctacactcattgctctgggtcagctgaggaaacttattcattcctcagaagcgttctgccttgaccaactactgagaactggaggcaggtaattgtgatataaggaaatagagattagctcactatcctggccattttcttgctggacatttattactcggctcacaaacacagtgctgccagatgccctgattgtcatgacacatatattttctaggacttatttatgatcctgccccatagcttcccccacaaagggcttttgtaaacttgtagaaaagatgaagccagaccagtcccagagactcttttcttgtaggagccttcgtctcacatgaacaattaatgttctttcctttatggctagttttgtgcttactgctcagcttttaaaaggtgtttagggatacacatgttggtttattgtaaagtttatcttcaaagaaaattcaggataatggttgcctctgggggtaagggcagggaatgggattagagaggtacctagagaggactaatctattggtaacattctattcttaacttggtggtgagtacattggaattcatttttcttcttatttaatatacattttacctatttcttgtgttttatatatgtttctgtaagtatatttcacttacccacacatagacttaaatacagcctcctatcaaactaggaataagacagattttccaataatgtcatctgtaaaaatatttagaagtattgcattatcaataaaatgaagaataaagaaggaagcccactattatcatttttatttgatagtttactagagatcttcattatgaaataagacaagaaaaaatgagaagaattggagaggaagactgagattgtccttatttaaagattatatatagaaaatccaggaaatctagaaataattgttacaaccaataagttcagtaatgtttatgtataaaagatcaacatacaaaacccccagtatttttacatttaccagtaatacaattaatgtataatagaaacacagattttttttattagccacaaaccataaggtatttaacaaataaatgtaaaaaaaatttgcacagcatttttggagaaaatattactgaatgagataatggaagacaagaataagtccacatcatgaagaagtcaattctttgattaatctataaatgtaatacaattccaaagaaatcataatagatttttttctgttgtcaacttgatttataaatttgattgtaaaattatatagaagtgaaaagagttaaaaatagctgagaaaaattggtgttgaagaaaagcaaggtagggggtcctgccctgccaaatagcaaggagtgttacaaagccaggctaatgaggaccgtcttttagtgatccaaagatagataacatacagcagaacaggacagagggtgcagaaatactcatgtttatgaaaatatatggtataggtggatttacaaatcagtggagaaagaatgtactatttaataaatgtggctaaggatttgtttccatgtggaaaaaacttacagtagtatcttgaattagatacacatcatacccgctattctatatcctataacactattccatctattttacaacacttttagaataaaacagcacaatatatttaaaccaccagggtagggaaggattctcaagacatacaaagctcaaaccatagaagaaaagatgtttaaatttgacttctttatatctaaaaacatctttaaaggactcttaaatttaaatgaccatgctgaagtccataataaaatgttagcaaactgaatccagcagtgtataaaaagtgttgtatagtttgaccaaatgaggtttatcccataaaagcaaggttggtttaacatcctaaaatacaccatatgaatagaataaagggaaaaaactcatgattatctcaatagacatagaaaaaatatttgacaaaatccaataccctttcatgataaacatgctcagcaatctgggaatagaattgaacttcttcaaccttataaaaggcatcatacttaatgttgaaagcctgaattttttccccctaagattaggaacaagtcaagaatactagctcttaccacatctactcgacattatagtggaaattctatcaagtggattaagataagtgaactaaattgaagatacacagatgggaagggaaaaagttaaaccatctttattagcagatgatatgattttgtatgtaaaaataacctaaggaatcaaccctcacacacacaaaaaaaccccattagaactaataaatgaattcagtaagactgcaggatacaggattaatatacagatatcaactatatttctaaatattagcaatgaaccatctgaaaatgaaataaaacaatttaatgcacaaaagcaaggaagaataaaatacatttaacagaagtataaggtctgtacactgaaactgcaaaacattgctgaaagttattctatgaagagatacatcatgctcatgggttggaagatctaatattattaaactggcagttcttcccaaattgatctacagattttatacaatctctatcaaaatcccagaagactttttttgcggaagaaattgataagatgatcctaaaatttgaatagagaataggggaattcaaaggacctataatggccaaaaaaattttgaaaaagaacaaaactggagaacttaccactacttggttttatttatttagagatggggtcccactctgttgcccaggctggagtgaggtggtgcaacctcagcttactgcagcctctgccttcttggctgaagcaatcctcccctttcagcctccaagtagatgggactaccggcacgtgccaccatgctcagctaatttttgtattattgtggagataggattttgccatgttgcccaggctggtcacgaaatcttggactcaaacgatctccccgcctgggcttcccaaagtgctgggattctaggcatgaaccactgtgcccagccagctggagtcaaaatttatcttcaaaagatgtattttcaagttagccctcattattagaactgatgcttagtccacatgtctcctgtcagcctggccacaattcttgtattttggattcttttatctctatttgaatatgcatatagtgaatatacatatagtgatacacaggccgattcctccactggccgtcaaacagctaaaactataggtgaaattctcttttaggttactgtgaggaggggcttatctctatttgaatatgcatatagtgattcttcaccaagaatctttgggatctaatttcttcaaccagtttattttagggtcatttttagagtaggtggatctgcctagttttcaatttgacaccctagaaaaataaaagcattggtgactattgaagactgtatcaaactgaacagtctaagaaaactacacaaatactgtatcagtaaaaataccaggtttaacaagcaggaagccaagatgccagatgctgaatatctacagcgctgacctttaaacaccccagcagaggttgtctcatttaattctcacaagtatatccacgaagactaaatacttggcccagggtcatttggataataaatgtaatgtctctccttgaaccactgcgctattcctcagggtggaaatttcaacgcttttaaccttttcttaaaggactttaacattttggggtgttttaatcagtgtctttcagttatcctctccgaataacagttcttctagattaaagaaatctagagctcaaaatctgacaccatagtttaatgagaatacatgaagatagcaagagaatagctcttaattactcaaaatagctcttagtttcttggagggagaatctttaagaaaatacagtttgaaaaagaatcacaaatattaaaactgataatatttaaagttgaatatagaagttatttatagtgtaaaaacatctgttttcaggatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggtgtctttctgctacttgtgatgttgtttgggttttgtttgtctctaattcttgagggtggaccaggaaaatatcagggataatgacaggaacccatgagcagaggccaagaatctataaataccaagcacctgtcaccttctagctggtgtaattctcacatggacacactgaggcaattgatattactgaggctcagacagattttgttcaatttccttaaacaattgagtaccaattatgtgccaccacggactagaggctaggtattcaagggtgcgtcacacttatgtagacccagctgtatttcggttagagacgcaagggaactttagaactctgaataaccatgccctgcagactgtgaaattcctcgcttcctggtggacaccctatttcttacccagccactggccccattgcacacacaagtgtaaatgtgtatgagcaaatgcaattttctaatgtaactatggtaagatttatactgttaaaaaattaaaatattgactattttcttaccacaggaatttttggctaacaacccctctctgactgaaatcagatcagaaattctacactatgctacttttgaacaggagattgatgagttgaagcctattattgttgtaggagcacttgaattacatacaggtattttaaaaatgtttattatgtaaagtatctgtactttcacatgaagtgttactttatttagcaagcagttattaagttatcttggtacaatagtattataccaagatataataataataatataccaaggttataataatagtattataccaagatatattataatattattataccattaaaagtaatggcaaaaactgcaattacttttgcaccaacctaatataaatgttaaatagttctgggccattgatattctttatacacacatccgtagacacactacacaggacgattcctccactggcagtcaaacagctaaaagtataggtgaaattctcttttaggttactgtaaggaggggcttgtatacatgagatgggactcaaacagtttgaagtctgccaagaagttgatccatttgggattagagtatcaaaggatgaggagacaatcattaatgcttgaaatagaaagatgactttattgcttgctgtagtgacagagagctgtactggtcaggcacagtgtacctggcagggcagactgctagtctcatacagggtgtctgggcagcatggagttgaaggactgtggacgtagacaggttgacatcatctgtagaaggatgcttactcaggtgagactgttgtaggctgattggcactcagaggcgggtttattggagtaagtctttcttgactagttgacattcagaagaaagggcctggcactgatagggttgtacacatatgagaactgatgttgacttggtctatggtttgggtttaaagctggttgtggtggctcattgttaccatggttacataacaatcagtcttatcctaagtttgtggaaagattttattctcagacaatatttgaatgaggtattttacatccattatccaccttaagtagattttcaggtctgttatcaagaagttaatgtaactgtggctcttgaatttggccacttgggttacttgacctctttaatctccatttcctctgctgatgaaaatgacagtatccacctcacgaaatgctttatatgagacgcttagcatagtacctggcgtatgattgatgttgaataaatattaaatattattattatatctaccaaggaagtacttgtgattctctgaggaagaatcacaagtaccaaagaattacaagtacttaagggggactatttacctggaaatcagaaactatgcatcagtggcaataattacaagaacttctgtagcgttttggaaactgtatctattattttttaaaagttcacatttgtctcctcataatggttagcactatgatccacaatacaaaaagcaactgtagtatacagacagagtgcgctggggagcttgtttttggagagtggcatctaaaaatggaagaggtgatggtagttataaagagaggggagggtgggctgaatccctaaggcctgagggaaaagggtcccctaggggatctcatgagatatgatctcacagcctcaatcaccagactggctgcatggttgttcttgggccacgctttctcctcagctccacaggcctcttaagtttaatggttggaaggcaagagcggtgcagccatgtttcaagcttggcagaattggggagtgtaggggtactgagaggtaaaaggggaaggattgataaggcagagttgactagttagagctgttttgttttcaagaaatagaaacacatttgagctatgttaagggagaaaaggtttatcccagaatccagggtgcaactgagccttcagaatagaccagaatcagggacagtataggaagctgaggaagttctttctctatgcctctcgtttcttcttccctctgtgcatgagtttttctgcttcccagactatgtggctcctcctcaagcctcatttcaaactctcaagaaaagactctgattggtccataatataggtcatgttgacctgggacaactggctaggtccagggtccagggtcagggtagacggatactctgaccatgtggatgatgtggtgagtagaaaagcaagaaacctgtgaagtcatggcttgacacacaaaacaatagatttcactccacctcatgggatctctcgagaaaaatgcgagaatgaatgagggccgctaatgggatggtcagaagaagtgcaagggtcacacagaacagtgatagaactaatttcaaaaatgctcccccatgggctgtggtgtcaaactcatgcacatttccacggggatacatgctctgtgggacaggaattaagtcttcaaaatctagtaaccttatagcacatgtaattcatactaaccacatttcaagtgttcaaaagccacatgtggttagtgactactgaattggacagagcaattatagatgcccttatagtttcagaatgccagttatattctaatttaatttcttcttgtcttcatcagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagtaagaaatgattgcatttttttttcttggaatgcttttttgttttttaaagaaatagagacacactaagaaagtgattctttaacatattcatctattatgtagcacagtctgcctatttctcgtctctgatgttgatgtctttgggagaattttggcaattatcaacagtgaacagtatacaaaagacactgttgtaatacaaaggaatgttaatatattaataatgctatagtggggtaggtagtgtttaatttttgatactggcaccaacattttgtggaaagaaataattgtcccttgtcatgtcaatcccaacatgttaggcaagttctcccaagatctttggcttgccttagaaaccaattataggtctcactcatgaacggtggtgtaccacaggcagtatggcagaaacagttccctcaggctccatagtaaactgttggaacttacatcaatgaaaaatgtttttaggaaacagtatgagttttctattgctgctataacaaatcaccaccaacttaatggcttaaaacaacacagatcgtttattttacagttctagacatcagaagtccaaaaatggatctaatggggctaacatcaagatgtcagcagggccatgttgctcctggaggctctaggggagaatccattccctcctttttctagcttctaggggctgcccacgtgtcttggctcatggttggttcccttctagtgatgccatcacttctacccccatttctgtcattgtgtcttctctcacacctactttcctgccacactctttctcttatgtggacttttgtgattacatcaggcccgcctgttaatccagggtaatctccccatggcaagctccttaacataatcatatctgcaaagtcccttttaccatataaggtaatatgttcacagactttggggatcaggacttggatagccttggtgagtttgtctattactaatatttagaatgttttaggactaatattatttagaatttctgatacatggtgataaaaatcaagcttttgattctttttattattggttttgttgtctataaacaatgcactgcctcattgcctacaatatctggggaattgacaccactactgcctctttatggtacccaatatttatgactgttttatgctttcttgaacccattgagagtttatactctttggtagctaatgaactttttacttttactgctttaaaaaaatcgtggtatttggggattttggatgctgaccagccagacttcaagatataataaattattatatcaaattttccctgactgcaaaagcttaattctttaccaaacttttttttttttttttttttttttttttttttttttttggtgaagacaattactggtcatcccttggagcctggatcattcaagtttcttttctttggagtatctcccacatcatttcattctgttccttgtatagtcaacccctgttttaatacagtctgtatcttacgtggtgttgacatagggtcaaggaggaaaaagagacatatacatctccatcagaatcacctaggtgcttattaaatgcagatttcagagcctgtgatccagagttagtatctggtagtcagaatctaaaggtgcttttcatacacttttaattttggaaaccacttttctagaacatgctgtcttcttctaagacataggaatgtgtttctagaaggcgtctaaatcatttggcaatggctttcccttgtgatatttctaaactccaccttcatcctgcaggaagcctatgctattttaaacagatttgaagttgaagtaaccaaagaagaatcagaagcagttgataccttaagatattctttcaacaaattgcagagcaaagctgtaagtatgaatttaactacattattttttcttaagtcactatctccagaaaaaaaaggtattttatacctttttaaagcttaatatacagtcatgtgccacataacaatgtttcagtcaacaacagactgcatatacaacggtgatctcataagattataatactgtatttttactgatccttttctatatttagatacacaaatgcttaccattgtctagaattgccttcagcattcagtatagtaacatgctgtagaggtttgtagcctagcagcaataggccataccatatagcctaggtgtacagtaggctatccctctaggtttgtgtaagtacactcaatgatgttcacacgacaaaatcacctaatgacacatttctcagcctattaccatcatcaagcaatgtgagactgtaaattattttaatggctttattgagatagaatacacataccataaagtttaccattttaaagcatacaattcagtgttttttagtatattcacattgttgcttaaccaccatcattgtctaattttaaaacattatcaccccacaaaggaaaccccgtgcccattagcaatcactcctgattctctctcttgccccagccctggcaaccactaatctactttctgtttctgtggattttccttttctggacatttaatgtagactaaatcatacaatatatggtctttcgtaacttgattctttcatttaacataatttttcaaagttcatccatattgtccatgtgcgaggacttcattttcctaatgcctaatgagatagagcatgttttcatgtggccattttattggtcatttgtatatcttatttggagagatgtgaatttaaatcctttgcttgatttttaaaaattttgttgtctttttacttttgagttgtaagaattctttatatattatggatacaagtttcttatcagatatgtgatttgcaaatgttttctcttctgtgggttatcttttcgctttattgatggtgtcttttgatgcacaaagttttttactttgatgaagtctagtttatctttttattgttgttgttgttggtgtttttggtatgttatctgggaaaccattgcccaatctagagttacaaagatttactgccatgttttcttatgagagttttataactttagcacttaaattttgatttctgatacattttgagttaatttgtgcatatggtataagttagggattcgacttcatataaaagcatgtagataatccagttgcattgacattgtttactgaaaaaactatcctttcaccaacaaattgtcttggtagccttgctgaaaatcaattgatcatagatgtaagagtttatttcagactctcaatttctattctttttatctatatgcctatccttatgccagcaccacactgtcttgattatagtagctttgtgctaagctttaaaaagaaaatagtggcaaaatgcatgtaacataaaatttaccttcttaaccattttagtagtgttaagtatattcacattgctgtgcaaccaatctccagaacttgcaaaaaatcttgcaaaactgttactctatttaaacaacaactctccattttcccctaccatttctaggttgcctgttcactctgctgattgtgtctttatagtcctttctatttctgttaggctggtagtgatgtcccctttttcattcctaattttagtaatttgcatcttctctcctttattcttacttagtttaggtaaaggtagtcaattttgtcagtcttttcaaataaaaaactttggtttgttgattttctctattgtttttctattctctctaccatttatttgtgctctagtttttatcatttcttttcttcttgctctgggtttaatttgttcctctttgtttaatttgcaaagttgaggttactgatttgagattttttttcttttaatgtagaacttgatagctacaaatttctctaagcatttttgaagttgataaacatttatacaccaaaattagacattaaaaatgaactccaaggggccaggcatggtggctcatgcctgtaatcccagcactttgggaggctgaggtgggtggatcacaagttcaggaggtcgagaccatcctggctaacacagtgaaaccctgcctctactaaaattacaaaaaaatcagccaggcatggtggcaggcacctgtagtcccagctacttgggaggctgaggcaggagaaagacgtgaacccaggaggcggagtttccagtgagccgagatcgcgccactgcactccagcctgggcaacagagcaagactctatctcaaaaaaaaaaaaaaaaaaaaaaagacctccaagggatgacctacatcctttaattatactgaattttatagaatattaattaaattggacattggctttaacatttcttatttatggaaatatttgtcacttatactgaagcaagacataacagcaaggagacacaaaactgaagctgaggtcacagcttgtgactatagctccactaccagtcaactggatgattttatgcaagttaataacatttgtttctcaacttcttcttggggtcatttaggaaggataatttttttatgtgtctatgaggcttacttgaggtaatgtatataaaatacttttttgaaagaaataaactcatgtttatttaaattcatattcaatattaactaatagcttactcctcttgctggttagtcagaggagcgagtcttagaaaagaaataggaaatctctgttgaggtttagtgaaacccagttttctgctattatatcaatggaaaagattcatggctgagcatggtggctcacacttgtaatccctgcactttgggaggctgagatgggtggatcacttgagcccaggagttccagaccagcctgggcaacatgtcaaaaccttgtctctacaaaaaatacaaaaattagctggaaatggcagcacacacctgtagtcctggctatttgggaggctgaggtgggaggatcacttgagccccagaggttgagactgcagtgaactgagattgtgccactgcactccagtctccagcctggtgacagagtgagacaccatctcaaaaaaaaaaaaaaaaaaaagaaaaaagaaagactcacttaggttgttcctctatctctttaatggttagtgttaaacccactaacccatcctttagcagaaatagattgttctatactacagtcaccattaaacttgaggtaatatatgttccaatctaaagatagctgctattgttgagagcagttaatagcaggggccctggaactacacagccaggttttgaatcttgactttgcctgatgctggtggtgggactttggagaagttacttagcctctctgtacctcagttttctcaactgtaaaatggtaatcatattagcatattacaattttcttcatagggttgttacaaagattaaaagagttaacatatataaagagcatggcagatagcaagcattatttaagtgctggcaattattattgaaggtttaagcagagtatttcaggaccattgtgtagggtatttgctatttttttttaatacctagagtaatatcactttcttttaggaatttgctccaatgactgcaggcatgtgaccttattagagattgctaatcccaagtcttggcctagccccacagacaacatgtgacccagaccatgccaataatagtatctgtctcccatgtcacagtgatggcctgaactggatcaaccagaaacagttacagagaaattggctttgcctcttgagtcaggctagaatgatttgagtctcctgtaggttcatttgggttattaatatattttattacaagcaaacagagacttccttgttcatataggatatctgtgagatacacttgttggaatagaattgtaatttttgtttttaatatgttactttcactctcaggttgaatattcttttttattgtaggtttcagtacaagaggacctagttcaagtgcagccaaagtttaaaagcaatctacttgagtctgtggaagtttttcgtgaggacgtgataaactttgcagaagcatatgaattggtaatttaagtattttcttgctgtatgttgaaatgttctgtgatgtgtttatatgaaatgaaagtgatgaaccctgaggaataggtacgttgcatgtatgtggctatatttgcgtatttgcagctatcagaaaaaggggatagctaatcctttaaaccagggatgtccaatcttttggcttccttggccatattggaaaaagaagaatttttctgggccacacataaaatacgctaacactaacgatagctgattagcttttaaaaattgcagaaaaatctcatactgttttaagaaagtttatgaatttgtgttgggctgcattcaaagctgtcctgggcttcatgtggcctgtgggctgtgggttgggcaagcttgctttaagcaaattttatagagaaagaaaacagattttactgttaaaaggagcaacaactttggagattgtggaaggaacaaagggtctggttttgtcttttctcgggggctgaattctcatggtagaaaatgtaatatagttgttggaaggccgtgagaaactataaacttctaataccaggatattatgccattgattttgcattctcactaactcttagagaaccaaaaaggtccctaagaataaataatagatgtcatactgggtcagtcccgtatgctactcaaactggtattctgactgataatgttgaccttgaagttaaactcaagactgaatatgttcccctgaaatattctttcttttagtggtcacagtggatctgtattcataagatgatttaagcccttggtgctacttatataatgcttttttttttaacatgtgctaaacatatctgttgatttgctgcctcattctattgttaaagtaaatctaaaatggagaccaggtctgaagagtccctgaacagacacagccagtcacttatataatgttttttttttaacatgtactaaacatatctgttgatttgccccctcattctattgttaaagtaaatttaaaatggagaccaggtctgaagaatccctgaacagacacagccagtcaggcttcttaagttaccttgcccttccacaatttgcagacataagcaaatctgaacacactatttcttataaatgcctatattagaaacagcttaactaatcagaagccgcaaacaagcccataattatataactggggactttccagcagaatagaccaaagaagacaactttataaatgaaaccaataaaatgttttctttgcattacttctgtgctcactctgtaaaagccttctgcagtggagaccctgaaccaagtctagttgggagtttcccaatttatgaattactgtgtgctcagataaacttaaaaaaaaaattattgggcctcagtttactttttaaacactattatattgggaatctagtctattatttagtatatctatcatatcatgattgaccatgttaatatacttaatagccttcatttttccattgggagtagcccctgttattttaatttgttgctataaattcatttattcctttgcttattttggggagtgtttttgaggattattttgcaactgtgttctggttcatagccaccagacactgctttctgcttcttccaaatattcaatttacatgtgtccctatttccatattgggctgaacagttattaaaaagaggatgttctcagaactctgtatcagttattctaatgcacaaacacagcatcatcatttgtaatcataaatgaaatttggcagagcccttggggtacacactccatatagaatgtaattttgtcacattttttattagctctgtcaaggtcctttaaaaatgaatggaagatagagtgatgaaaatgttctaaatgattgtggtcatggttgcacaaccctgtgaatgtactaaaaatcattgacttgtacactttaaatgaatgaattgtatagtatgtgaattccatctcaataaagctgttagaaataaataaaagcttcaagtacaggacacaattaaataatttaaattaaaaaaatgcttgtttacttaaatggaaataatagataaacccaataaactgacaaatacatatgattaagaatgaaaatggagattatattcttccttacaggaaggacctatggttccaaatataccaccccaagaagctagcaacaggctacagatatttcaggtgaaaccacattttttttgttacatcgacaatgtgtaatttaaaaaattattttggggaaagatggaggttttactttttaatagaaaagtttgtatttcaagtacatcagtccttaattgtattctaatctgctaaatgatgcaattgactcctctgtctccctccatgctcctctccacagaatagctctctgtatttttagagaataagactgattctcaacttaagaatataacttattttagttctaagcatttcatttgatatgtaaagtaataagaaatcatagtatagtaaaatttatcaaaataatattttaaatattggcaaatgttttccctctgtattcattattttgtcttccttttgcatccatctctttaagtttccctacttctttgtcctatctcctctgcctgtacaatactcattggatcaggccaaccattcaccatctttttctacactcggattgctgagcgcgtctagagaaagttcacacatccacatggattaatactttgcaaattcatggattcctatgtgaacttcctcctcaggagcatcaagcaattctcttctttgctcctgctctttttcctgtttcccacagtggctgaatagtgtgattagttcttttcatgtcccctttcccacctgcattcttagtaatcaaaaaaaaaaaaaaaagatcagatgcctactgtgtggcttgctcaggagaaatttgatgaagaagtggttcttacctctaagctgctaaaatctgatagagagatagcaagctagagagaaaactgcaagtgcgatgagagctgtgacctaggtatgtgaaattgtgtaatggaaacagatgggctgttagagcagatggagaaggcttcctgaaagaggaagaatctaagctgcatcttgaaggactaattagagttagccaggggaagacggaggggaaaaagaaagttaggcagaatttgcagctcatacaaaggcccggcagagaggaaactagtagggcaatatggggagatgtaaggagtgcagggtggggtcgtgtacctttgggatgcggtactaaagaggatagtggtgaggaacgaggtgacagagtgggcagcgagcaccagtggagggcccggtaggcaataataaggagtctgaattctatcttgagggttggagggttctaagcagggagtgatatgatcatacttgaatttttaaaatagttggttttttaaagatttttagtggtactaatgtagagactggtttggagagaggaagatcaaactgagggcagttttggtagtaaaagcaagaaattgtaaagagggagaccaagcaagtgacacctgtataatgaagaaaattggatggatcatgaatttattaacgaagcagaattgacgggcctgaaacctggtttgagggaaaaagttaaaggtttccaacttgggcatattgacgaaggtagaactacttatcgaaggagggcatgtagtaggaggagtagctttggggcttgtttgagcggatgaccttgttttcaagtttgcagagaaaatttagggcatgtgatgtaaaccaactgattagtcagcaactgggacattatgtgccaagattttacccaggggtgtggttgctaatgtagccaggtattgtggcatgtgcctgtaatcccagctactcaggaggctgaggcaggagaattgcttgaacctgggaggcgaaggttgcagtgagccaagattgcaccactgcactccagcctgggcaagagagcaagactccatctcaaaaaaaaaaacaaaacaacaacaacaaaaaaacccaacaaaacaacaacaacaacaaaaaaaccatctcaaaaaaaaaaaaaaaggcaatgtagggcacatcttttgcctttctgtaccttctgttctgcctgtctctcgaggtgtgagccaaacaggctgtttggcatgcacttcactgggatatgtgacttgaggtcagatttgtagacacaacccttttcaaaatgagatgtactccaaccccctaaaaaaaacaggtgccaaaggctggatgtgtgaaggcagaggtgccttatattgggccttgggtcctgatggtgctctctcatgcaaatttattttggggagttcttgggcaccctgctggcctgttgacaaagctgatactttattcctgttcagctgatgctgtgggtgtttttatgttacttgcaacctgaaggaaaaaaaaggtgagtgattagcatccatcaatagtctttacacattgatgagtttttaaacaccattattttaatgtattctaactttagtgttattgtttatccttccttagtgttcacatagtcccactcttcatagtgaagagtcctatggactcttcattcagtacatttattgaataaccaccatgccaaccaccaaggaatacacaaagtacaaaatatggcacttgccctctaggaactaagagttcattcgagttcacctggtatcttcatgccttcctgatctgggtcctgtaaaatatactaacgtatctgtcagatctgtatttttgtctaagccttgtgaggtctgatgctggatattctccagggctgggaatttagggttctcgggaatatgctgtaccacttacacagagtgctcatatgtcctcacagatgggttacttctgttggcatttgtgctttgaacattgctaatatttagcatcccaaatataggatattcaaatcccaattcaaaaggaaaaattaaaagacatgtgcattaactttggtgatttaagttgttagaattatttcaaatggtgttaaaattggatcttcttttttatagactcttcattgcatgtacagaaaacaggactgaatggattagactaacactttgctcatttgagccctgtaggatagagatggccagtctaaattactgaaaaatcctgaattgtagagttttaaaaatgcagctttattacttttagatgtacttatgggaactcgaaatataggccttctggagaagaagaagaaataattttatataaaatgaatgcttttagaatgcttgaaagcgaactttcctaagtgtttaactttttctctgatagcttggtatcagtataaatttgcttcacaaatccttattttatagctattacttaataaacctcaacctagcttttatcccaatgaaaataaattccactttaattctactgaattaattgtattttagtacaatttaaaaacctttgttacaggccagtttcgatgatctgtggaggaaatttgttacgtattcatctggtgaacaactttttggattgcctgtgactgattatgaggttttacacaaaaccaggtaagtttagaaaataagcaagtattacatgcaaataattaaatactatctattagaagaatcatgtcaccattaaatcctttatcatgcagaggacactacagcttggagcacaactgaatattctccttattccagctattctttacaaattggacacacagtctcctatacaaaagaaacgttctaggggagtaaaaaatatgttgctaaaattttgagcatgcatggtctatatttagcctatgctttactttttcttttgactgtttttgcatagtgtcagtgattatgcagaagcacagcaattttgagtaacttttgtttatttagaggaataaccttcctggctccccttgccttcttttttttttgagacagagtctcgctctgttgcccaggctggagtgcagtggcgcaatctcggctcactgcaagctctgcctcccggattcatgctattctcctgcctcagccttccgaatagctgggactacaggctcctaccaccatggccggctaatttttttgtgtttttagtagagacggggtttcaccatgttagccaggatggtctcgatctcctgacctcgtgatccgcctgcctcggcctcccaaagtgctgggattacaggcgtgagccaccacgcctggctccccttgccttcttactccatttgtggtaaaatgctcttccccattgggtagacatagaatttattgagattgacgtccaaataagctaattgattataaaccacacatataaacaagtgtatttcaatcaaattttagaatattcttaaagaatttgaaatataactttccttaaaagcaacattaatacagtgatagtattagctcattagagtcttggctttagaaaataagtttatgttgacttccttcaaagccacaacgtgaaaatttcatgaaaatagacatgaaattttctgaagagaaatgaatgcttcagccatttagggtaggtggtttgtattctctttctaaaacagtcattctccaaacgtaatccattagccaattgtgttagaattgcggatgtctggccctcatttctgatttactgaatcagaacctctgggattgggtcccagaaaatctgcattttacacactctccaggtgactgtgatgcacactcagcctgagatccaatgcgttcaccctcaggctagcaggagaaatcatcatcaccatttaccatctggaccaacagaccattttcattttgatattttaaattttatgaataattttagagaatggtgagaatggtgagaagctttgaagttttttttttgtttgttttgttttttttttgagacaggatctcactctgttgctagtactggagtgtagtggtggaatcactcgacttccgtagttcaagtgatcctcctgcctcagcctcccaggtagtggggattataggtgcataccactgggcccaggtaatttttaaaaaattttttatacatacaggagtctccttatgttgcccaggctggtcttgaactttggggctcaagtgatcctcccacctcggcctcccattgtgttgagatttcaggtgtgagcacccgcacccaaccgagaagcactttttttttttttgagacggagtttcactcttgttgcccaggctggagtgcaatgacatgatctcggctcacagcaacctccacctgctgggttcaagtgattcgcctgcctcggcctcccgagtagctgggattataggcatgtgccaccatgcccggctaattttatatttttagtagagacggggtttcatcatgttggtcaggctggtctcaaactcctgacctcagatgatctgcctgccttggcctcccaaagtgctgggattacaggtgtgggccaccatgtccggtgaagaagcacttttattagaagatttaataataatttaagcagagtaaactcaaacttttattctgtaatatcctagtttgaagatgtatatatacaaaatggggaccagcactgaatgagactaactcctcatcggctgtcatgtgtgaacctggagcatatccatgctgtaaatatggatttcatattttaaatcatctccaatggatctgtggcttatcattaattctgacttttcttgcacttgcattgtcaagactcaaagctgttgaaaactcggacagtcatcatttttttaagagaagactgtcatctgttttgcttcataaatattgaagactttacttttagatttgaatgatcaattccaagaaattttaaatttctaaatcatctatttccttgaatacacatctgacttcaacatttgtccacttatgaaatgtatcaaatacaacttatgtaaatataaataatgaaggaacactgtcacttatctttttcacaaaatggaatagtttaggttcttgttgcaaaatattgcatgataaggcccttatttctattgaagtctacggaaatatattgtttacttataaattactggattttataaaattcatctaggttatgatcatctgaagacatagtatgagatttcacatattaatcaatttcaccatcaaaagggaatgctgctttctctttcctgtttaatacttgggaaacacatttctttgtcaattttcttctctttacccttttaggtagaaaatgaaaaattctgaattcttaactgtattaaatgaaagcaactgtattaaacaagcaaaaatcaaaagacaacaaaaatggtgtctctggcattctttttatatacttttttgaaagattttgcaatactttatgttatacagtaagaagcctggaggatgatgcagtagtcatttttttttcactgttgcattaccctttaggcaatgtcatcattctcttttcttattttttttagtcatttttagcatagttgagaataataataagtggtaatgaaataattctaagaatgatgaaaaatgaatcaagaattgaaaaaataggacaactaagatcgcagaatgtgtcttagatttgtaaaatctactacgcctacatggtaattacaagatagaatgggctgggtgccgtagctcatgcctataatcccagcacttagggaggctgaggcgggccgatcacctgagatcaggagttcaagaccagcctagctaacatgatgagacctcatctctactaaaaatacaaaaattagccgggcgtggtggcatctgcctgtaatctcagctactcgggaggctgaggcaggggaattgcttgaacccaggaggcagaggttatggtgagccgagatcgtgccactgcactccagcctgggcaacagagtgagattctctctcaaaaataaaataaaataaaataaaaagatagaacgacttttacttcattacaaaatttatttttggtttttgaagtatctctgatgaagaataaaagttgtgaatgtcaatccttataaataaacttgaaaactaaaactgaatccagtagaaccttatggcatactaagggctgaggaatttctgggagaatccacaaattctgttgagtggtcaatttggtgttttacacatttaagaattttcctttacttggaccttttattcttgttttaaacacagtaacttcatctgggcacatgtgggatttttttttttggataggatcttgttctgttgcccaggctggagtgcagtggtgcaatcatagctcactgcatccttgaactcctgggctcaagcagtcctttcacatcagcctcccaagtagctgggactacagtcacatgccaccacacctggccacatgagggaaaacttctggtaggaatagggtgtttaagctcaatcttaaaggcagatcagggcttagtcaagggaaatgttctcataaaatccagcttgtatttgaaagaaaaaaaagtcaaatgaaaccttagccgcagctatgaccttatcattaagttttggtcacattgtttgcaatgattggtatagtaagtttctcattaaaaagtagcaagattttttttctttacagaataaaccatttgctaatgtcaagttatagtctgacttggaatatttgggagcagtaaacttggccttaatgacagatctttaacgaagtctttgtattgaaaatggatatagttgtatgcatttggtatctataagacattgtacacgcaatgtatgaaatatttgattggatgaactctgcctttccaataatggactttattaaatattatacatgatgtgataacttagttactttgtttcccagaaaagaactcaacttgctgcagaagctgtatggattgtatgacaccgtaatgagcagtattagtggttattatgaaatactttggggagatgtagatattgaaaaaattaatgcagaactgctggaatttcaaaacaggtgagtttcaatggaattttttataatgcctgtcttcttaggatcctataggtatttcagaagctaatttattccctaatataatagtgtatatacataaaaccttcctcaaataaatgtgaaggtggcatattttttttctctttctttctgaaagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggtacataagtgtatacgttcttatcaatgatccattaaagaatgtctgctttttcttttctgggagttgtacagatattttatgagaggttggactaattgccctctataatgcaccctcaaaatttggaatgatcctgaacattcttgacttttatgaaataatcttgtaactcaatgagattatatgattatttgaaatacattatttgaaatacatttgttctggaacccttcaatacatcttccttgtccccagaatgcacttccacttaaaaaaaatttgtttatttatgtattgtgttcttggtgaatccctctgaactattttccaaatttctaattttatgctttttcctgttcagtctattaagtttttagaattttctattattacatttttcctttccaagatttttaattcattcttttttgtggccaatctttttttttcattttttcattaaaaattttctgtcccttttgtagattcttagatctacagtcttaaatctatatatattcccagatctgtaggtttcaaatctatagatttatagatgtcttcgcttatctctttgagcattttaaacataattatttaaacatttttcattagggaaaattttaaacacatacaaaagtaaagatctccttgctctagcatttatcaactcatggccaatattattttatctatactatctttatctatacttcaacaactccaaattaaacataaagatgttttcagattcttctttaagattaatttcacctggactgaatttttgctgtgattgttttttatgttggctatcctctgagccttagatttttttcatgggttttgtaatttttattggggtggctgggaggactcattttgaatgggcaggatttcaaaaattctggcttatataatgtgttaaaattgtctctgtccgtttgtgtcttcgttttccttgtctagtggctttgtggttgcctcctacactgtccatgtcccctcagccccaagttgagagccaggtgttgtaatagcggtctccttcctctactgtgctgtggtgtgatgatccaggaatgtgctgacctatttcaggtcctggttgtggggctggttttgtgtcaccccatcccccaggtccacagttccattaaatctagttgcctagatggcagctagaggcagtgttttcagcctccttccatgaatggagggctttagaccccagcccaggtactccttttcctatagatcatttttactcttcttcaccccatgggaaccaaaggcctggccccagtgtccaggcctcaggcctgtgtttcagctccaccaactggtttgcatagcttttccacttttggttcatggatatgtttgtcttttttttaagtctggctctgtttgcttttttacttactttaaaaaaattattttatccattattctatgtttttggagttgagaaaatgcaccatgtgaccagaaatctcccaaatatatggtttgggttttctgccttcccctacctctttttaacaacatgtgtgcacaaaaagcttttctttcaaagcatttttgtcctatttgtaaatatcactaagaaacaaagaggtagaaacactttggtgaccatctccttcttataagtaggtttttatacttaataatatagccattcgtaggctgtgctttattatacaatttcaagtaattccaggcttctgttaatgactcttggtacacaaaacagagtcttggtactgtctaccccagatacatctagttgctcagccacacatgctgtaccattagccaaattagattcctgctgttactggactcactgcctctaaaggaaggcttcccttcagtacagaatttcctcttcctcccagagagtctctgctggaatctcacctcctcctctacgaagctgttcctcctcagcacagacctccctcctcagaaatcaccatggttcacatcattcttaggacatttattacacagtaatttgtgttaagatcatttgtggaaacatctcacacctttaaattctttttcatctctgtgattctaactatgaacacacattgaggcattgtggggaaaatatgttacttttattttctttcgtgagtctttcttattaagtattctcaaaaaaaaaatatagaaaaacccataagaaaaaaacaactgatgcttaagcaaatgagatattcatattaggaccagaacaggcagaaatatagtaatatctatatgttacttgaaagagttcaaaagactcttatgtatattctcatttgaatctcatagctaatctctgggataaacagggcagctgtgattatccccattttagccaaaagttcgaattgaaaacataatctgaaaaatgatgatttaagttccattgtttcatgtatgtggtacagaaaaataattagtagtcggcgattagtaaataattagtaaggctctagtgtcaagttgcaacacaatgatctgaagccttttcttggctgtaaaatgactaaatgaactgggtgacttacaggtccctttcaagcaaaaaaaaaattctatgatttgatgatgcacttaatttgtagttgaaaacatcatgacatatactttgcttttccttcaaaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacaggtaattttataatttgagagagagatttaaatgggatatttagggttataaaattctaagtaaaagctcagttttaaagctctttcattggatggattctgcactaaatttggtattatcttgtctgttcctatacaaactgcccgttttccctaataatcatggcctccatctcttctttaatggtactcatctccccttccctatttttcctggtgggccccatcctaattattcctccccagactggcatcttgtcctctgaaggtcttggctccccactgagatgacctcttcatttcatcttttctctcctttgttcctctgacatcattgacctcttggctaatcctgttcaaacattcacccaatggcccgggaaaagcctgctggccacccgtgagagcaatctaccactacagcaatctacccattaggggcttggcacttacttagagactttcattttttatggtgaaaagagcctgagaccattatggcctgaatgaggtcacctgttcatcattgaactacgaaccagcttggaggtgcctatgatcttgagtgcagctttaggaaattcctgtaggactcagattaaatattctgtcaggtctttggcactggcaacctctattcctctggccgactgtgcagtagttctcaactattcttcacctgaacacacctaagaaatagctaatatcccttttccacgttgggatcactggttagtgagttgcatgctgcatgacctctggctccaggggcagtcttgtatttgcataatgacaaagctgccagtccagggagttctgggttgaatatataaaggtcaaggtcctcggatgcatcctctgtgttcagagaatcctggcaaagatgaccataggatattcagtacttcctagacttcatgggcaactgctgccctatggttcattgcaaattttgcccatctgacttcctggatgatgacctcttgatgaagggctgtagattcacctgggcagtgtctgcagccaagaaattcaggatttgaaggctttcttcaattcatacttacttggacataacctgatgagtaaaatacctatttgtgttattagtaaactcaatgtttacaaacttctaggccctgccagaaagagtataaggatagctaagaagtcatcaaattctgggagattctcttcctagagaactttgcagtgccaagtaggtctggaaagcctgttccagaactaaccacagactgacctagtagtgagtcatacctgctggatccctaggactactttgatgtgacttcagaaggaagctgtatgtctccttcggtaagacttgactgtaggtattgcctggattgtgacacttccctggtggatccctgattccatgggacttcatgggccatggtgggtttgaccacacaaagttgtacaatgcaggtatctagccaaaggacagaaactagctatgctcgattttatttcagatctcccttttccatctttagaagttatacaccatcaaggatgactcttttttttctgtgcagaacaattttggcctatctagttgcttcatctccctaaatgcctgcccatgccatgttggtttacatgtccttatttggaagatgtttttggcatattgactgcctttcagctctcgaccagtggccagggaaacagcataaactgagtattgggaaaaatgcttcttactgcctgaacaactggattacctacctccttagagcaatttatgtacaactccatttataacttcatgtataacataggctttcagggaaattatgagttgtattcaggcatcagaccgtacccagaaaaaaccccattctacatgtgaatcactctgtcctagatcagaagaagtttgaagatcctagtcaacaagtgccactcaccagcaaatgtcactgcaccacattgaaactgcttgcccttgctacacactgcagtcggcttcttgctctaactgtaggtagttggggtttttacccagtagcctcccattgcttcctccatggcatccattctatttcttgtcctcctttgttgtgctcagctttctggaccccttgtattctcataaacacttcagcaagccctgatgatcagaaaacaggagccctgctatatgggggtagcaaccctgggtctctagctctgcagaatctagttgtagtacctggtgtaattctctctctgtgggtgggaagagcacacctgtaagtgaacatcagacttcaagcttgactctggctgtgcggtcatcttctccaggtgaacctggtgatacctaaccctctcctgatctttagggatctgatttgtcctgtccctttagagatagtctgtctcttgctggatgaaaccttcaagaccattcataaaaggaaaatccctggatagtgttctcttttcctagattcagtagttccacagaccagtaacagtgtctcacatgttactctcacaagcagaccccacttggatttggttcacagactttttggaaaaccatcttattccttgcttggcatttactcccagaagcaaccagcacagttcctttgctggacctatgcaccataaaactaggcccattctcctattctatgactgacacatgggaacaataagtaaaatcactgcagttatatgagttttattcatgaaaagcaacagtttttattagctgtatgatatctattaggaactgccctttaaggacaaaacattcattcccaaagtaatatttcttctggaatttacttcggtaaggccatactattttctgaatcttctttgaaatgtgattttttccgttcttaccttttagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggtaaatatggcttttgtaattactgataaaataatttggtgtatgttgtctatatgtctctgtaaaagtcttcacaaagacatatggtcaaggcttgactatgatggggtttggcaaactatggcccacttgcctgtttttgtaaataaagttttattggaacacaaccacatccattcttttatatattgtctgtggctgctgtagcaccacaacagcagagttgagtagttataactgagattatacggcccaaaaagtctaaaatctttactatctggcccttcacagaaaaagttttttaggaagtgctgacctctgattagcagaaagaagaaacttacatagttttaaacagtgaataatctcgaggttgtttgaggatgtgaggtacattcaaatgcagtactattatagtagttcatgtcttctaagagttaacctcataatattcctctgagaataatattaaaattaatctatattctgtaagcacagatcaactttagttaattattactaagtctactactagcagatcagaacatgctgtggagcaagaaaacagccttgggaggctgtaacaaaacctttaaaacagctctattggggccttttaaataaatgccaataactgtaataactgataggtttagtcgatgaaggtaactttgctattagaaaattaagcctgatcttcctaaacttctgtatttacaagcaagatctatataggttaaaaatcaaggataaaagaggttttttttttgctttttttttttttgaaaatggccgatttcctttgtactaatagcacatttttaaaacattaaactgaaatgtatcatttttgttttttaatcagaagtctgtatttttaaaagaggaaagattatgccaattgctagaggcatttttgcagctaagtacaaagcttaatatcattcatagtaaatagaaaattttcacttgcgaaaatgtaaatgaaactttgttttgtggctttactgtcttttttctttttttccccgccttggggtactattgagctgtaattattccaaggatcctgagatcaaattattttcatgcttcttcagtttgctcctcaaaccaaaacacctggggtgctgaaacactagattggaactttaagttgatagctctgcaaattaatcatgtggtactttgaaaaacatgttaaatgcaatgaaacaaataagcaataagcctcattgtgataaagaagcattttaatatgcagttttataactttgggtttgtgtcgctcagaattaattcaaatgaaaaaaaattgtctgtttaaattatgcagcctgagactaatagaggctggtttgaagaactatagaaaattccaaggtgaagactttgctttttttcaattatccaaatgctaatctttactggctatggatgcattttcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtaagagtttaatttttaaatcacatatcattttgtatgtgacagtgttttatcccaaacttactagtattgactacatttctggtttggtagtgatggttaaagtggggctaggaacttaaaatttcacatagattgaacttttctgtgaggaagacacctttgacttgggggtggttaaggcattgtattagtttcgtcaggctgctataacaaatttccacagacagttggcttaaagcaacagaaattcattctcacagttgtggagacaagaagtctgaaatcaaggtgttggctccctctgaaggctctaagagaggatcctcccttgcctcttttggcttctggtggctctaggagtttcttggttcatgccttcataactccaatctctgtctctgtcttcacttggccttcttctcctcttcctgtgtgtctcttatgacgacatttgtcactggattcagggctcttcaagatccttaacttcactccctctgcaaaagccctttttccaaataaggtcatgcttcaggatttcagggaataggacctggacatgtctttttgagggctaaaattcaagccactgcaggcgtagaatagaaatgtgcactaagagaacaactcaccaaactcaaatatcatttttattttattttatttttactgtcacaagaggatggtgtcaggataatttttttaaggcagttcattttcaatctctatttgaaatagggtgataatacatcctggtttgtccaagtttatgcgtctgtcctggcttaatggttagttgtcctccctttcactctcaaaatgtgttggtttggagatacggtttgtgctccccctgggtttaagccatgagctttccagcagtctcagaaaggtcataggagggcatctgatgagaaaggagaggacagcagatgatggggcagccttgctctgaatctcttgttttcccaagtgtcatccatggtggagcatggactttggttttcaccaaacattgcaggggtaggtgataagtgactttaggtgtttgctattatcttagcaaagatgttagtgattatgtcttgactaaaaaaataataatttaggggaaaaaaaaccacttggtaacatactgtcgactttatttgaaggtatttggagaagaaacgattactgtttccaagattcttctttgtatctgatccagttctcctggaaattcttggacaagccagtgattcccacaccatacaggtataatctaagaatctgtgatctaacttgcttttcccacgacatacacaatgaagaataaaagtgaagttaaaatcttaaaaatgcaggcaggaaagaagagtattacaaattacattgatcataaaatttcatattttctgtgtatttggagcctgtcatcctgatgcagtccagcagtgttaagtgactatgcactgactatgccattcctagctgtgtgatcttggcaggcttcctaatttccccatccctcaattccatatctgtaaaatcaggatattaatggttctcacctcacaggactgtcatgaggattatatgagatcatgcatagcagagtctctagcacacagtatgtgtttattaaatcgaatttatcattatgagtattttattctaaatattcttagaccaaatagggattatattttggatttgtccttttttccttcctcaatacttctcaaatgcttttagccatttcctagagcaatactttggaagaggaaaagaaaaaccgtagcaaactgagagtgggaggcacagaaggtcccatcccagggccaattctggtctggggatctgggaaacggctaatgtagtttccttgttggtttccagggacttgtaacaatgagaaaagagaatagaaaggctctgtgaaaggtggaggtagagctaggagagatggcaggactgagctgtatctgtcgggggaggaggggggaggcggtgtggtccagtccccatctggtggaaggtgacagtccttagtctaatctgcatagcatgggaggggccatttgcaggacttggagaaaacattcctctggccttgattttaaaaagtagacctccaagccagttaagggtcaaagcagagtctctctctattttttgagacaataaagtaaatacttaaccttttaaaaagatacaaaatattaaggcttttaaaaacatctcagcggcttttgtgtccagcctcatgtgtgacgttttcctctgtcttacagccgcatctccctgcagtatctgacaacatcaatgaggtgacatttcatgcaaaagactatgatcgcatcatggccgtcatatcaagagaaggagaaaaaattgttgtaatttaccttgctttaaatttttttattagaatttctttaaaaacttaggttgaggagaatacagttctcttacagaaaaaaacaggaggagagggagttctcattctacagccctgggctttgttaaaaactagtttagataaatcctttaacttctctgagactcattttgtaatttatgaagtgaaagttttggactaggtgatctgtgtagttccttccagctatagtattaggtgattttacccatatttaaaatattttgtataaaatatgaaactgtttgcttggcatagggcactatgatttattaagtgtgcatggaacgtctgtaaaaatgccaaattattatcaatttataatatccttgtaattttgttttagttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggtgagaatacacaatgcttaagtaatggtgaaaagaaatggaaataaaggggaaggatgcttagcaggtggttgacctgatggtgtgaggcaattgtagctttgaattaggttagagtggcctactcacactcattttagcctcagctcccaaccacctgcttgtcaacctacaccattctagaccaacccatcccatgtcccagaggaggatatgccactattttcccatcatgaaggatacatacattgagtctaatagatacatatgtaagcgtgtgtgtgtgtgtgtatttgtatacagaaactcctcgacttatgatgggattatctcccaacaaactcatcatagttgaaaatatcattaaccaaaaatgcatttaatgcatctaacctaccaatcataagcttggtctagtatgtcttaaagatgctcagaacacttacattagcctacagttaggcaaaatcttctaacaccaagcctattttataataaagtgttgattgtctcatataatttattgactactacactgaaagtgaaaaacagaatggttgtgtgggtactcaaagtacagtttctactaaatgcatattgcttttgcactgtcgtaaagtaaaaaaaatttttaagttgtaccattgaaagttggggaccatctgtgtgtaagtgcacgtgtgtgtgtgtgtatatatatatgtatatatatacaccaattcatagatatgatgtggatatagatatggatatatgtaaagggaatgagcataccttttcttgaaatgaaatccatcttgtctttaattttcccttcaagcaattaaaaatggacataaattgttgagaggctttttcatgcaactaatgtttagaaagtgaagacctcaaagaggccaagattggagcaggtaccaatggtttcattacactttcattcaagagaaatgaaaagtgatgatttgtgatctggccagagagagcatgggataaaaggcaagagatatccaaggaaaacgtaggcaatttttgcccaaatggtatttcttctccaactactcctcccaacctgagctccaaatcctgaattagtgcacacaaaatgaagacagctgaaatgatgtatcatttattcaaaccacagaaggacagagatataatcaacctttattggagagaataatattgtgatttttatattatataataccctgggaaactttagtattcttattagcattattacctttgtgataaagcttataaaatactttgttaaattgagaaaagagttcctgaaactaaatccacgtattttctttctccagaccctgtatatcctgaaggagaggcttggcctaaattaggctgaggatttagcattaagtagagagttgagagcaagttccaaacagtggtgaagttgaacaggatgtagtaggaaagatgactagttttcaggattttctctagtgtatgtgtgtatatatatatgaacatatatacacatatgtataaaatactttgtatttaatatatatacatatatacataaatacaaagtatttttacaatgtatataatacatattttacaaagtattttatacaatgtatataatactatatatataatacaaagtattatatacatatatacatatgtgtatatatgaatatattcacataagtatatatgaatatattcatgtatgtgtatatatacatgtatacacatatattaaattttttaaggcattttttcaaatgactgaaatctctaactatcaagttaatttaacatttttatctgaaattgtttaaaattccacttctgctttcttttaaaacatgttttaattgtttgaatgccatggatccttgctgcaaaattttggaaaatgcaaaaaatataaaagtggaatacataggtgatgggttgataggtgcagcaaaccaccatggcacacgtttacctatgtaagaaacctgcacgttctgcacgtgtattccgaaacttaaataaaataaaaataaaataaaagtggaaataagaatttcccatatttctaccacctggaaattatgactattaatattttagtgtattcccttccaatacgttatttatgtatttattgctgttttctcctttgttctttttttaaattgacatataacaattgtacatatttatggggtgcatagtgatgttttgatgtgtataatatgtcttgtgatcagatgagagtaattagcatatccatcatctcaaacatcatttctttgtgttgggaacattcaatatcctccttctcgctatttgaaactataggttattcttaactatagttatcctacagtggtatagaacaagggtccccaaccacccccacccggcccggccacaaaccggtaccggttcatgggctattagaaactgggtcgcacagcaggaggtaagcggcgggcaagtgagcatgactgcctgtgctccacctcctgtcagatcaacggcggcatgagattctcagaggagggcgaaccctattgtgaactgaactgtgcatttgagggatcaaggttgtgcgctgcttatgtgaatctaaagcatcctgtgacccccgtccatggaaaaattgtcttccatgaaaccagtccctggtgccaaaaaggctggggaccactggtatagatcactaacacttagtcctcctacctggctataattttgtgtcctttagcaaatccatccctatcctcttctccttacccttcccagcctctagtatcctccattctgctttcacttctctgaggtcagctttattttagtttccatgtatgtgtgagaacatgtggtgccttctcatattgtttaatgtgcttattataggcatcgagtaatattgatgagaatgagcattcttgttttgctgttttgttttttaatgagacatcctctggttttcaccactaagtcgcatgcctttttagactgagtataaaaacataattttaagctgttcttggtgactcaagataatgattgtaaagacttgcctttggatagacataattatgcagtggcttttggggtctgctggtctatttgtctttaagtcaggcagccttacactgctatgcttttgtagtttttctctttgtctttccccccttggaccatcatctgctgctgaccagaatctgcttgctcttggggggctttctgacactgcttgttttctccagatcccattgctcacttcagccaggtgctttcatttatctttagctgcagccctcaggattggccactgctctagcaggaaaagtatcaaagtccctgataaggcagggacagaaagagggttttattctttcttttctcactgttgagcccatgccaagcagtatccacatactgcctgccccgctttcagtcctcttttttggtccaaatgatgttggatctgtcattcgactctggatgaatgagagctcctgaagggacaaccctttcagtgaaggggtgagggtggggcatgctcagaccacttttattaccttttctggggcagaaattgtaggttaaggtgacatcctctcacagtttctttatgacttcatcaggatacaaagaatacaagcttctccccttctcattttctgtctccctctctcttctatagataagtatagagacagaaaagtagacgtagataaaaacgtggatatcagagagagggagcaatcaagaaaggagataggcagtgtattgtttttagaagagcagagagacctttgggaagccctgttcaagaacaagcagataataaagagttcctttgcttttcttgagaaagaaaaatcgttgcatggaagtatccaatagtctcaggccctctgtagaaaaatttcctaaccatcttctataacacacatatagttcaacaaatggtagccagtattttaatcatcattaatctatctactttgaaataattaaatattaacggttaaaactttaactgtttccctcctttgggagtgaagaaatgcaagtcaatctcatttttagtttaaaatgtgaataagtgaccaccaaattttattgcagatgtgctttaaatatttggcaaattttaatatttttctgctggatctgtaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaggtatctttttttttaatttagtgtactaactaataatgaacagctaagaattgtatatgttgcctaacttacatgaactttccatttacttggtcctttttcataactgtccatcaatatcgtgtccacagtattgtatttctgtattggatggcttaaacaaccatattatatattcatttggcactctgaaagtttggaaccaactgatgtgatatgagccagctaattgttccattaaaccaaataaccaggaacatgatataatttaggtcataagctatgctgggtcgattggaaaaggagcacagatggaacggaatcaggcttcagagcactctcacggctgttcgtccagttgatggtgatcatgggcttgatttaggcaaagttctgtagggtgggactaagaaggataagtgtttgaattcctttagaaatgggactctaaccagtggccttgaccaaggccaacttctcctaaagcaaggatttttctattacaggtggttttgaaatgccactatttgataatctttacctcccatttaactcctattgctttagtctacttgatttgatacattttaaaggtatctctttccttcatcagagacacataattcatgcaggttgggtcctgttttagagaatgtgatcacagactgcctgttttgaagttttaccaaaagttctgatcagatagtttgtatttattgaagattatttgaaggacatccagtcagtccgtccatccccctgcaacccagatccttgcttctcaaagtattacatgctgaccagtgctttggtatcacctggaagttggtgaaaagagcagaatctccagcctccctcctcccatccaagacctactgaatcagaatctgcattttatcaagattcttaggagattcatatgcatattgaagtttgaggaaaaactgctctaggatttatctctggattaagctactatcagaaagctgcacacttatattgttttggccttccacggactagcttttactaattgcagttactattatactttgactttaattgatgtccacctcaagaagcactagtatggagttcattattgtatctgctgtcagcatacgtttgaggatgttgtctatacgtctctcactggctcctaaaactgaagtcctgtgaaagaaatttcttttaaaattaagtgctgagcaaactttactttacatccagagggattaaaaaaaataaacctgtacataaggaaaactatgaaaccattttcttttatcttaatcaccattgaactgtttgcatcccaactaaatgagatgtcatggccaacatatatgcattttatttttccatgtacaattattagaacaacctgatatacagcaagaactcaataaatatattaactattcttcttttcttctccacctcctccttaccatcttaacagatggttgaaagtagctggctgagagcatccccatggccttgagtcctgtgttacagagcattccctgtgggtggggccagactgtgttacctgaaagtaactcaagatgatgaatacaaactgtgctttaggtgggaagccagtccttaactagaggaggaagcaagatcataaccaaacaacaaacaacaatagcaaaaagcaggactgtaaatagcaaggaatatggaggcctggtcagatggagatctgaacattgtatagtagccacgagtccattttttagtgtcagttgaatgacctggaagtgggcctactggatttaagagcagtgaaggggaccacttgccacttcctgtgttgattcctctgaatgggcaggactggtgtttcaccagtttcactggaaagtcacgaagctcctcagaatgtggttatgatggaatggaattcctaagtttgcttacctggtttctgtctctttgaacagaccaggtactagagcttgcatccatggctatgagagcccagtacctcttgcctcacttgtatatgctgatgactaggcagattgagtggcttggctatagtgctggtgcagggagacatgggcatatataaccatgtgtttccctgcttaatccctttagtggcttccgactgctatgaagacaattcctaaaccccttcccatggccctgtgaaccctcaactctcatgctttctctagatcccgggatgcccctagctgtactgaccttttttcaattccttgaagatgccaatcagatcttctagacatttgcctatagcacttactcttcccacaccctcatgatcccttttgttccccgctcctggtggccctggctaattcctactatttatctgggttttagttgagatgttttcttcctctgagtgcccctctcagatatcctggagtagttaggtcctcctgctccatatattcatgagccctgaatttcggtggtggtgccctttgtactttattgcaatgatttgtttcactgtttgccttttgcccttttctgtaagctctggaagcctggaaccatctctgtctttgtttgcctagcacagtgtcaagcataggaagaaactcaataaatatttgttaataagaatcagttcatcaaagagtgaattttaaaaactgcccacatgcttatgttttatgctattgcaattcagtatataatttttttgtattttatgtttttaaggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagataggtaggaaacccagttttcgttttttattttgtaattttaaaatgtgcataacattatttatagttgaatttgaaatattaacaaaagcagatttctgtcatgctgggtagatgctagctcattaaagtcagcctaacaatgaaataaccacttaaatatacatgtgcattgaatttttatgaagtagaaaaagataaaagaataaaagcaagcttgaatgttgactgtgagtgatttaatggtgaattttagattgcaagatggaaaaatattcctagaatcccaaaagaagttaaaattgcaaagaaggaaggtcccttggagatcatttaatttagtctttttttcagatgtggaaattggcacctaacgtacattttcatggccaatatgaataattagtcaatggcagatcccgtcacaattctttccattatatgacactaggcaattactaggtcttttttatcccatgacacccagttaagtatgctgtgcatagaaaacattcaataaatgttgttagaattgacttaaattgcgttctttaatattaagtgctgctgttactttaagtagggctgcctccaggtgaaattatatcaaatcacatcttcagcctccttttgatttattgaacctatcccttttatatgcccagtgccatagcaacataaatttgtcagtgttttctcttctattggtgtttacatattaagcatcgtgtctcatgaagctttactaagatctttactaagttttacttagatccaaaacaaatacaacagaagctggatcatggatacaaagagatttattatattagtattctttgcacttttctaaatgagcgaattatttcatagtgaaactatttatttacagtggtgtgctggagctgacttgcatcagcctgtggtgcttacctggtttctttttttgttttgagacagagtcttgctctgtcgcccaggctggagtgcagtggcgcgatcttggctcactgcaacctccacctctacctcacaagtagctgggactacaggcgcatgccaccacgcctggctaatttttgtgttttttaaatagagacagggtttcaccgtattggccaggctggtcttgaactcctgacctcatgatccgcccacctcagcttcccaaagtgttgggattacaggcgtgagccaccatgcccagccttacctggtttctgtctatgtgcattttgccccgactttgtgatatcacattggtagcttgccattgaccacagtggaagaatttatacaatagatattggcaaacatgaaaaccaggttttttttttttttttctggagagccagttgttaaacatttgccagcacaatactgctcatttggttctcctgactgtaatgggaggaaggcctgagggttttaagtcagggttgaggagttttgaaattagtctcaagaaatctttgggctcactgtagtacttttaatgaatatcaagtaccctaaccttgtttgttcacttcttttatgtgggctactcagactctaaaataaataggcccattccaatcacattggatttttgcttgcgccatcctgtaacgtgtcatcccatactcacaatgctttattggatgaacatttgcagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggcaagtgtcaaataatgtagattattttaggtgaatttatttttattgccttttaatgttattttctgatataaatccaaagtgacgtgatctcatataatctacattagtatgggttgatccgtatgatattgccatttttctaggtcaaaaatggctggatatcaacagtttcatatggttcaatactattgctagtgttatagtctatgcatggaatgtgtgttagattacgaaaatggaatcaatctataattgcctgaaataatagtagagaggatcaaaatagcaaacaggggacacatgtggcttccctcccacagaaatgaaagaattttagaaagcatagcaacactggaaaataagaagggggtggccatcagcagatggaaaattttgagaaaatcctgaaaggtacgtagaacatgttttcagatggacagagaaaaaaatatttgaagacacatcaacctcagagctcagtacttggcgatcttctcttttctatctacatgcattctcttggtgatcttatgtaggtccaaactttaaatgccatctgtatgatgactccagaattatatctctagctcggacttcttgaaactctagattcattacgtacaactgttgatttagcatgtccacttaaatgtctagcaggtgcagattcactatgtttaaaaccaaactcccggccgggcacggctcacgcttgtaatcccagcactttgggaggccgaggcaggcggatcatgaggtcgggagttcaaccatcctggccaacatggtgaaaccccatctctactaaaaatacaaaaattagctgggcatggtggtgcgtgcctgtagtcccagctactcaggaggctgagctagaattgcttgaacccgggaggcggaggttgcagtgagccgagatcttgccactgcactccagcctgggctacagagcaagactctaccaaaaaaaacaaaacaaaacaacaaaaacaaaaacaaaaaaccccaaaactcctgatctctaggtgctcagacacaacaacaacaacaacaacaacaacaaacaaaacaaccatccccaaacaacttcgacctatcctttactccgctctttctcttatactcagatccaatctgtcagcaaacactgttggttctactttcaaaatacccccaaaatttgtactttcatcttagcagtgtactgtttccattgttttgatgaaaatatacaaataattaaacctctctttatcactggaattaaatatgtatttatcaacagccagatatgaaactttacataatcccgtttcaatgtataatggtttgggagcactggagaaatgattgttatcaagaaggtatattatagagtaaaactttacaaattaactgtttttcatgccaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatggtgagaaaaaaggctttaaatgcaatttaattagtttaattgttacagacataaataaaacaaagcatgtgttaatgggtagatgaccaactatccaggagttataagctgttctctcttaccatatgattttttttatgtcattataacccagacagaagataaaatagtaatttttttcaattaaaaaaaattcagatccagacctacagaggtaatatgctaaggataataatagatactgtttattgaccacatagtataatatgtgtaaggtgcaggctaaatgttctatgtgctatatcagatggcataactcatgtggttctgcagtaacaaacaatccctaaatcttaattgcttaaagccacaaggtttatctctctgtcatgccacatgtccactgtgggttgactagggtagaagtaggaggccagggctgctttgtatgtctttactctagtactcggcctgacgaggtacctactatctcaatcattgctctttgctgtagcaaaggaaaaagagaacatgaagaattgtgctctgactcttagagtttctttccagaagtgacacaagtcctaagacattggctaaagcaagtttcacgacctaacttcagggggtggtggggtgggggaaaacgtgccatcctatcgtgtaactagaaacaggaaggacctgaaatattctctcacatgtacactgtatcttatagctatgatagccctctgaagtggatattatatagctgacttacctgaggctcagcgagacttaaaaacttcctaggtcacccagccagtaagagaaagaagaagttgttgtctctctaacataaaaatctgactgcttaacctccacacttggtttttctttgacaccgaataaaaggaaataaaaataaaatttctgcaataatttaacaaggtcctatacgaaagaattgtaacaaattcagttaccatgtgattaagggtgagctttgagattcagtgttgtaaagataggaaaccaaaggcatgaataaacgggagtttttatgcttttatgtatcaccagttttaaagcttttatgtgttttccataaagttaaatctcgaagttgcaagataacacaaagcactctgagtttttaaatgtccccatggataaagatgataaattataggaagcaaaatcagaaatgtttctgatacactttattgtaagcaaacatccagtaaagcagttagggggaaataagaataatctgaagtattgattataagtcaggaagtgggatgaagaaatgtactcagtgtaaaactgtggtctagaattttacaaaaagcttaacatgctccctggattaagaataatattggaaatagcaattagatattgcattaagctgtgagtaactgaaacctaaaaaaaattgtagtttaacatgtaaggattctcttaagatccttttatggttctactccatcatgaattccatcttcaaggtcaccttatgaaccaagatgctacagaaagcatctctattgtgttgcagccaattgactgagtcaactctcttcaaaaaaacatcaaggatatttagtacagtgtgcccctttgcatctcgcagtgtagaatataatcacagcagctgcaaggcaggctgggaaatgtagtttttaatctaggtgttgctgtacccagcttgcaggtgggctcctgtggctcaggaaggttaagaggagtattgagaggcagcctcaatttctgtatttccagcccctagcaaggtacctggcctattgacagtgcccagtaaatggtcagggactgaaggtttttaacaaacttgcctaaaataactcattcctgttggccttacttgtctttgaatctccaaccttcctttgagacttgggtctgacctctgttcaacctgttgcttcttaggaggacttcatttcctgtctgtctctacttttgtccatttcagtgtttttcccatcattcccttctttatttcccctcactgccatctttatttctcctcacttccatgggtttttgttagccaaagagctctgtaactgtggctgcaaagaataattgaagagatggaataaaaaaaatgcccaaggaagctcatcagtataaaatccttagtttttttcttctttcaataacatactttagaccataattatcaggtatctattcagttttctcttgtattatttcacgttcttttctatttttaagccagcagacacaattttctattttttaagtcagtagacaattttgccacacaaaattgtgtgtgactttattaatatcatgaaaatggaaatatataaaagggcatataaatattaatatacatggtctaatacatattgttttgagaaaacaagagtattttatgaatctaatattttcaataccatcttaaaatctgaattaggggtttgaaatatatttgtattcagaaatgaaaattgttttagcaattaaaaattaaacatattttaacttttagaaccctggatatgctgggcgccaggaactaccagaaaacctaaaaatccagtttagaactgttgctatgatggttcctgatagacaggtatgcactaggatttaaaagcataatgtgctttatgttctttacttgtttttcactaaagttgaaaaaaactcactatattaattttcagatcattatgagagttaaacttgcaagctgtggttttcttgaaaatgttatcttggctcaaaaattttacgttctttacaaactctgtgaagagcaacttactaaacaggtaactttatagatctgctttcctcctagcaatagtatttggtttttttgctttgtaattttcccttgataaatactcatcagtgagttaaaatctcattgactcttttctaaaatgcttttagaattaattttacctattggttgtgtatttttaagacccttttattttgaaataattgtagattcacaggaagttgcaaaggaatgtacagggaggcatgtacccttcaccctgccttgcctggtggttgacatcttgtaactgtagcgcaataacaaaactggaaatggacactgaagcagtccacagagtttaaggtttcatcagttatacatgcactggtgtgtgtatatgtgtgtgtgtgtgtgtgtgtgtgtgtagttgtatggaatatgtaagatacggctctgttccatcaccacaaggttccctcatgctactttatagccacacccacctctctcccaaatccctaacccattaaccttttctccatgtctagaattttattgcaagaatgttatgtaaacggaatcacatagtatgtaacctcttggttatgcatttaaaaatctattgtttgggccgggtgccgtggctcacgtctgtaatcccagcattctgggaggccgaggcgagtggatcatgaggtcgggagatcgagaccatcctggctaacatggtgaaaccctgtctctactaaaaatacaaaaaaaaaaaaaaattagccaggcgtggtggcacgcgcctataatcccagctactggggaggctgaggcaggagaattgcttgaacccgggaggtggtggttgcagtgagccgaggtcccgccactgcacttcagcctggatgacagagtgagactccatctcaaaaaaaaaaaaaaaaaaaacaaaaaagaaactattgtttgttgctcagactgtatcagactatattattctcaaaagatatttaaggtgtgaatacttacttgatcttgcagcttggattttcccatggaatgatcatatttcagtcaaaggaaaggcaggaagttgagctaataaacctttgtggcttagtcaccccaaaactatcccatataagtatcagaatcgacctatatgcatagagtgagccgtgagtctatgtttagtttttcaattaaaccatctttttgccctcttctcccatctcaggttcattatgactttggattgagaaatattctgtctgtattgaggactcttggatctcaaaaaagagccagaccagaagatagtgaattaagcattgtcatgagaggactaagagatatgaacctttccaaactggtatcttctctgaattctcttcttttccacaattttaatattgtttctttctatttggtggacaagtagaggtaggctgatgttgagctgtgagcacccataattacagggataataagtgtgcaaagctaccactgtgcttccagaagaaagcaaaagaccccatgacctgtgtgaccaacatggactataagtgcctccttttatcagctgtgtgcagtgaaacaggtcatcagtgggcttcagctccaagactcaacctagttgtctaccattattcacaaagtgacacaaattctcagcataagaatctggattcacagggaaccatgagaactttttgctttctctgtatgtgactagcttatctcagatatatctctcccaaaacataaacatcatttctattttccaaaaacacattgaaaatttgctgtggagagcatgctgctttcatgcttgtcatggttacagcctgatttttttttttttctttgaaacagactctcagtcacccaggctggagtgcagtggtgcaatcttggctcactgcaacctcctcattccaggctcaagctatttccctgccccagcctcctgagtagctgggactactggcacacaccaccatgcctggctaatttttgtactgttttgtagagatagggttttgccatgtcacccaggctggtctcaaactcctggactcaagtgatccaccccacctcagcctcccaaagtgctgggattacaggcataagccaccaagcccagcccagcccagccaggttgttttgaatagctgatggacaggttcatgtgacatataaggatttctacatgccacatattgtgcccatgccatgggtgtacaaagttgaagaagaagtggttcaggaagctacattctagttacaaaaactaacatctgtggagttcattagtgttacaaagtcttttcaggtgtatcgtcttatttgagcctcacagcaactctgtggggtctggatggctagcttgtttattgtcacttcacttattggggaatggagactagaggttgcaggattcccccataatcaccatcagctgagaagaggggacaaaaatttataagattttctggtgccaaatccactgctcctgccagtatacctcactgcctgtatgaccaacatggactgtaatggaggcttagactccctaagtcacccaggctggagtgcagtctaagcctcccttagataatggtattttggaaattcctagacaagtactcaagaaagcatcagcaaagccctagagaataaagagaaatcataaggggtcagatgttgggaacagggcaatctatgcattaaagacattgcaagcaaggattggagtcagtgtactcaaacctactgcttataagaaaggctcagaacactgccctgatggacttttgcagccattgttggatgaagtcatgcagggttatggctatttccccaatttaaataaaatatccgttctttaatttcatggggttgggactacaaattatcatttttaaggttaatgcaaatgccactgtgagaagcaaagattcatgtgataaagtaatgaggtcgtactttggagcagtagactggggcaggattgtagaacacattgaatgctaacgaactttgggtacaatatagattcagtggtgattgtattagtctgttctcacactgttaataaagacaatttataaaggaaagaggtttgatgaactcacagttccacatggctggggaggcctcacaatcatgctgggaggtgaatgaggagcaaagtcacgtctttacatggcggcaggcaagagagcatgtgcaagggaactcccgtttacaaaaccatcagatcttgtgagacttattcactatcataagaacagcagggaaagacttgcccccatgatacaattacctctcactgggtccctcccacgacacgtgggagttatgggagctacgattccagatgagatttgggtagggacacagccaaaccatatcagtgatattctggagaaagtactagagaatacaagcctgattaggagagtaataaatggttctctggggatgaagtgataagtactatgcacatcccagctagctgataaatgtttgttgactgaatgagtaaatttattttaaactatgccaccttaggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcaggtaaagacattttaatctattattagtataatgataagtatgtgttaaacattcctgtctgaatagaaaaactcatagttagtcttacttgatgtaaatgttaaatgaaaacatcatatatacatcattgcaaaaagaatacttggaaggatgtggtggtcctaggaagatagtatggatttaccctgcctcacagtaatcaagcagtaatttactgcagtttttacttatacctggtgacaatgttgggcggaaatagtaggttataaaaactctaggggaacggaacaacgcagatgtcttcttgtgccaatctgatagtactggctgcagctgggtgcctcagtggagtgcagagcctgaggaatctgggagtgctattttgctcctgctttgtgtgtggacatgttatatccttcacctacactaaaacctgaatcttttgactgcatatgttggtgtctttctgttcatcacatttcatccttgtgacaaccatctaaccacttgattggattaccagtagaatcaagaacttgtagcagagacacaggattaaatctctatgagcttgatgctttgggaatattttccagagcttttggaaaattaaggagctgaaattgtggacattgttgaaaactgcatttgaaatattaatataacgattcttattttaacttactgttcttgccagattataagatgtgcaagtatctgagatacatccaaatcttacaaagaaatatgtgcatgggggaaaagtctttttcatcattcatgtactggaaaccattttaagagtttaaaaaatttctgggaaaacatgattttatatatgatatgcatacagtatactgagttttaaaattcttgccatctcaatgggtggcgactagaattttgggttctttgttgatgtcaataacattgctcttgaacatgtcaggaacagtgcctctgttgcttttaaactatagtttacaatggtaatacatttctgtccaaaatgttaggagaataactcactctccctctgatcagctgtcagacctttgacttcttaatttttttaatgagaaaactgcagacgggatgttatagcagcggctgtccatgatcctagcatgtctcctcgaatctcttgtaccatttccacgtgcccctgcccagcttctgtgtgttttcgcttctaatagcaaaaggaggcctggagccattttgttggcaggcacaaagagtaggtgctgcacgggagtttatttcccatccacccccaaacaaacgtctctaagagttgatggagtaggaaagtcaagcttgcctggttccaggtggagcaatctttgaggtgtaagttacactccagtctcccgagggatcaggctcaagtctgtcctctacagggctttgtcctcaatcacaccttgcttggcttcttcccattcctgtcctgctttcctcttctcttactggtttctcctgggagcactacctgaataaatcacttgcacaggaatcctcattcatgatgtacttctggggaattagaaggcccctttgaaacggatcttcactgtgatgctctgcgttgctgctttccaccactaaggggcgatatcatcacattggatgccgagaaagtttgcgcatggaacaactgctggttatagaccaacaagccaaaatcacagggaatcatcacgcaagaagcaaaaactagatgctgagttaattatttccaaaatgtaattcaagctccacattgttattactttagcacatatcgttttataacgtggtgctcatttgctatgcacatctagtaaaacaacattttttacaacttaaaaatagtgaactagttacgttaatgaagagcttattaaagcctttaatcttcaagtagctactatgaatgtcagcaagagactcataaattacatattttaatttactggttaattgtgtagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtatacacaaacctcctttgtgatcattttttccctgctagcgtattaacacagtatttttttgatttttccattttaattacttgcaagtgaaaagtgattttctgttttaattattttcaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggtggggcagagagatgggaagaagaaccctcagagtctctccacgtttcactttctcaataaacacagattctgtttctttgttgcaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaagtaagatttttttttgtacatttactacttcgattttgatttttttttcactcagttgcagtttacagccatctgaaatagaaagttcagacagtccataaaaatcatttgatgatgtggctgtaaaagctctgataattttgatttctattaaagatcttcttaatgatcttactgttttctctattattttcacttcccagagggatgttgtcagaggaaggggaatgaactatctttcccattgtcaggtttagtgacctgtcccataaagtgtgtataataatgacagtcaataaaatatagtaattaattaaattttaaaataaataaaaaataacacatacacctacacacacacacacacacacacacacacacacacacacacacccctgcactccagctggggcgacagagtgagaccctgtctcaaaataaataaataagtaaataaaaataaataaagttggtagcttcgtgggaaagaacagaaaggggcctgttgcaatcaagaaaacttgggaggcaattttggctttggaaatttagcatataacaggtaaggaaaatctttaaataaaaattatctgacaagtagttgtagcattgttttttccctttcttccttcctttcctctttctttccctttttcttttcttttctttctttctttctttctttctttctttttctttctttctttctttctttctttctctttctccttccttccttcctccttctctctttctttctttctctttctccttccttccttcctccttctctctttctttctttctctctctctttctttctctctttctttctttctctctcgctctctctttctcccctccctccccttcccttcccttcccttccctccccttccctcccctcccctcccctcccctcccctcccctccccttcccttcccttccctccctctctctctcttcttttcttttcctttcttttctttccttttctttcttttctttcaacaaggtcttgcctgttgcccaggctggagtgtagtggtgcaatcaatcataactcactgcaaccttgaagtcctgggctcgagctgtcctcctgccttagcctttgaagttgttggggctacaggcacacaccaccatgcccagctaatttttagattttttatagagacagggtctctgtatgttgcccaggctggtctaggctcctggactcaagcagtcctcctgcctcagcctcctaaagtgctaggattgcaggcatgagccaccatgcccagccagcattctttatttcctactcggttttccttattagtctttgagttaaaacagaattaatcatagatcttcaagggctctcctaattctgatctataggtgatctctccttacacattctagagcttcaattctcagttaagagagtcagtcatttgtgggtaggttagaaacaatatataaggccgaaatcagtgaattatttagtaattactttaaaatggatcatagaagacaatattttattttgaagtaattttgttttgaaagaccgaggatgtcctactgtacttgtctttctgatgctatagggcattggcacactttttcttaaagggccaggtagtattaataaatattttaggctttgcacaactctctgtctcaaccactcagctttgctgttgtagcacaaaagcagctagagacaatgcataggtgaatgagtgtgactgtgtgtgtgttccagtaaaactttatttaccaaacaggtggccagcctctagggccacagtttgctaagtcctgcaaaattttacaaagaaatagaatctttgatctggaaaatttagataacttaactttagaaccagtagctaccttagctgcttacatcgagtctaggccttttgctttcccagtaggaaattgagactcagagaggtcagtgggatgagctgagggttgaaaccacaggagcagattttcagttcagcatcctttctgctagaccatgctgcctgtctaaaacaggatagcctttcttctacgtgctgttggctgtaggacggtgatcaagcaatagcttgagatatatctatttttcttctctcttccttcctccttttaattttactattatttacaattttttattttcaaaattttaatttaaaaatttattttatttgaaacattttcagtctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtaagcccactgaactataccttaaatgaaatgacttttttcaaatgagaaaatataagctttcataaactcttctatgagagaatattaaaacaattatgaaaacataattgttaataccattttgaaaagagcatgtatttgaaagagagtggaattttgcatatgaattgtgcccgaaactgatattgagactcttgacttctccttttggagtgggctcagtaaaatctggcataaataagttagtaataccttgtacaacatctactttctaatgctggaataggaaaggtagcagcgtggagaacacagattcttcatgatgcaaagcatgctaatacacataacggatcagccccacaattcccctgttgggaatgccagaatgagtagagaatgaacgtagcagattcctcaaggtccagcgctgtcaccttagccccccagccttccatgtatggccgggcccagctcactgctccttaaaagaaatgcctttgaacttggtgctttcatccagagcccaggccctgattcttcaaagttccaaagaggaaaaatatgcttcctaaaaactctaattacctctggttcttcctaaaaactcaaaaacagcaatagtcttttgtttgtttgttttaatgaataaactgaaggacaactggagcaggagagtagacagcaatagccaaattttgaaagcaagaaagcagtaaggtaagcggcagtcgatttagcacactggcagtgggaagagctgagaagtaattgagaagcgcacgtcacaggacattcaaagggctcaggaagtggaaactggggcaaaagttgagctaaaaaccacagggctggttataagtctgtttgagaaaaagacctcctgggccgctttccaaagccctgctgccagacaatcggccttccccacactggcaagactaaagagttactgtttgaatcgtgtaaaatagagggtttcctagacttggggacaccaggcacatttaagagtgggagaatcataccaaaactggggattaagtggaaatttgtgtttgaaagggactgagataaataaattttttcagtgggccatctttaaccagaaaggccaataattgtattacatgtgttagatgctgctaaaggtttgagatggcaaaagggcactctaactcaaaatgcaaactaacaaaggaatctttaaatctagatatgcactcccttagaatccagagccaagctcctccacagcgctgctttctgagcagccggagttctatgatgtttaaaggttcagattgcctccctctgagtgccttgtccttattcagaggccgggccccaagttactcagagagtgaaattcatcagcagcaattttccaaccatggcagagccttggttaggggattgagatggcatctaataaggaagccaataaaataattaccttcctctgtgccatcaaaaatatgtattgccacatttcttaaagagcagtccagtgatgtttgtgacattttcttccaagtagctaggactggttctgtaagtttagacaatgatgttttcttatttttaatggagatgttaacaaaaggttgacaacaatctagactcatattccttcttcaaggtggtcctgaagtggtctgttgactaaaatattgaggggttgcaggcattcagtcttgccatcctaagtaactacttttgacgaaatttatttgcccgagcctttgtggccacgaaatgaactaagatattatgcacttagtggttatttagggccctaacatgtccactcagctgacttctagccagccctttcttaactcattcttcatccatccttttaatttttttatggacattaacatctttggagaagacttcattcatagatttaaaatgaagtaaggagacttatgcttccagcgaagatggagtaatggggactgggtttaacctcttatattaaaaatatagaaaactggacaaaatgtgtaagacggttttttttcagagattggacaataggcactactggactgaaatcaccgagggaagtgaaacaaggtgattgcattagtttattgcatggatgcagtttctagaagcagctcagggaggggaagatcaaatagaattggctgtctcaccaaatgagaaggcagaggttgatttgggagaggccaaggtggctggaatttgcagggcagagcaccagagaggagaaatctgcacaaggaggaagtgtcagagaacaacagaaacagaaagacaaatccacagttatactaaaggtgtcaatattttgaataattgatagaacaaatagacaaaattagtaaatatatggaagactttaacaacactatcaataccctgaattcaaaattatagaatgcttcagcccaaaacagcagaatatacatttttttccagtgcacggaaaacacttaccaagatattctgggtcatataacaattctcgatagggagactttacagcactttatgtctttactagaaaagaagaaaggtctcaaaacaatgatttcaacttcttccttaataagttaggaaaagaaaagcaaattaaacccaaagtaagcagaagaaagaaccatgatcaaagcagaaatcaatgaaacaaaaaatagaacagcaacagaaaaaaatcaatgaaacaaaaagatggatctgaaaagatcaataaaaagaataaatctcttattagagacatcagaacaaaagagaagacatacattaccatagtcaaggatgaaagagagaacatcactacagtcctcacaaacattagaaacatgacgtgagtatattagaaacaactttgcaagaacacatttgacaatgaagatgaaatggacaaatttcttgaaagatataaactaccagccatcatcaagaagaactagatattgcacagcatgctgaatatagttaataactgtgttgtacatttcaaaattgctaagagagtaaatttcaaatattttcaacacaaaaaaatgataagcatttgaggtgatagatatgttaattcgcttgtaataattccacatgatacgttaattcgcttgtaataattccatattgtatccataaaccataacattttgttccccataaatatatacaattgtaaattgtcaatttacaataaaatttaaaaagaagaaatagatatcctaaatagccctatatctactaaagaaattgaatttgtagttaaaaaccttcccacaaagaaaaacaccaggccaagatgattttattggtgaattcgactaaatatttaaggaagaaataataccaactgtacacaaactcttccaaaagatataaaatgtacaataggaagaaacacttcccagcccatttcataaggacagtgttatgctcatgccaaaaccagagaaagacattccaagaaaaaaacaaaaacaaaaaaaactatagaccaatattcctcaggaacattgacgaaaatttcttaataaaattataacaaatccaatagtatacaaaagtccaactgtggcttttattctagaaatggaagatcaacattcaaaaactgatcaatataatctgccatataagactaaaaactaagcaagccataaacagtcatctaaatgaatgaagaaaagcatttggcaaaatttgacactcttttgtgatgaaataggaactttatcatctgacaacatctacaaaatacctacagctaacgttatacggaatggtaaacaactaaatacttccttcccaatatcaagaacacaacaaggacgtctttctcacctctattcaatttcatttctattcaacattgtactagaggttctagccagtgcagtggggggcaaatcaaatgtctatagattagaaaagaacaagtaaaattctctttatttgcagatgacatgaccatctgtggaatcttcaaaaagttattagaactactaaaggattttagcaaggtcacaggacaaaagggccatacatttgataagttatatttctatatgctcacaacaaacagttgaaaattgaattttaagaataccagttaaaatagaacgcaaggctgggtgcaggggctcacaccttcacacctgtaatcccagccctttgggaggccgagtggggcagctcacctgaggtcaggagttcaagaccagcctggccaacatggtgaaaccccgtatctactaaaaaaaaacaaaaaaattagccaggtgttgtggtatatgcccgtaagcacagctactcaggaggctgaggcatgagaatagcttgaatctgggaggcggaggttgcagtgagctgagattgtgccactgcactccggcctgggagacagagtgagactctgtcttaaaaacacacaaacaaaaatagaatccaaaaaaagaatacttaggaataaatttaataaaatacgtgtaagatctgtatactaaaactgtaaaactgcgctgagagaagctatagaaggcccaaataaggggacagatcttatttaaacattatttaaagattattttgctatttgaaatagcaaaatctagccagtgcgatggggggaaaaatctcttttgctgtttaaaagtcactattaagaaaatgaaaaacccagccacagactgtaaagaactatttgaaacatatatatctgataaaaaaaatttatccagaatatgtaaagaactcctataatccaataactatcaataggcaaccaatctaaattttaaaatggggaggaaatttcagttgatactttgctaaataagataagtgaaaggtgaaaaaagcatgtgaaagatatttaacatcattggtcgtcagggaaatgcaaattaaaactccaatggggtctgggtgcagtggctcatgcctgtaatcccaacactttgggaggccaaggcgagtagatcacttgaagtcagcacttcgagaccagcctggccaacatggtgaaaccccgtctctactaaaaatacaaaaatcagctgtgcgtggtggcgggtgcctgtaatcccagctactcaggaggctgaggcaggaaaattgcttgaacccggagatggaggctgcagtgagctgagatcgcaccactacactccagtctgggccacagaggcagaccttgcttcaaaaaaaacaaaaacaaaaccccgcacaatggatatcatcacatagccactggaatgtctacagttaaaaaggttaataatgccaaatattggtgccgtaatagagcacctagagccctcatatgctacagaatggcacagccactttggaaaatagtttggcagtgttttagaagttaaacatactcatttttgcttactttctcaagaaaacatgaaattggggttattactccaatgatgagtatttgttcatcattgtttcaccaatatcaatgtatgctttctttccatgcattctgtgtacacagtaacttttgggtataattctgaatcattgtataatctttttgaagacatttaaaatagaggctaaacgtatcaatgaaagtaattcaatttgaatggcaatgataggaataacgccaatacaagtttgcctagcaacagcaatggtacagtaccacaggttgtaaggaacatccagagatgctaaaatgtaaataaatttttgaaatcaatgttttttttttttttttttgagacggagtttcgctctttgttgcccacgctggagtgcaatggcgcgatcttggctcaccacaacctccgcctcccgggttcaagtgattctcctgcctcagcctcccgagtagctgggattacaggcatgcaccaccaggcctggctaattttgtatttttagtagagacagggtttctccacgttggtcaggctggtcgcgaacttccaacctcagctgatccacccacctcagcctcccaaagtgctgggtttacagacgtcagccactgtgcccggacttgaaatcaatttcttatggcaaatactctatatctagtaaacggttgactctttttttggtcttttccgtcttttcagttgatgtggcttttctgctaggcatccattacattactggttttaccaccggctgattttaattccatttcaggcaaggtttctccagatgggtgagttagcaatttaaaagccaatttacaaaaaataacagatgctggagaggttgtggagaaaaggaaatgcttctacactgctagtgggaatgtaaattagtgcagccattacggaaagcagtttggtgatttctcaaagaacttaaacttagacctaccatctgacccaccaatctcattattgggtattatactcaaaggaacgtatatcattctaccataaagacacatgcatgcatatgttcattgcagcactattcacaatagcaaagacatggaatcaacttacatgcccatcagtgttagactggataaagaaaatttggtacacatataccatggaatactatgcagccataaaaaatatgagattatgtcctttgaagaaacatggatggagctggaagccattatcctaagcagactaactcaggaatagaaaatcaaatactgcgtattttcaattataagtgggagctaaatattgagtacacagggatgcaaagaaaggaacaacagacactggggcctacttgagggttgggggtgggagaagggtgaggatcaaaacactacttattgggtactatgcttatcacctggtgatgaaataatctgtacgacaaacccctgtatatctaacagacctgcacatgtatccctgaacctgaaagtttttttaaaagctgactttataaaaaaaggcaaaacaaattatcaaatgctgtagacataagataagcagatatattaacatgttttaggaaaacattttgaatgtttatacgattctattgattgtttattgcacttaacatttttgtattatgagataactttcacagaatatggttctattaagatgaaattttacttattatataggtgattgggagcactggaataagaaacttcagccttattattatccaactgacagtattccggaatattcatcaattttggttccaaatgttgacaatattagaacaaattttttgatagacaccattgcaaaacaacataaagtaagtttaatagatagttccttaaatgatcacaaaccatccatggccacgggaatatgcacccatattttcttccagcacttttatagtacacattttacatttaaatctgtaatacaactgggacttattttgatggtagatgcaattctaaaaagttattaaaaattagttgtattaatttatagaagactagcccatagaatcataagatatttgaaactaaataagttgtaacacatttcaacactattatcctatgattgcaggctgttttgctcacaggagagcagggaactgcaaaaactgtcatggttaaggcctatttgaaaaaatatgatcctgaagtacagctatccaaaagtctaaacttttcatctgccacagaaccaatgatgtttcaggtgaaatccatcatttgctgtaatattataaacataatacattttaaattagtggttacaataaaatgtgtacgcatataaaatgtgaaaatattatatattcaaaagaaatcatgctgcacttggcattcagctgtttagctttcctaaggctaaggttgaaggcaaatccaaatagcatactttgacctaatattgagactgcagctgaactttggagcatatctactgtaatgtaaatgaaggataaaactccaatgccttatttttaaaaatttaacaacatatattttaataattatatgtatacttattaaatgcgtaagtaaattatattctactctgacaagaatgctcattatttttagaagtatggattaaaatctaatgcataagacaaaacgtttccttctctctagagaacaattgaaagctacgtggataagcgaattggaagcacatatgggccaccaggagggagaaaaatgactgtatttattgatgatattaatatgcctgtgattaatgagtggggagatcaggtatggctgaaatatctcatatagatgatcctgaatttgtatttttatgtatatatattatatatatgtaaatgttaataactttgttaaaaactttatgtttttaagtctactgccaatcctcagtctttttctgacttctctgttatagctgagtttctcctttcttaaatccctatgtgtttttttgtttttgtttttttattaaactttaagttttagggtacatgtgcacaacatgcaggtttgttacatatgtatacatgtgccatgttggtgtgctgcacccattaactcgtcatttaacattttgagacggagtcttgctctctcacccaagctcgagtgcagtggcatgatctcagctcactgcaagctccacctcccgggctcaagcaattctcccttcctcagccacctgagtagctgggataacatgtgcccgccaccacgcctggctaatttttgtatttttagtagagacacggtttcaccatgttggccaggctggtcttgaactcctgacctcagatgatccgcccacctcggcctcccaaagtgctgggattacaggcatgagccatcacacctgtctcctacgtggttttctacagcaaatgcctcctctctctttggctacttgacttcagtgtcctttcttagctcctctcttctgcctttctgcagggttacatccttgctctaacctcttattgtgcataatttctgaggagtacgtgatgttcaaaaaaacaaaaacaaaaaatgaaaaaccaaacaactatttatttatttatttaactgtgccacacaccgtggttctagttgtggtcatctatccacccaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactcatcctgtggcgaaaaaccaaacagttctgtatggcctgcgtctgctccaaggcagatagacctcagcagttcctggaaggagaggagggtgaaggcatgtttagatcaggttcatgcttatcttccataagctgaagcgctcctgaattccgaactcacgtatccaactagggatgtctggttggatcgcaaacttaacacctccaacacctgctcctccaacagtcttctctctctcagcaaatagcacctccacagtcactctgtcagaaaatcaagttggctctatcttcacactgtatctgaaatttgaccactactcatcacctccactgctaccacctggcgccacccaccaccagctctcttcttgatcattacaaatgcctcctcactgcctcctgtctcccttacccttctcagcttgttctcacatcatcaacaaatgaaaacaagagttagatcacgacacactcttctggtcaacatcctccaaagagacttgtagaatataaataccaaaatccttaccatgatccaagactctacacattttgaccgcctctccctcttcccgtgactctttgcttccaccacatttactgatctttgtatacgctggatatggtgttcactcagtacctctgcatttgcagtttcctctgcctagagtgctcttcccctaggtatcgaactggcttactttctcaccttcttcaggtcttggcttatatatcatgtcaggtgaagcctcccctgctctccttgagtcacacccttgagcccctcctatattctacaaaagtcttagagtataccattttatttacatatcaacatgcatctgtacatcttgtctctcaccactagaatgtgtgcttcatgaggacagaaaattttgtctatgctacaagagaggctggcacacagtagtcattcatgaaatgttggttaattgaaagacggttatatttgaggtgcttgtgtgatatgcactaagagatgctcaatagagacttgaatatacaggtgtagagcttagaagagaatttgaagctagagttatagatatgagattctttagaatatagggttgagatagcatttcctggaacaatgagaagaggaaagagcccaggatggaaccctggagaacagttacatgtgagggatgagtggacaatgagtggcttaggaagtgatcccagagccctgagatggacctggaaaaaaaacaagcctctgaaaccaagagaggtaacatttccaaggaggggggttggcagtgttggaggatgcagagaagataagatgagaacataaaaccaacaaccaaaacagttagtaatataatattgaaaactcaggacagaaaccatcctacattctgatctaaaggtttttaagtgttgaatattgagtatgaaagatgtctacagtaaaacttgttgtaacttggagtattaatgtaatttaaccaaatatcttataactcacatatctaaatttatttggaaattagtttgatcaatgtggtgaaaggcaccttggacttggaccatgcatgtgttatgatctagagttcatgggtgacatcatttaagtcaaattaccttgaaggtgatcatcgacattcacaaacacttcattgataagagtttaatgttttcttctaatctcatttgtactattttattgaagttatggaggaatatgatagtgatatgttacaaaaatattgctgtgtgaaatttcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggtatgaatattcttagcgtttattttattgcattacataatggacataaaccacacaaaatttcatttaagagacaaaaaggctctgtctaaagtggggttaggtatgtgaaatggagagctaaacactaggaaagagggactaaatactaaggtgacctatgcttatagcctattctcagactcagagatatttaaaaataggcttgttgaaagttaacattagacgtaaaggaaccttggtgttttggttttcaggacatggttaatcagagaaatttgggccaataaatgatagcacaaagatcacagattaacgatatattatacaaagtcaaatgtagcacttcaatatgttaatgaaaatgagattcttgacatcaaatgtaacatcgaatcacataaattatgccatcaaaacttatgtgtaggtcagcccatgcctataatcttagcactttggaagaccaaggtgagagaattgctggaggccaggagatcaagagcagcctgggctcatagagagaccccatttctacaaaaaatttaaaacattagctgggcatggtggcacacgtctgtagtcctagctgcgtggaaggctgaggccagaggattgcttgagcctaggaggtcaaggctgcagtgagctatgatcacattgctgcattcgagcctgggtaacagagtaagaacctgtctaaaaaaccaaaaaacaaacccccaatccaccccaaaacctcttacatacacgagaaacagacccttgcatataagaacattaattatttgatatagcaagtactgtagtcagaagggaaagggcagacttttttttttttttttttttgagatggagtgtcactcttgtcacccaggctggagtgcagtggcgcgatctcagctcactgcaaccgctgactcctgggttcaagcgattctcctgcctcagcctcccaattagctgggattacaggcgcctgccaccacacccggctaatttttttgtatttttagtagagacggggtttcaccacattgacagggttggtctcgaactcctgacctcaggtgatctgcctgcctcgggctcccaaagtgctgggattacaggcatgagccaccgtgcccatccgggaaagggcagacttttaataagtagttctgggatacttagtaattcttataggaaaataattaaatttggacagctacctcatgccaatgacatgatcaactacagatgagataaggacctaaatatggaaggcaaggctgtaaaacatttggaagaaaatgtagagaaatagttgagtgacctctgagtaggaaaggatttcataaatgagactcagaaagcacaaaaataaagaaaaaaaataccaatttgactagattgaaatgtaaaatttctcttcattaaaaaataacattaagagagtgaaaagcctcaaagtggaagaaaaaattttaacacatataataacaacaaaaatgtcatattctgaatatttagagaaatcctataaatcagtcagtcaagaaaaggaaacaacctgatataaaaatgggcaaacaactaaggcactttaaaaagaggaagctaaatagccaataaacaaagtaaagatggtaaacatcatcagtattctggaaaatacaaatgagaaacaccaagcgataccatttcatacccactagatttgcaaaaataaaaaattctgacaaaaatcaagcattagtgagaatgtgaagcaactgagactctcattgcctgctggccgtagtgtcagttgctacaaaccctttggataacaattttgcatccctgctggtaaagtagggcgtgtgcccatccctagcagtaccacttctaggtttatgccaaattgtcatttttttcctttatggtttgggttttctgagtctcaagaagtccttttctatccggacatcatacaagtattcttttatgttttcttccagacattgtatagttttgccttccatatctggggcctcaatccatctgtagttgattttgcacatgcatgccagcagacttatacaaaaatgctcatagtgcagcgtacacaatggcaaaaacgtgaaataatccagatatttatcactagtaaaactggataaatacatcctgtcacaggcacacagtggcctgctgtgcagcagtgaaaatgaatgaatatagctacatgctttcaccatggatgaagcccagaaatacaatgctgaattgaaagaagcaaatcacaggaaaaatataattccattaaactgaatttcaaaaattttttttttttaccagttcagaagttcaaaaacctaagtggtgaagctataaagaaaagcaagttactgattatattaaagagaggtggcgacctctggagaagggaggaattgtgaacaaggatgaacgtacaagggcttctaatgtgctgggcaaggttgtagttttcaatctggtggtctgtacatgagcgtttgttatttgttaagctatttgacatactcttcagtatgactgacacatttaaacaaatacggaaaacaaaccaaccagaaactgagcctcagagaagtgagataactgcccaatcaaggccttttagctagtgcttggcagatgggtgttgctaatccctatctcatgcttcttataacatggttgtcccacaggaaggtggaaatctagaatataggatttcaggaagcaaacggactttacaggcacttagcacaaccaaccatgatttggaggaaaatttcatgtttccccagggcaattcttcaattagtgtgaacaaactccagtttctttagtctccactcttcatcaacctgttctgcatctctgagcagatattcatattcctctgagaataccatgctcagaactgaacacactctgcagtgtgtagtctcactggagtgaagcagagtaaatctttcttcggtctaaatcaaagacattctgagactttgagaacagtctctaaacctacaccccagtctttctgagagtcataatgatggtcagaccatcactttgctgggtgttccctaggaatgttgcatgtctagcccaggccagagtggtgactgactgtaggctggaaaaagtggtcctgattccagttctgccaataccagtccatgtgaccttgaacaatcggcttcacctgtctgggcctggtctccttctctgtaagatgagggagtactctctaagctcacatatgcttcagggtgaatgctgatgtacagactctagggccaggttgcttgggttcacatctcagatttgtctgcatgcaagctgtgtaactttgagcaagttactaagctcatgttaaaatgggactagtaataataatacctaccttgtatttttttcttgtagggtgctgggtgggggattaaatgagtcaatacatataaaacacttatcactgcgtactaagcttggctggatccactactgactcccagtcttagctgatcccttgagagaaattctgaacaacacccagcttagtcagccttgtaatgatttgtttactgggataaacatatacttggaaatcttttggtaagcttataccttcaatcttgcttatctttcaggaattattggatgtggatactttgatccttgtagaagtttcaagcctcaaatatgtgagatgattgtgaatttagtctcagtgggtagagtgctgtggcaatggactaaggtacagaatggtttgtcaataatttttaaaaaggcaactattattcagccctagatcacacctcgtggctcattaagttatcataatatcatatatagtggtgttttttggaaaagacaaattacgtgctcaaatagatttacaacaccttttccttccagggagcaaatgatctgactaaatgatgctttccgtatgtatgagatgttactgtaaaccagacatgacatccaagacaaagtagaattttgctgaaatgagaacactgcatttccacttgttactctgatttgtaaatctttatttgtattatctgtctccttctaccaaactatgtcagacactcagatgcttattgactgacttaatacatggatttccagatattctcagccaactaggacttgaagtctaacttgtgtatttctctgagcaggagcgtgagttagtaaatggatggaaatgttcttaacaaaaattggctagatttgcatacacaagtcagtgtcctaagtaaagctcagcaaacctgcagctgtccccagatgacttagggcagtactcatgaaaaggcaattaagtgtaggtatgagataaaaatgaggttgatatatttgacaaaaagccatgaaggagataaggattagttgtcgtaattcactacacatccattaggccaattatacacatgtgggcacgcacttgtctcctgggaaacctgagtgtgccagcctttcagattcctgggtagactgggggatttctagatacacaattattggaagaggaatttgggggtttcttatgagatgctcttccatgtggccaccttcagtgatgagtgtggggccctgttccttgccaacacagggcctttgcacatgccattgcacctcttttaaagaaactcagaaatgagttgcaaggactgagcgtctgagatagttttccgtggtaagatacatgtggtttccaataggattattgctcaatttactgtgcttatatacatagttctctgaaaagctttgcccttgcagctgtcttccatcagtttcttttggtatttggatgtttcctggctccatttcctcagtgtcttttctttacctctttaatccattctgcacaagctttcattcccactgttcatgtcaaggccaccaaagaccttgatcttgccacatctcaaggttaattttcctctccctcttacttgactttttagcagcatttgacctaaatgatcctttagcagcatttgacctaaatgatccctctaaatattttcttcacttggcttcagagggtccccatagtcttgattttcttcctagtgcactggctacctcattaaagtcccccttcttctttccctcctctaaacactgaaatgcacctggtctcgatgccaggccctcttctctatctacattctttccctaggtggcctcatcaagcttcaaggctctaaacatcatccctgtgctgatgacttcaaaatggatatctccatcccaggcctctctacctggctccaggccgattgctaactacttaatagacatcagtgtttgatgtctgatactcatctcaaagttaccatgtccaaacagaactcctaaatgtctttaaatacaatcctctctcagacttctgcatcttagtagcagcaccagttatcctgcttcttaggttaaaattactgggcaccatccttgatttatgtcttcctcatggcctacatcgagtccatcagtgaatctcagtgacctccccttcaaaatctaccccaaagctgaaccttcctcaccatccccccgtgaccaccctgataagtggtccgatcacctgtcccctggaccatgcagtaacttcctaaccaatctccttgctttcttcttgctctcttggagtctgttcttttcacagtcctagatgatattttttaaaaagtaaagcagaaatctttactccttcttaaaaccaccagtagactcccagttccacttacaatgtcagcagactccgcttacttcccttgcctgccaccaacctgctccagccgatggccctgctcaccattccttgagtaccccaggtttattgcgttgctgggccaccatacgttggctcattctcatcactcttaccttcagagcgactgttccaatcatcctctaaagtgactgcacttgtccctatcctagtcattatctgtctcctggccctggttttttttaaaccatggcttctatcattatttgcatatttacatatatatttgttccctgttcattctcaggctctccccactggaataaaagcccgcttgatggcagcagagttagctgtcctctgtttaccactgtgtcttcttaagaaccaaggaggtgctcagtcattgaaaaatgaatgaatcttcctcctctgcccacctctacataagcagccttctttgtatcttttcttcaaatctcccatcttcacaaagcactcttttgatccattcatgccttgtctatcagcccacctttgtattactttatatagctttaaggcagaagcagttcagaaaagaaagaaggtgatgaaaagtagagggaaatattagaagagaaggaaagaagcaggttaacaaataatgagaagaagaaggaaagaaaggaatttttttttacagaattctctttaatgactgcctcagttaccaatggctgccgtcatggctggagtgttatactataaaaaaagcaatattcacataaccttaccgctttgagtatttttacatacttgtaatataactatatgttttacattttagtgggtaggatgaacattttagtttgcaatggaactgagcaaagagggaagttgataggtgattgataaaatacacttcttttattttcatctccccatgctacttgctgttttaaatagcactgtgaattagcctgtaaaaattacaaactcaatagggtaatttttcagtatagaaagggcttaatttatgaacagatgctaaagaaagcatctgctttgctgaaataggcgtatggggtgtttgtatcaccagaattatcattattttcactttcaaaaatgatgctaatgatatcaattatgatctttatacatgaccatcaatgctttccatatctagagtacctcgaggttatctcttaacgggtatctctctgggtaagaatgtggtattgttacagctttgcctttttatatcctagaagttggtagaaatagtaaattagcatataatacagtctttgtgctcaaacagaaaaaacatctattactatacgtatagctgcatgtcagacttgcctgtccacttattatggatatacagatacatgaaagactgttgactgagtttggatccacacagtaaaatccaggttatgatatgcagatatatttatggaaatcctaacacattaaggaccctaatcaaagcaatttatagaagatagccattattaactttaaaggtgaacattcgttgttcttacctgcatgacaaccaactcacgttcagtttttgttatgacatatttccacatatactaccaataattagggatgattattcccacagttcatatagtccttaagaattcaggggaggtgacttgttcaaagccaactgatggtagtagaacaaggtgttggaatctgcatccagtgccttggtcttgaatccatcctatccaagagattatggtcttttaaatcctaagttggtttatttatgatttttttctgtccgtgttgtcacaaaatgtgaacttaatcttgatttatttactcagcagattttatctaaaataggatttgtgagacagttgtaaaagtaattctacttttagttgtatctgaaaactaactgagagtattacattttttcatctctaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacaggtgcgtgttgcggcactagagtttaaatgtatgacctgagaagtttatactacttggttaattttttttatttttatttttgagatggagttttgctcttgttgcccaggctggagtgcaatggtgcgatctcagctgaccacaacctctgcctcccgggttcaagtgattctccaacttcagcctcccccgtagctgggatcacaggcatgcaccaccatggccggctattttgttgttgttgttgtatttttagtagagatggggtttctccatgttgatcaggctggtcttgaactcctgacctcaggagatcctcctgtctcagtctcccaaagtgctgggattacaggcatgagccaccctgcccagccggttacttcttgcattacctactaggataagtagagtaaggagcattgtcatcatttgctgtggggcttgtgaagcattgatggcatctctcacctgcccactgtcttaaaaaaatgctctgccgatttattccagtatgacttcaacaatacatctttataaatcaccagatcatcagaggtgataacattcggaggcacattttcattgtatatattttctacaaattttgtgagctctttgtaggttttctgtggggaaatctggtttcatccctttaaagttaaacaatcccattaaagttaaattcagtcatcttttggagcctccattccctcatctataaatcatagatgataatgccagtttcacaaagttgtaaagtgtctaccatgtctcacacaagggtgatacttgtcaaatgttactcccctttgtcctctcttccctctgttatattgtcaatctgaaaaggtcctttgtgtactgaatccaccaacccagaaagaggacgctcgtccactaccgaccatcacttctgctctcctatcgcaagttttagggacctttgatctcacctaagtgattcatctgtgttttctataagtagtgctgttaatgttataactttcttggatggggttatgcccttcttatcaaaaggcagaacatattgtttccctgtcctgaattgagaaggtccagggtggggctgagaagaggcgaagggacatgttcagttagaaaagatgctttcatatttaacattcttactactacattttcctttcagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattggtatttattttcatctcttaaaagaggttttcagattgctcacctgactagatctttctctctgcaccagagtcctaccatggagttgctataattccagcactttgggaggctgaggtgggaggattgcttgagcctgggagtttgagaccagcctgagcaacataatgagaccctgtctctataaaaaataagaaaaattagtcgggtgtggtggcatgctgctgtactcccaattactcagcaggtggaggtgggaggattacttgagcccaggagtttgagactgcagtgagctgtgattgtgtcactgcactctagcctgggtgacagaatgagaccctgtctcaaaaaaacaaacaaacaaacaaacaaacaaacaaaaaaacaaaaaagagagagagagagttcagtaagatgaccaagcattatataaatgtgaaataactatcctctatacctataccaagggttggcaaattatagtttctgggccagatccagccagcccactgcctgtttttattagacttactagctaagaaggatatttatttgtttatttatttatttattttgagatggagtctctctctgtcaccccaggctggagcacagtggcacgatctcggctcactgcaacctccgcctcccagttcaagcaattctcctgcctcagcctcccgagtagctgggattacaggtgccccccaccatgcctggctaattttttgtatttttagtagagacgaggtttcaccgtgttggtcctgtgattacaggtgctcgctaccatgcctggctaattttttgtatttttagtagagatgaggttttatcatgttggtcaggctggttttgaacttctgacctcaagtgatccacccatctcggcctcccaaattctggagtgacaggcgtgagccaccatgcccggctgatttttcatttttaaatagttaccaaaaaataaaaataagcaaaagaataatattgtgtgacatgtaaaaataatatagaattcaaatttcattgttcataaataaggttttattgaaacacccattggtttaaatattggccatagctgcttttgcactacaatggcaggggtgagtagagactgaatgggccttaaagcctgaaatatttactatcttgccctttacagaaaaaatttaccaacacttgccaacaatcacaagacagaaaatataacataaaagtatttcatttaacagcaacaacaatattaacatgtaggaattaacatgataaaactttacttaaacagcaacatgtcattctttctaaattaatatataggtttaatgaaatttgaaacaagatttcaaagggacttttaaaaacagggttatataacaaagtaattctaaagttatatagagccgggcgaggtggtttatgcctgtaatacccgcgacttgggggagttgaggtaggaggagccatagagccaaggaagtcgaggctgcagtgagctatgattggaccactgcactccagtccgggtgacagagtaccttgactctaaaaaataaaaataaaaataaagtgtatgcagatcaaagaattagatggggaggaacaatttgcaaaacaaagaaagtgggtgtggatttatttcagaacaacaaagacttgtggatttaactccataaataatgtaaaacctttttatatttttgaaagctgcaaacaatattaaaaagtaagtaaaaaccaagaaaaatatttcctatattaatgtgttaattactatggataggagttggtagggaaaggtcagaaatgattttgcactagaaaccaactaatacagttaagtttcaggccttagaaaatggaaataactaaaagtagactaatacgtgagaaacctctggaaatccataacgtttaaaaaaagatatgtatattttaaaattacttttgagtgtctttacaattgctactttaatacatacttggatcttaaatattatttttttatctttctctccacccatagatgccatcctttgactttctggctgaaaaactccagttttaccagagacagttcaatgaaatcattagaggaacatctcttgatctggtgttttttaaagatgcaatgactcatcttattaaggtcctaactattgcctatttactgatataaatagatgatttaaaagcttcgtatatttcatagataaattttttgagagaataactatatactatcaggtaccgtatagaagactgtacataggttgggtcaattcactgtcccagaaaataaaggcttaataggaaaccctttatttgaatccatctacatggcagcaaatgtctttcaagggcaaatagatggttttctgttcagagcttttggcacactgagtcaacaagaaagtatggagaacctttagaaagtatggagaaccctgtgaaaaaatatacttccctcaaattatattttgatattatgggaattctgttgcccatggaggaaaagatgttgcttttaaaagtgtcaatgttatgattgacttacaggtgatgggacaggggtaaggttgatatataggactggtgagagaatagaagccagttagaggtaacacgaaaaaggggtgttttcacactaatctattcaacaagtaattattgaccattcaccgtggctagatcttgaggttctgagatcctattctgagtgcaaagccataagtgattaatatattttaaaatatactgatagaatttacacataccagggtgtcattattgatccaccatctgcaaaacttgtatttttttaaaaattatttttagtggtgatagtgaatttactgatccatctagactttctccctaattggtgacaataatataaaagacagctttttagcaatgtcttcaattggcctgcatgagatttgacccacaatttgagtcttatcttcactgaggaaatcaaccatagaaaagcaacacaacatgaaaggctgtctctccaagttggcttctagaaacatcctcctaccccactgtaaatagaattatggtacttaaaaaaatttgttggcagagatatgatagagttagtgttcattgttgagttaggtgtctacatgattcagtgtgtcaggctgatgaataataaaaaaacaattgtaaacatttcttatatcttctgcagattgggaagagcagctccactatccattgggtctaaaaataataaaattctacatgcgtgcacacgcatgaacacacacacagaatagttttaaaatagaagggagtaaatccagtttgttctgttcttcatgatgtaaacatagatggtcaaggaaagattcgagctgaacaaatcagtattaaactttaattttaaaaattctgtcatagaccattaacgaggaaaaagtctaatatcatctagaaacatatgatcaaaacttgggctcatttagtgcaagaaaatgtaaacattgcattcttttttcaaataagcacgttttaaatctcaaaacagatttcacgaataattcgaacgtcgtgtggaaatgcattgctggtgggtgttggtggttccggaaaacaaagtctttcaagattggcctcttttattgctggctatcaaatattccagataacattaaccaggtaggatgaaataaaacacaatatgtttttctatagttaatttctctatagttaaatgtttagaaaaaaaggaagcacaacagtttcctgtatttctttttaaggtaaactttaagtattatatatataaggatatttacgcaagtgtcacaaagtaaatacatctatgtagccagtctacagatgaagaaataaaacacttcttgtatcccagaagtgcctccatgttacgttgcagtcattaccctcccaagggtaaccatattcaaagggtaagcccattgattagttttgcccagttttgaattttgtatcaattgaactatacaggatttgctctttgcatcctatttctattactgcattgtttgtgagattcatccatgatgctacatgtagcaagaattgttcattctttttgctgcatgatcttcaacttaatcagatactaccacagtctatttatccattgtactcttgataaacatttggtttggggcaaatagagctactgtaaatattcttgtacatgtctgagtacacatctagagttaaaattgctggatgtaggttatctgtatatttagctttagttgatctgcttagtagttttccatgtggttgtaccaatttacacttccaccaacatgtcatgagagttgctccgcatccttgctcccacttggcattgtgtgtctttttcattttagcaaatctttttttttttttgaaatgtagtcttgctctgtcgcccaggctggagtgcaatggcatgatctctgctcactgcaaactccacctcccaggttcaagcgattctcttgcctcagctcacgagtagctgggatcacaggagtgtgccaccatgcccagccaatttttgtatttttagtagagacggggtttcaccatgttggccaggcttctcttgaactcctgacctcaagtgatcaacccgcgtcggcctcccaaaattataggcgtgagccaccgcgcctggccgattttagcaattctgtgtgtggagtggtagctcactgtgtttcagtttgcgtttcccagatggctaatgatgttgagcacctttttatctctcattggccatttggataggctcttttgtgaattataaaagccctttctccatttttttttcaatttgtttgcgattctttcttattgattgttaggaattctatatgtgttttggatataaagggtgtatattgcaaatacctttgctcagttattgatttgccttttcattctcttagcggatcttaattttaatgaaacattcatttttttctatttagtccttttttgtattatattttaaaatctttgtttaccctaagggcacatagatattttcctatgattttcttcacatttacacataaaatttactactttctcatttagtactataactgacctagaattcattttcttataatgtctgacataggagttgtgattattattttcaatattgatatccagttgatccagctccatttattaaaaaagtcatcttttccctgccacatcacagtgccattttttgtcttaagtcatctgatcatatatgtgactatatagtctcctccactggtttccttatctatctttgtatcattacctactatattaattgctgtagcttctttagtatatatatttaaatttaacatatgtatatttggtagtgtcagatctctaactttgttgttcttcaaaacgtcttgtccatttggccttttatttccgtataaaatttagatcactttgccaatttataaacaaacacacaaatcattctgctgccaaacaaaagaaaaataaaaattgaacaaaatacaatttatagaagtattttaaaaacataaaatatcaaataagtaggtattaatttaattttacttcaaaaaattaaattagttgtcagcatttaaaaatcgggaggtttcatgttttagaaaagcgtatttctgactttttgaaataattggaagatctggcaacctagggcctacactcccaggtggcagagctcagtagcagctgcctccttggatgggacatgcaatcctccaatccacaggccccaacagcactgcttcactcactggcattatctgtctgattcctgtaggcatctaaatttgggatcctgagataggtggtgttgcactgattgtagttaggaatgacggaggcttaaattaaggcaaatttattcactatattttcttaatttctgtattcttgataccctggcatctgagactctgctgactggggagagactgacccttctaggttagccaattcttagagattcaaacagctcctccaggagagtacctttcatatgcaaaccaaccaatccagagtccttactcccaaccaccacctctatctggtgggtgtgtggtggcatctcatggtggattagaatattcctctgccctaatcaccccagggccacataccagtcaacaagggaccactcctatgccccagaggctgctgaaattattcaaactagcaaatcctaattctgcttacctgccttgcctttctcatggaaaccacaataaagactcttgcccgtgttttcccatcactccttttgcctcctgattgactctggtgtttccccatgtcaccctacctagcatgtcaagcccccttctgtttctggggatccttgagtataaacatcttgcttcatgacagtcgttcctgtgtcattgtgtcttaccacacttgattacaacaaattctggatacattttataacagcagatgaagtgggaatagagaggaagactcagcagggacagtttaaagtatgcaggattgataggacttagtaactgacccaatattcaggaagaggaggaaagaacaggaaggctaggatgacactctaatttctctagtggtacagttgtgtgccccataaggacattttggtcaacaacagacaacatatatgatggtggtcacatgagattataatggagctgccctatacacgagtagcattttaaaaatcttttatactgtatttttactgtaccttttctatggttaggtagatacacaaatatggaccattgcattagaattgcctatggtattcattcagtgcagtaacatgttgttcaggtttgtagcttaggagcaataggccattccatatagcctaggtatgtgtaggcatactctacgctgttctgtattagtcagtttttgcattgctatgaatacctgaggctgtgtaatttatttaaaaacaggtttgttttggctcaaggttctgcaggctgtacaggaagtgtgatgctggcacctgcttctggtgagggtctcaggaagctttcaatcatggcaggaggcaaaggggcagcaggtggtcatattgtgagagctggagtgagagagtgagggtgcaggtcccagactcctttaaacaaccagatcttatatgaactcagagttagaactcactcattaccaaggggatagtgctaagccattcatgagggatctgcctccatgacccagacacctcccaccaagccccgcctccaacattggtggttacatttcaacacgagatttggaggggacaaacatccaaactatattatgctcccacagttacaatgttttctttttctttctttcttccttttttttttttttttttgagaaggagtctcactctgtcacacaggctggagtgcagtggtgcaatctctgctcactgcaacctccacctcccgggttcaagcagttatctgcctcagcctcccgagtagctgggattacaggcgagcaccaccacgcctggctcatttttgtatttttagtagaggcagggtttcaccatgctggccaggctggtcttgaactcctgaccttgtgatccacctgcctcagcctcccaaagtgctgggattacaagcatgagccaccgcgcccagccacagtgacaatattttctaaggatgcatttatcaaaatgtaaccccattgttaagcaatgcatgactgtacttaccacactgcattaaaaaaaagtgcttgttcacatacatttctatctccttcactaagctgtaagctccctgagaatgggccactgtaatctttgtcttttttacttttattattaaatgcttacttttaaccaattctgtaaaaggatgtgttgaataaataaaaaaatgaccagctttgaagggtaaagtgagaatttagttcagtacatttgagtctgaggtgtctgcagaacacagtgtccatagataataagactcatggatgtggagttcaggagaggggttctggttctggagatagcaatatagaagtctcagtagagaggaaccttttgtggtcatggggagtacgaatagggtgcgtcatggaaagaaaagatggctgtggaaagaattctggggtctcccaacatagagaaagggggcttgcgatggagagtgagaagaagaggcaagacagagaggaggaaatccagagtggtttccagaaactaagcaggtagataattaatctgaaaatgctggccgggcgccctggctcacgcctgtaatcccagcactttgggaggccgaggtgggcggatcacctgaggtgaggagttcgagactggctggccaacatggtgaaaccccatctgtactaaaaatacaaaaaaattagctgggcatagtgacaggcgcctgtaatcccagctactcaagaggctgaggcaggagaatcgcttgtaccctgatggtggaggttgcagtgagccgagatcatgccattgcactccagcctgggcaagaagagtgaaactccgtctcaaaaaaaaaaaaaaaaaaaagaaagaatctgaaaatgttaagacatgaaaagtggcaactgatatgcatgacgacactttcagtgaagtggatgggtgcacaagccacattgcattaggaagagaagaagcacagagaatacttttggaaaacttgaaagaaagaaacaagagaggtcaggatctggacaaggggtgtgttgtgactgtctctatgtattgcaaaagcaatacatcacagtcagtctaattctttaaaaaatcagccaaattgacctctttggctgattagttcagagactggccagtcagtgagaggattactctgacagcatcaggccactagatctttctggttccagggctcatagtctttctgtgagaccccatggcctactgcccattacttgcattgtaacacctccttccagtgaggattaccttttagtccttgtcattagcttacccatgaggatttacatacaacatttcagataatgtctgctttatttttacacatctcatcacctctggtagcacatacatttaaccggaaacagagtgaaccaaaaaacaaagaccaagatcttttcattccataatttgtagccatctaacatttctattatttataccttattgcacaatgcatctttttctgtgggttttctttgtatctagccacttaatgagctgtgcaaattgccactatatacaatttatgactaattttattcataacgtattttgaatttttcaccaaatcaaactcatccaaatttcagatgagttttagatattatatatatatttactcggacaaaatctgttgctgaggactgtcagattgcagggactaaaagttcatttctctattcccacttatgctttgtggatcacttttggtaagttccctgtttctcagttctcagcttaaacgaaatatttgttttgaatggtaacatatcactctttagctctaatctctgtgttttctagcaggcaccattacttagtatctattggagcaggtacagattatgctctaataatcacaggctattattatgttttgggataaattatgactatggttttttttgttgttgttgtttgtttgtttatttgttttaagaaggagtctcactctgtcgcccaggctggagtgcagtggcatgatctcggctcactgcaacctctgcctcccgggttcaagcgattctcctgcctcagcctcccaagtagctgggattataggcacacaccacacacttggcttttttttttgtatttttttagtagagatggggtttcaccatgttggtcaggatggtctcgatctcctgacctcgtgatccacccgccttggcctcccaaagtgctgggattacaggtgtgagccaccgcgcccagccgactatatattttttaatctaaaactttctatcatttttcttcttaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggaggtaagtctcaaaagtagagaaaaagcccatattgtaaaaatataaattatattggaatagaaaaagcagcaacctttcaaaaatgaggctatttagtacattttttattttagacatggttaatgtacgagatttagcagattttctgaagttcctgtgaaatgaatgctgcccatctccagatgctttgtttaattttgaacatggttccttacttgtctcttcagtcttcactttggtcttataatttattttaggagaagcaaagtatctgtccatctatctgcatactagtgaggagtatagaatggttgaaagagttctgttagttgtaaatggatgtctgtactgccacttctgaaaccgcttgtatcagcacttccgtgagcactcacatctttagtacttcatcagaaagactcaccagactcagcatatacaggtcgagcttctcaaatccaaaactctggaatccaaaatgctccaaaatctgaaactttttgagcacggacatgatgctcaaaggacatgctcattattggagcattttagatttcagattttttgatttgggggtgctcaaccagtaagtgaaatgcaaacattccaaaatctgaaaaaaatctgaaatctgaaacattgtggtcccaagcattttgaataagggatgttcaacttatagttatactcatggctgagatttattgtggcaacacagtaaggatacagagccagatcagtagagaaaaagactcatcttgtggagtcatcgatgttccaggaacatggaattgatgttccagcttcctatgcttttgccaaggggccatgcagaacgtcctctccatccagtatgaagggcagtaacatatgcactgtttccattcagggaagcccacttgagattcagagtccagtggtttttttttaggtttggtcacttcctgcctagctacaactaccaaagttccagattcctagaaggaaagcagatagatgtttgccatgtatcacaaggtttgtgtaaacagtctagttggcactgcaaaacaaccttatcaattactaatggaggagacattccaaaagccaagttccctgataacagacaagggtcagctctgcaagcatacccttttcaagattaggcctgctgtgttaactcttccctacaccatggtatacagatgcttaatggtgcaaaaattagttaagtattttggagccagagttgattagactgactctgagtcaaagtacagagggcacccctggacattttaaagagatgattgagtggtggtggagatagctttttggtgatagctattggagcacaggagaacacaattagttcttgattgagctgctcaataaaaagttgcagtcttgatcatctctggcaaatcagggatttgactgtggagatgctgaaagaaaatatgaaacaagatgacatgcaaattaaaaaagggactggactttggcagtgaattgactgtggagaactcttaaaacacagaacacttccttgtccattccttaaagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagtaagtttttatttttatttatatctacgtagaaagagttccttatttaaaggtgcttagtttgccttctctgattagaaaatgatcttagaaattaatatttttacattgaattaaaattaacacttttgtaccacacaatctccattgaccaaattctcatttccagtgtaatttaaaatattcatattattaaaaaatactgcataacctgcaattttcattaattacctagagacatgggttgtttgaattgtaagggacttggtgatgtaacctcgtccagctccacctcccatgtagacatattagctttactataatgtctctgatgtaggtttgaaaatctctatctcattgtgcttcccaatatagtagccattaggcatatatggctacttaagttttgattaattagcctcatttctacttactatttggtttatttttggtacagggtcttgctctgttgcctaggctgaagtgcagtggcatgatcatggctcactgcagcatcaacctcccaggctcaagccatcctctcaccttagactcccaagtagctgagactacaagcatgtgccaccatgcccagttaatttttgtattttttgtagagacaaggttttgccatgttgtccaggctggtctggaactcctgaactcaagcgattcacctgcctgggcctcgcaaagtgctgggattacaggcatgagctaccgtgcctggcttagctccattcctggtgcttagtagtcatgtgtggctaatagctaccacactggaaagcatatatataaagcatttttattatcacttaaagttctattgacagctctgctctagggagtctcactaatttataaggcagcctgcttcattcttggatagtctaattgccaaaaagctcttatttataatcaatagaattttgtctctgtacttttctgattctaactctgccctatacaaggaactcaatccctcttccgtgtaaagtttttcagatatttggagaaggtttttgcaaggctgtctaagttgattcctttttagaccaaacaactgttcctgcagctgttctcacttgtcccagtgtccaggccttttgctgtcctggccctctctctaaaagagtactagtttatcagtttcctcttaaaagaaagttcctagaattgaacgcaataatgtagatgtagtcccaggacagggaagagtgtggagtatatttcctcccttcatcacaacattaaatttatatatgactgcagcccaagaagattcattttcaaatctgtgatgtcacactcttgggtcagattgcgtaaatctctctctggctgacttataacccctctgtgtttctaatgtttgttgactttgctatcaataggttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaaggtaagtgatattacataagcaccatcgctatggaaccacagcatgtattcccaagaggaatgcattgtaacatccagcagaagactctttctattcattgagcacgagctgtatttttagatctttcttgctttgattttctagtgactatgtatgaagagatggcaagtaaacaagatttaaaaacgaactagtgtccacacttaaatacctttttatcctccaagcctcagagtaacagatgcttaatgaattactttatttcatctgcttaattttgttttgaaaatgacttaactaattcatcaccaactgtttaaaattagtttcttattcaaatgtattatttattttgattaaagtacactgcttctaatgtttctttattgccttatgttaaaggagtatttagaatttgtatttgcattacttagtcttaccaatgtttctatgccagacaactatgaaacaaaatatcaattgactatgggaaaaccactcactaaaagcagcaatggcatgttcattatgtgaaagctggtgtcaaccatgcaaaaacacagcttttttccccaaagcatgacagtcactgtgtaagattgacaaatgggccaacgtggatccccagaaaagctatgcctgtttttctgcatagagagtttgcgtaacactttcattgattttcagtgaggttcctacttcacaaaagtttatttattccataccttttcctttacttaaaaccattcccagaccacccttttagataagatctcccaaattctcttggtgaatcagtgtatactaattcttactgttaagaagattttctttctatttgaacgcctgctaatgtcatccatggagataaatttttacctttgtgcagctacaaaaatctgtttctttactttgaaaatttgggtatatttttcaaaattttttatatgttcttaggttgttgaagtttattctgaatgtaatatttttacaacactttaatgatagtcacatatatgcccaagatcttaaaaaaaactcaaaagcattaaaaatcttcaaaactacaaaagtttaaattaatataaaaggttaaataattttatagtacgtgaagaactcttttttcacttgagcttcttctgtataaaattatgccttttgtaataaagccacaataaagtggacatttgaatcgagtgtggttgccttgatttcaaggccaatccagtgaacttgggagacattggtttttgcttctgtaaacccacccagctggtatccagcagtgaagaggttgtaacaaatatcacttgaatgaaaatggatcacagcacaaattcatttcaaccacttatccctaatatttgtccagaaccttaaagttttgcactgttgacaccagctttcacatagattcatatatgcgattttatttgatcttcacaaaattctgggaggggtagagcagatattcttttctctattttccagatgaggaaacagagttggagttaagggtgaagtcaaagacccctcagggttgaaacatcagacagatttagtcctttttccacctcacctctgagaaaccttgctcaagtcctgtcttcctgctagtgaatcactctacatgatcacactgatttcaccttgggaaaggtgtcgttttatgggagtacgcacaatgattgaaatggtccttttaatgttctgctttcagataccgccgaagagcacatgtgactcccaaatcttacctctcatttataaatggttataaaaacatttatgctgaaaaggtgaagttcattaatgaacaggctgaacgtatgaatattggtaagaggaatggaatggaatgggatggaatagaaatagggtttatttgatagggatctcaatattttgtttggtggacattttgtctgaaaatgaaatactcactttgttagtagtagataattttaaaggatggccttgagggtattttgacctgtcgagaaactctgaacagaagaaaatctaaacagaagtggcctattttctctgcagaaccatttctcctggctctttcaactctgggtcccctgtgctgagtcactgagccattgctggcagatggggacaagccagcttttgggaatggacaacaatttcagtttttggtttcattttgatttgccttgatttgtataaactttgccatgttaattttccctacatttctaataaagaaaaaggcaaaatagaagcaaaaacaaataaaaacaaaaagagattgtgtacctaagcaagagttttccaagtgtctgctatatgtagtataactagcaaaagtaaacattggaagagattatatgtccagaaagcatgtggcccaaacaatctaaaacaccttagttcttatttttcaagttctaaataaaacttgaggggctgagtatggtggctgatgcctgtaattccacactttgagaggccaacgcaagcggatcacttgagcccaggagttcaagagcagcctgggcaacatggtgaaaccctgtctctacaaaaatataaaaattagtcaggcattgtggtggtgcatgcctgtagaccaagctacttgggaggctgaggtgggaggatcacttgagccctggaggtcaaggctgcagtgaactgagattgcaccactacactccagcctaggtgacagagtgggaccctgtctcaagaaaaaatcaaaacaaaaaccacttggtcacatagcataacagcgccaaggtctgtgaagtcatagttatgagagaagactgtgaaagaaggcttcttctgcggttttctcatgattcagcttcttgcagctttcctatatgatgctttagatcagtagtgtgctgaagccaactcatagtggcttttgagaacacaatgttaaatttttaggaattttgtgatctccttgttaaacagaacttttattaaaaattaactcatgtatacttacaattaaacaaattggatttaaaataaaggcaataaatgctcaaactcatcccttcttagttttactctttttttttttctttttctttgagacagagttttgctctgttgcccaggttggagtgcaatggcgtgatctctgttcactgcaacctctgcctcccaggttcaaggaattctcctgcctcagcctcccaagtaactgggattacaggcatgcgccaccatgcccagcttgttttgtatttttagtagagacagggttttgccatgttggccaggctggtttcgaactgacctcaggtgatccacccgccttggcctcccaaagttctgggattacaggggtgagccaccgtacccggcctactctattttcttatatcaatgttcttgaggttatttacttctgtctgtatggtaggaatattacataacagtgtggtactgagaatcttttggtagcctgaaatcagccatggtgggagtgtttacactacagaaattggacaatatacagatgagggcttccccttttcccagtgacccagatttaaatatttaccaacatcccactacctagaacccgttggaatgtgagcaattcagttaaccagttctttttctctacggtgctaaaagttgcaaagtccattacataagttttcacagttattttcatttttataacaaagagaaccacaaaaatgttaatatattttctatttcatttgccacctcagctgcaatatgattcaaaggcaaaaaatgatagctacaaactgtttacaaagccacagagagcataaatttgtcaaataagtttcttggccaaactaatcttattcaataggacattgtgactttcccttaaatgtagctacgtgatattcttcggtcagagctattttctttgccttcctgttgaaactcagaaatatggtcaatattgttgcttttaagacatgtatatttttaaagcttttgtctacaattttgtgtttgttatattacatgtacagtgcctaataaatagtaaacattgaataaatatttgatgaaggcatatacctgtactcagtaaaggtatatatgtgtgtatttgtaaaggtcttgataaactaatggaggcaagtgaatctgttgctaaactctctcaggatcttgcagtcaaggagaaggagttggcagtggcttccataaaagcagacgaagtgagtttgcatttattttatcactgatgaggaatatttttccatattaaaatgcattgttttaaaatggtactaaagaacaagcagggtataaacccatggacaattcctgataagatagtgttcacaaagaccattagacatttttgtttaacttataccagcgtatacctgaactattaattttgctacttggcctaagactattatttcttctctcactctgtctgtctctcttgttctttttcatctgtttatgaaatttctgcttgactatgagttatatttggtcttctgtttaaggtccctgtatgttccaggtttctgggatggcccaaatcgaggaagagttggtagagtttttttttttaaaagaaagaaagaggaaaaatccatactcctctcaaggagataggtatatatgtgtgctgctttttctcttttttttttttttttttttttttttgagacagagtcttgctctgttgcccaggctggagtgcagtggcgtgatctcggctcactgcaacctccacctcctgggttcaagcgattctcctgcctaatttttgtatttttagtagagacggggtttcaccatgttggccaggatggtctcaatctcttgactttgtgatccgcctgcctcggcctcccaaagtgctgggattacaggcatgagccatggtgcccggcctatgtgctgcttttttatctattatacagccttctagtctcagactttcagcttccagtcaccaagagtcagttaagaatagatacttcagtcttgatccttagccagttgctgaaatgagtgaactaacataggggaggcacttaagcatagtcctggcatatatggtaagcactcaataaacattagcttcttttattgttattatacaaggcttaaaatggttttttgcccttattctatgatacttacttgaattgttttaattttctagaaatttgtagagtgaaaatactatttcttctgaaagctttaaatatttatttatatatatattctaagcctaagaaaagcttagaaaatggaagactgcgaggaactgctcaaaggaatttactttaatataccttaaaatatagacaacttaggaaataagtttgttcttattcgtgttttatattatgttgaataaatatttgctcactattcagatctataaattttgcttgaaaggtttctattggctttcatgtgtttcctcaacttaacaggtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatgtgagcagtgcattgttaccccttccaacacaagtcctagaaggcttcatgtttcattacatgaaattaactcatcagaaaactgaattgaattcttaatgtgattgataatctctgagtctggaaacaaatgtgtcaattaattcagttttctaagttctaatttttttaaagtcttcccctcttatattattttcatcccacaaattggtcttccatgagaactgagaaataatgctagtggttagtggcctaaactgtgagaaattcagattacgcagagagcctgctcagtttctccagcatcccttccagattatgtcatgctcccttttaaaatcttcctgtggttcccactgctcttaggataaagtcctgagctagacatccacagctgtgaggcaaaaggggcacagctttggaggcaggcagacctgcattcaacctctatatataatacacacacacacacacatacacacacacacacatacatacacatatatgtgcatgtatatatatgtggatatatacacacatatatacacacgtgtatatacttacacactgctaatacacacacatataagtatgtatgtacatatagatgatctggagtaaatttgcttaactttcttgggtttctatggggattataatttctcattgatccttaaagaatcaatgtgagcattaaaattaattaatacaaaatgctaggcacatagaaagcactcaataaatattagtgcttctgttcctgctgatgacctggctcctgtctgtctcttcaactttatctcttgtcattttgtccctacacacaatgcgatccagtcatacagaaaaatgtataggattctggaagaatggtcaggatctgttacctttaaacgtgcctccacctctgctgggaatgcttttcctaactttcattgcctaattagagtcattctttaaatctgggcccagacctcactcctcccaggaagttttcagttcttcttcgaggccttcctttgttttcctatcactcacatgcttctgtcatggcagaaatccttatgtagggtaattgtatttgctttgccattttcagaggttatgaggacaagactattttggtttgctttgttttatatgggagaatgcctgcaattgttaaatgaatgaataaatctatgataatcatttaataaaattttcacaatgaccaggacacattctgcacccccacttcctttatgggtcttactgtaacgtacaaaaggaagagatcaccgaaccgaaggagtcttagaacatgttattgatcatatggtctcccagtccttgccttgatggtcaggcaatgtcttaatccaaacccagccaatggatagaaattttcaaaaatgtttttatgagccatatattacagtaattttcttgtctccttctaattcctctccctgccatagacagggaagccctcacaatgaaggctaaaggtgaggtttctgatattcagggctttgtatcctctcttaatatccacacctaatatagaccctgtgctttgaagatgcaagttatctaaatgttacatatcagtgggacttattaacagaggtctatgatggcaatgcctgttagtgatattttaaaccaattcgttgggagcaacagggaaaagaagaatacatacaaataaacacaaataccaaaataacaatgaaagagccactaagcaaaaatcttggaaatggagagaaaatatgttttaaagttttctatcttaattattgaaaagtattagatttccatataactattaataccactcaacaaacaaaatattgatccttaatcccaaatatagactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaaggtaagtaaaatctatcattgtcaatcctatgagctgcatcaggcgtcctcagcccaggacactcaatatagaccagacaaactggcagacaataattgatcattgcgtattgaaaagtttatcttaaactccatcacctaaaatgtaaagagggatagattttaaagccaaataccttctttttatgacatctgtccagaaccggtggctagtattggcacagccttggtgtcaacccagcccagttttcaaaaaggggcttgtgtggttggtggcattcagatgcacttaccagaaagaaaacttacatagcttttcttctttactctttccacatggaatccagaagacaatttgtgatttacagatttaggttggctactgccaatagtctcaatttgtgtatttagagcaaatcatctattacttctttgagaaaattcaatttagaagtacatattaactcaggaagaaagtattttcttccagaacttacaggttataatactatttttcagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggtaaaagtttccttccttctcccagtaaatcaatatttcataaaatcagtcatcagtattactgctattaaaagacaatgcgtagtttagaccaataaaggtagatgtccctgttaccaaatttgtcttttttctctatgtcctctcaaagtttctccttctttttatatctgttacatgtttcttgacaatgcaggcaagtgactgaaaccaacatgttaacttacacaggaaatgaatttcttgggaataataatcaagctgtcataagaagaaaaacttgccatttctttgaagtttggagattaggtttggaggttgaatttgattactgtatttcaaacaaaacttataaaattaggtttgacacctagaaaggttttaaatttcaaagacagaaggagaaccttaaatgcaatctaagaagcaatcagacaaaacctaaaaggttgtttacaaaagacaaatcaagatgttgcagatttcccacaaccctaaatactagaagataatgaaaaaacatatgcagagttttgaggaggaaaatgctggggtccaagcactccataatggccaaagctggtcttcatggatgagggaacagaatgagattcttaggagggcaaggattcatgaaatgtatcactcagatacacactgcctccagggccccatcccaatctcccaccccaacaaagctaaaagtattataagtggttgctctgtggaatggataatgaggagtcggtgggcagggggttactgtttttcataagccttagagaagtggctgcctcctttaaaacctgtgcatgaggaactttgagaaaaatagaaagtcaatttaaaataaaaagttttaacaaagagaaatgataggaaaaatacaaaaaacacaccccaacaaaaagatactaagggagaaatcttacaataaatgtagaattcaagaaaaaaaagaaaacacacacacacatcagaaaagaactattctttgttgataaaaattatgatccatagtgaagacaattaaaataatgtgttatgcaataaataaaatagcataaaattgtataaaccaaatccattagtattttcagtggaaattaacaaacataatactgtaatttgagattgtgatacatgctatgaaattaacaaaaataatattgtaatttgagattgtggctacccctggtaggcatagggccagcttcttgggtgtgcacacagggccttgtgttaatgctctgctgttgccctcttcagattcttaatatttttttttaacaaggggccccacatttttcattttgcactgggccctgtaaattagagaggcagtcccgagtaggcataaattagtaattatatagaaattttacatgatactatttttcaggttgaataactacattgaactttcttcagtataaacaaagaacatgaaattatttctagagtacaagaaacatttataagaattaattatattcaatggtaaaagaggaccttgattaaattcccgaaagcaaaaaatcctggggtctcattctctgagtataagcaataatactggaaactttacattaaaatgaactcagtcattcctaattaggaaatgatgaaaataagcgagttaccaaagcttctgtgatatggccaaaatggtacattcttagcccttacatacatcaaagaaactaaacattccactgaagagttaaagtatatactcactcataagcatacatacacatgaaatttaaggaaatcggaatagagccaataaaaataacattaaaaattagagaaaagcagcagaattaatgagcaaatctaagaacctatgctttgcaaaaacaaaactgtaagaaatattcctggaaaatctaatcaagaagaaaatgaaaacaaatgaaaatagaaagataaatcctcataattctagatgtgaagatttaaataattataaagtaattgttttttaagagacagggtttcattctggcccccaggctggagtgcagtggtgcaatcatagcttactgcagccttgaattcctgggcttaagcagttctcctacctcagcctcccaaactgctcccaggattataggtgtgagccactgtgccaggctgcaaatattacctagttatatgttaatatattagaaaatctaaatgaaataaaagttttatgggaaaaggagctaaattcaaataaacattgagaatgaaaataagaaagggatcaaagaacttctaccccagaaggctttgggcctagattattttactgattattttaaatttacaggaagcagatcattaccacattgtaggacttagaaaaatatgaaaaactactgttacagtaatttcacttgcagaatctttgaaattggattgttaccaaagtaacaatcctaaatgtgtacatatccaatagtatttatcacaacattatttgtaataactaaaaatgggtgggtggacaaatgtatatgagtaggaaaaaggttaattatgatacatccaacacgtagaatatcatgcagtcacataactaacgttcatgatggacttgggaccttcataaaatgaaatgaaatgaaaaaaaatcaaaatgccaattacctacttcctaacacaatactcacaggttatgtctgagaaatttcggggtaacttttgtcctcctttctatacattgctgcattttccatgttttcttattgaacattaataattaaaaaaatttttttgagacagggtctcactctgtcgcccaggctggagtacagtgttgcgatcacagctcactgcagcctcgacctccggggcccaagtgatcctcctgcttcagcctccagagtagcttggactacaggtgcatgccaccatacctagctaatttttctatttttctgtagaaacaagatctcactattttgcccaggctggtcttgaactgggctcaagtgatcctcagcctctcaaagttctgggattacaggcatgagccaccacacctggccagtaattaaaaatttaaaagtaatgaaataccctccaagacgctttgctttcccagctgaagacacggaaacagatgtgctcgaaagtcccgtctagtgcagaaattatgtgatttgtgttatctaccagttacaatcatgactgtttcatgcagctaatacactaaccacgtcttcttcttttcaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggtgagattaaacataaaaaatccccaaaatggtgtactgaaactttacacaagagcatgctatatttggaaatcaggcaaatggttgtgatgaaaaaatattggccagcatgcctatctgctttggatctttggtgctcaaaattattttttgtgttttcactgatcaaactttaccgtcactgatttgagggttagaaaactgggtttgagatgcagctcagacacttgttaattgtgtggtttggggctttcacgcgcgtccatgtgaagagaccaccaaacaggctttgtgtgagcaacaaggctgtttatttcacctgggtgcaggcgagctgagtccgaaaagagtcagcgaagggagacaggggtggggccgttttataggatttaggtaggtaaaggaaaattacagtcaaagggagttgttctctggcgggcaggggtgggggtcacaaggtgctcagtgggggagcttttgagctaggatgagccaggaaaaggaatttcacaaggtaatgtcatcagttaaggcaggaacaggccattttcacttcttttgtggtggaatgtcatcagttaaggcaggaaccggccatctggatgtgtacatgcaggtcacaggggatatgatggcttagctttggctcagagacctgacaggggcaatctacctagctctgtttgtaaaatggggatcctaatataacctcttgggataggttgtaagcagtggtggtctggtaaatgttaacaatctagtgtgcagtgtggggagaggaaagtccggatttgtaatatttgctgatttctgtggtgtaaatactcccatcactggcaattttaaactccaatgtaacgtcactgagcacagatttgggaaaaggtgcatggcagtaccccatcgcatactatttccaccatccagatacaacggtcttaacctcaaaaccatagataatattaacatttaaataattaggaagtaagcttttgttatttattacttttgcttttaatataattttttaattgtaagcttacatagtttaatttttaataaaggctgtgtttagcaccagctcacaaatactctaaaaatttaacaattggctcttaagagttgatacaagccggctgctacatgctattgttgtctgggatttttccaggagaaaatactttgtaaatgacaaagaactcgggattattactgcatccaagacatcaaaatggcaaatcttattgatttgattctgttttgaaaatattcaatagaaatactattgtaatttgtctgattaaaagataaattatgtgatttggattctgtcttacaaaattgctttccttgaaattttataaggtaaaatcactatattatgaatgatcaaaatttaatatgtgaagtttcaatgcacactgtatttttaggttatattattttgcaaagtaagaaattcccccatgtatttttatgtgtgaatataatggatgtttgtgttaagcacttagaaaagttttttgagacattctcccattatggctgcaggatttgcttaatgacgctgatacgtgccggaaaaagatgcaggccgcctccactctcatcgatgggctgagtggagaaaaaatccggtggacccagcaaagtaaagaattcaaagctcagattaataggtgggaatctgggtcttcttcataatcactctttctttgtgacattagagaacataaagtccatttccatgtgttcatctctgaatcccatcatctatgacagtgcttgcaacttaaatcatgcactctcaggtgaaatactatagagggtgaagaagattttgtgaaatattttacatctcagctgtggttcagcactgtgggttttcagtatgagagtgcttttgatattgtttggatttgccagagccgtctccactccagttctctatgcttcacctcaatgattttgaaagtgtggatcaatggtttgttgtggatcaatggtttgttgtaaatgcaaggctgtcttctgctggtgtctgttggtgtccttagaaaacttaaaagagaggggaatgagagaggagcaagaaaatggcaaaaaaataaaaataaaaataaaaaaataaaaaaataaaaagggaggggaaagaaaaaatggtttaacacaagactgaaatctgaataagagcaagggacaggatgggggaagatactttcctcacagtatcaaggctcacgacctgtaggcttcaggaggaagccttctttcttgcttcctgaccaccccacatgtggccactcctacccacttttgggtttggggctccactttgcacggtctttttccatgcctggctaccaagcattaagcaggggcaaagaaggatttcacccagtaacagagcaaaactgtgacctctcaaacaacttaatgtcaggtgactcactttggggagggggctgtgtgttttcttcacagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactgtaagttttactttcccaatgttatttgaatttcagtctcattttatttcttacttactgagaaacccggctgggtgtggtggctcacatctgtaatcccagcactttgggaggctgaggagggcagatcatgaggtcaggagttcaagaccagcctaaccaacatggtgaaatccccatctctactaaaaatacaaaagttagccgggcatgatggtgcatgcctgtaatcctagctactcaggaggctgaggcaggagaatcgcttcaaccagggaggcaatggttccgagatcacgccactccactccagactgggcaacaagagagaaactccatcccccccccaaaaaaaagaaacccaggttcattgaattttttctttaactgggaagattgttttgaaagtgcttaagagtttttttaaaaataattttctttatggtataaatgtttctttgcgttttaagtaatcttgcttccaaattaagaccaattgcattgctatgaactgaaagatcatttgagagatatcagcttgctaatactgggcccttcttataactcttcattatttacaccactcctgtgaagtcatactctctttcaaacattttaggcaaatgtaggcatgatctgtgctggtattaaccttattttcattatttgctatcttttttagtgtctaaaaacgtaacagaatagcatgttctggtgaccctaagtaatagcaagtcctttcatactaaccttccttgctgggaattcgatgccactgtcaatttccggtatatcttgcagagcttctgttgtaataaatgctttccaggcaatttgtattcatgagttgcttttctggtttgcaaatctgctctccagttgctgtttccttaggggatgccaagctattaatttcatattatctgtatttaaaagttaaaaactaatcttttccaattcgaacattgttgaattcacccttacagggaatagattatgtcttggagatgcactgggcactggtgaagcaaagtgggccagaatattctttattaattatggcctttgggggtcctgggataatttaacaaaggtggaggctggttggctcattggatctctgattattttattttattttattttattttattttattttattttattttattttattttattttttttagagacaaagtcttgctctgtagcccagacggaagtgcagtgctgtgatcatggctcacagcagcctcaaattcctgggctcaagtgaccctcccagactcccaaaatgctgggattataggcatgaaccactgcgcctggcccggtgattttattgatcacatggtgggaggctggcaatcccctctaaatttggagaaggaaatattcacaaaagtgtcattgatgagctccggccaatataataactcatctaatttatctccagctatgcaatcacccatacaccatgtgggcagaaccaaagggccggaaggggaagctatcaggggctaattgcctgggacttaccttgttctctgacatttcattatattcactatctccattaaccccaaatcaggtttaatatgcaatcaacttgctatgattcccctaagtatgaaaatacaatgcaaaaggataaaccttgtcttgggtaattaaagaagggattcattagataataaatttgtttttttttaatgtgaatgttatttggttcacatttacaagtttgctttttttcgaagtacaagttgcatagtctcaaaggaaaataatgtccacattttaaattattttactttacagtacttttaattactaatgagggcattcctgttctcctttgaatggtgatatccatttcctgttgttcagattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtatgtagcatttggtgcaggggaaagtaatcttgaaatcatgaaactctttcaaaattttgattgaatctgcagtcataaagttgtcatctccatgacaaatgtttgctaattcacactcttgagttttgtaacagcaatttggggcaacagctctgattcttttctctcttttgtactctctttggatcctccctccccctctctttgtacatttccctgactccattgcttttgctaatgtcgaatgtggcttttgttccgggccttgggtttgggcctataggaaagtggcaaatagaacattgtgatccctcagttcaagaccattcatgccaaccttgctcaggctcttggtactacgtagcttactgagtccagctttggtgcttgcatctaataaggtgttaattttaaggtgagagtagacaagggcaggattccaacattcctgactcccttagggattctgttactattgatattttaattcaactaccaatgtgggatattcagtgtttcctagacactgttcccagtgctctaaacccccgtccccatgtttttgcttatactgtttctactaaccaaaatgtctttctctacctccacttatatcctagataaaaatctcagatattcttcaaagtccacatccaccactacctccatcaagacttttctgtgtccccagctcaatataacctgtcctgaatcctcacaatgtcttgtttgcactcatgttgtggacttagaatctgacttaaattattgttctttgcacatttatcttttatttctattgtaccatgaactcctttttggccaagttttattcatctttacatgttctgcactgctctttttgagtaggaattctgatatttattgaatttaagtgaattaatcaaagtgtgtcatcattatagaaaaaaagaaccaggaaaataatgtggtcatcttgatgaatatgaaaagaagcacttggtaaaattcaatgctcattcatgatcaaatttccagcaaactgggagagatcttccttaattagatagtttctttttacaaaaagccataacaaacatcctatttagtggtgaaatgttgaaagatttcctcctgagatcagtgcttctcatccaagtggatatagcccagtgctgggaagcacacctaaataccccacctcatcaatactccagaacacgatacatcagtctatgtttactaagaaaacccagggaaatcctagaatggaccaggcaatgtaaatagaagagaagagttaaaagaaatagtgtccatttccacgaagcttcttaggagccacattttcaggggtgcacaaatgtggtataccagaacacttctgttcttagtttctgcagccaggtcaactataacttgtccctggccccattccccttggctcccctggctttcaatctccctgctcatcttattcttggaaccttgcctggacatccttagctcaatgcatgctcctgtatcacttggacatgaatgctgctattttttctgatcttagctttatctctccatttctggattaaatttactgatagtcttcactgaagtcctttctgatgcaacccagtcccaggaaccttcttgtggaaggaatagaaatatgcccgaaactcttccttattttaaaaaccatccactgctgggatggaaatagactgaattgtattctccttactcagacaacattattttcttatgtggataagcacatgtacaaacacatgcaaatgaaaaacaaagcatagtttttatgcccagggctgtggtcaaccttggcagctttgccaaggctaccttcaatgccatctccaggacctacagctctgacttgtggaaagaggatgtatttaccaagtctccctatcaggaattcactggtcaccttgtaaagacccaataccagtctttgcgcaggtgaaccaggctctgggggtggctaccaaatagtgtttcacaagaaaaatccagtgaaataaacctgaaattgggattccaaaatactatttcaagtttctaaaagacattgaagatgactgaagataattatctccttacttgggaaagatatcacaaaaatagaatttaccccttgagaaataaagcaagatataagcaaatttagtcttactggtgcttttcttcaccttgtttattaagttcattaaagttctttgtttagattctttttccttattaacttacaggaaggtctttacagcacattatttgtataaagaaagctattcatccagggaaacaacttccttcatgtgcagaatttttttttagttatttcctttttaatcaaaacaggacaaaagtaggctgatttaattgttatatttcatatcttctttttatcatagtaattgagagatacatatttaattccattctcctaatcgcctgttgtcccagtggattcttccttgcatcttatggtctgcacccacaatagcctaaggcattagttgaattcagaagataggatacaaaaagttgagaaatgagcctttgggaatcttcacagttaggcagggggagggatcctaggtgaagtaagggttcaaatccaattggctcatgcagagatgaaccactacagtgtgtctattttaactaataacaaacgcattaatctaaacacgaagacccaaccaggaattcagaattgcagttttaaaaaaatgtaagcatatataaagtgaatgtctagtcttttaggttgactttacggaaagtgttaaattcttcccagtgccaataggagacagaatacatggatagaccctcagtgcgactcaatatatcatttctgacattcttatgtttactttttatcacttactcatcttgtaggggtcctgagaaaataaatgaatatccagatatgcaagttgctttgctttctctgagcgattatagctatgtaagtttgaaaggattaatccttgactattctcttccatctgtcaggagcagaactctgacattgcatctgagcaatgccccttaaccctcctcttttgatcatagagaccccattacacatctagaccccattcaacaaaatcatgactcaccaagttttagaaattaatttttgtatgttactttaatttttttaagtaagtcttcttctattgcccttaaaattcttgattacctgtccaacaaatctctcggtttcccttagcaatgggcacattctttgtaacacagatagaccaatgagttctttctgtttaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgagctttgtaaaaaaaaaaaaaaagaaagaaagaaagaaaagaaaaagaaaaaaagaaaaaaattaagaaagagaaagaaagaaaagaacaatggtgacatctacttatcttattgagcatagcagcaaatgcaatttcctttaggcagtagtatttggtacgtcggaaataaactatttccagactgatacttcagtgtttccttttattttttatagcgtataaaagtttctgaggtgggggcaatattttgataagagtagtcgtttagctaaaactaagtaacattaaggaaacacattgtctggtcttaatatgttagtgcaacacacagtatatatatgtttaagcaactctagatattggttttgcaagccttatatatatacatttttacaaaataacccggatttcttccctggagaaaatgacattttaataaagtcattgatttggtaaagtcattgatttaataaagtcattttaataaacacattgatttggtcatttatctctttattttcagtctaaactcattgactttgttggaagctatggaatattgttctcaattgttggtgatgaattattttcaatttgtataagtgtttcatgtttaatttgtgtcattctctacctttaggcttcttaagttttataacagcatttctgattgggtgtttattactttggacaacttaatttcatgagtatcagtgaataagtaaaaatgaatattttctcattaaataaagacagatttattcagaaaaattttcttcataatgtgaaaatcttttatatgccgcattttaaaaaattcattcagcaaaggtttatggagcatccaatatatacttaagcctttatgagtttatagggagaaaaataaataaaacgcagttagtgttctgaaggttagcatcattctataagattagagggtagaatttctctttttcataaaaagaagctaagaacaaaattttggtgactggcttggatattatggactcatccacaattttgaactgcatttaaaaaggtttaatccacaggtaaagatcgtatatatttaaactgtacaatgtgatgatttggtatacatatacgttgtataatgattaccacaatcaaattaattaacacatccatcaccacacatgctgtaccttagatacctgaaacttgttcatcttatcactgaaagtttgtaccctttgaccaacatctccccatttctcccatcccctatcttgctggcaaccactgttctattctctgcttctatgagtttgacttttttagatttcacatgtgagatcatacagtgtttatctgtgtctggcttatcttatatgacatatttaatatgccaaaggaggttatagaatctctattcccgaaggtcttttaaaagatcctagatttttatctgcaatgtgaaggcataatgccttagaatgtgatggtggccttagtgatgttttcggtcacgggcagaattaagattaaccagagatttaagtcatttaaaaattctatgattgccacctgatttttagatagcaaaaaccaattgttttttcaacatgctgcaaatagtagtgttgaagataaatgttacctttttgaaaaaagttggcgtttttcctttgaaaattacattaactttttctgttgtcaaatatgcttcagatatacctatgaaattcaaaaaacaaaatttcctataaacacatcaaatttccacagtaggaaacaattttcttaactggagaaaaaatagcggctcctgtactacaaacaattgatgggagtgataagtacttgctaaaatgttaaagtcaaatcttagatatgtctaagttttcctttattcaccgtttgttttggataactttttcatttgatttgcttggtatcattgctaaaaacatcaccaggcaggactacaattctaaattattctaaattgaataggctttattatttaagatcagtgattaaaattttgtaactttccttcccaatttattgaagcgtcacagcactgacaggtaaattcttttctaaattgaacccaagttcctttccctgccctttaagctgtttttaattttatatgtgaatttatgtaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggtaatctctctctcaaggtaaagaatttctgcttataatacatgcttaaaatgtattgagaaattgctaagtatgtgaaaaagaaaaaaaaatttaaaaaccatatttatccttgttaacataagtatttcttttgcagccttaattcctgtcaagaaatcatgtaactcatcttctcatccagcctgaaacacacacacacacacacacacacacacacacacccgtctctttctacttctgtctttaaacttctaggtgtactgactctcttatgtatagtccttgtcttggggacacctgaaaacatcaataaaacaatgattgagagaaaaagaaattcctctgaatggctcttctttccactgtagtagtttcaactactacagtccaataatctaatgatatagggagccatacctttatttttaattaaattttcctgcactaaagcagggaaattatgtctaactgagggttctaataaaacaaagaacaacttaggactggaagattttaagagactgatacaagattaaactaatttttaagttgaagctcagaaaacattgttttatgcataaaatataattgcataaaatattttatgtatctgcattataaagtacatttgcataaaatatgataaagtaattaattttagaattaaagattcaagacaaaggcaaggttagaaataataagagcagcaaggcatgaagtggatgggtgagaaaaagaatgacaagggaggaaaacagacagaggagggaaaagaggagatgtgaatccagggtcccaaacacaggagagacatccaagaagggagagggaaatgacacagacaccaaagaagtagactcagtgaaaggcaacatcctacctggctcatagacagttaccacaggcacaggcccttgaaaggtggctggtctggtggagtgaaaagggcacagtctcagctttgactctcttagttgtttgatcttggtttccaacaaacctggggcttatgcagtccaggaagggatcccgttcctcttccacagccaggcggagatggccctggcccggcaattcactgtttccatcgcctctcaggatcacatgctgttaactgttgacagttagtcccttgtggtctaattggtgctgtgggtttattttgagatgattcctcgctggtctagatcccccatgcaggctgcactaacctccagaagtcaagcaactccactgtctaaaggtccccagggctccccacacccactcttcttattccctagcttcctcttcaagagatgtgctaagatgctcatagcaaccttgctggagaaaaaaatgcacatttaatatgcaggagggtattctaaacattatatttaaccctcctaacaatcctactattatacccatatttttacagatgagcaaatggagaccaaagaaaataagggtctcggtctgtaacagcacatggactttgcagcctgccaagcctcctagataaggtttacaggtcctgctatgaagtttagcaagagtccactgtgctatgatatctgtttttccatatccagaaaaggaagctaatatgatttcattttgtccatgtattcctatactgccacccaggggtgaccattttaatgaaaatgactaactggttatttccctgcaaatacagcaatgctctttatcgccccatcaactcctgccaccctgtaagtacaatggcaataacactagtcttggagttggaggacaagggtattaggctgttttaacacacagctagttactggcagagaccggcctaatacccttgttattcagagttcatatttctgggtccttggcttttccaaatgtaaaataaagaaattggactaaattcagcacatttcagtttgacaaatatttattgggttgagtttcttctttacaaagccacaagataagtactgtcaataatacaaaaatgaataggaaagcttatgtatctgttttctagatgcataaaccgtagttggagggaaataatctactgatagattgtgatacaaactatattagaggccaggcgtggtggctcacccctgtattcctagcactttggaaggttgaggcaggtggattacctgaggtcaagagtttgagaccagcctggccaacacggtgaaaccccgtctctactaaaaatacaaaaattagccaggcgtggtggtgcacgcctgtagtcccagctactcgggagtctgaggcaggagaattgcttgaacctgggcggcagaggttgcagtgagccgagatcacaccactgtatcctagcctgggtgtcagagggagactccatctcaaaaaaacaaaacaaaacaaaacaaaaaacacgcacagaaaaaaatcacaaaaaaacaaaaaacaaaacaaactacattagatgtacagatgaaggctgtgccatggcttttgattgactggttcaggaagactttttgaaaatgatgaaatttctgaagcaattttcccagaaaccttcccaaataagttttaaaacaccttcttttaacgtaattctaagtgcagcatgtgattctgtataaaatcagaagaaaaatgttgtaaggaatattattgagattattgagatttcaatgtagactctgtgtttagtgagagtatcagtgatactgacacatcagtatcagtgttaaatttcctgaatttgaatattgggctacacttatgtaaaagaatgacctggttcttcagagatttgctaaagtgtttaggggtaaaaggacatgacatccacgagtgattcagcagtaataataatgataacaacaataacaataatgacaacattatgtattctatagagatatagtgataaagcaaaatgtgatttggtgaatctaagtgaaggctatatgaaagttccttgtattaggcttgcaactttttgaatgcttgaaattttttcaaaatataattttaaaaatatatcattttatgtaagaagaaaaaaactcctgtaaacattcaagtttgccctctgtagaaggagatacaaataaaatggaaaatgggtttgtattggcaatcggctgtgccaaaccaggtacctggtgctcccataggaaccaggccaagagctcacatttaatctgggtagccccttggtttcttggtattattgcctttttgtttctacttgttctgactgcaaataaagatagcatttcttacagaagcagtgtgggaacagggccaagagaatgggacatgctatttataaacttaaagctggcaagagagcttggggtaattgggcaaaattatttagcagaattgtctggtgcctgccagtataagtgctgtggaaccttaatgacagtaggcataattttaaaaaaatttccacagaaacaaaaatatggatagatagatttggctaatgatagtaatttcttctgccattcaaaaggtactttgctttaaacttttaaaattgttaataaacactagtgagttgggtttactgtaataactggtaattatagttccaatgttattttttgttttttaatgacaggagttagaggctgagagggttaaacttttggaggatgttacttttaataagcggaagatgaaagaacttgaagataacctcctctataaattaagtgctacaaaaggtattgtgttattaagaagtaatgaaataacggattctgaataaggatttcatttacactcttttcaatgccctcatgactatagatgttaggaaatactcatgttatcaatgcaaaaacaagcaaggcaatttccatctagacattaaagagggacggcagagaatctgatttttgaattagcaaatagagactgagcatctgagaataacacaattttcttgatataattgctttctcctgagaaaaattagggctcctgatagagctagataactcattataggttaatttgcttgccccaaagaaactaatgtgctcaatctattttttttttttttttgagacagagtcttgctctgtctcccaagccagacgtggtggctcatgcttctaatcccagcactttgggagaccaaggcgggtggatcacctgaggtcaggagtttgagaacagcctggccaacatggtgaaactcaatctattttttttcaaattgactctttcatttggcattgaaatgcagttattgcaacgggttatgacacatgtaatccatgtcagaagagcttgggtaccaaaggcccagcttaccctctacttggcttgacctcccactttagatgggaaagacaggttctcctctgggcagccaaatcatcatgccacacctcaatttgaggatgtactctctctgcaatatataaaaagaaaattttatccaaagaaaataaaatcaacaaacatattgttctgtagcagacaaatcacagaaacctgaattctactaccttattagaagtgaatgaatacttcacaactgcaccttaatcccgggatgttatttaaacaagtctgaccttccagaagtactgtacctttatggtgagcttagtgaaaagtccttttatctgcctactcgcactgctcccgctagtgaagttgtctgtttcttggtccagtgactcctcccagccatttgggatacccctgggcattaaaaatatagcaagcagagctgagggctgctcccctagtctagccaagagtgtgctggatcaagacctctctccttgaggttaatcccaatttggacttccacagtagacagcatacccgttggagtaacacagcccttcctgcagcacttgtctgccatcccgaactctagggtaggccagagtgctgctgttcgcagatatgggaactgttcgcagatatggggactgttagctcagtacatccaaggtgtctttccttagattttaattaaaaaccaaattcattgtcataaacatgcactatttccattaaaaacaataataaaaaaaaaggatgagttcatgtcctttgcagggacatggatgaaactggaaaccatcattctcagcaaagtaatatcagaatagaaaaccaaacaccgcatgttctcactcataagtgggagttgaacaataagaacacatggacacagggaggggaacatcacacactggggcctgtcggtgggtaggggtctggggggagggatagcgttaggagaaatacctaatgtaaatgacaagttgatgggtgcagcaaacaaacatggcccatgtatacctatgtaacaaacctgcacgttctgcatgtgtaccccagaacttaaagtataataaaaaaaaaaataatgaaaggcaaaactaaaaataaaattcaagtttctcttcctggtgagacattttcactatacccaatttgctcttgttagagacagagggattagagttttctatagcaacgactgttctactaaagcagtgtgaggagtgtaccattcaactatcagcatgacagtcagcccatgtgtgaagtgttcaggttagctacaccctgagacaagcagcgtggacaagctgtgacactttgaggagagccaccaagatgacagtgggtgtgaagcctatcacatggggaacagcaaagagcactggagacatgatcattgtcttgagacatgtgaagacccaatcaaatgggtcttttgctttttgcagatgtttaggcagagcaggggatagtctgtcagcaggaatgttcagaaggcttcaggtattgggtggtagttggactagaagctttttggtgtcttaagattctactgtaccagtagtcttcctgactttggagacatcaagttgaaagctaacagcgttttttttttttcagaagagatgtatcttgctttgcaagtttcccgtcttgtgtactacggttttcctgttttgaatttcaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccaggtgagtcctcactaccttcatccaaaagtggtgacttaaaagtttgcttgtatttctactcttttagaaattgctttttcactattcacaatagcaaagacatggaatcaacctaaatgcccatcaacagtagagtggataaagaaaaggtggtacatatacaacggggaatactatgcagccataaaaaagaatgaactcatgtcctttgcagaaacatggatgaagctggaggccattatccttagcaaactaacacaggaacggaaaaccaaataccgcatagtctcatttataagtaggaactaaatgatgataccacatggacacatagaggagaacaacagacactgtgacctgtcagagagtggagggtgggaggagggagaggatcaagaaaaataactaatgggtactaggcttaatacctgggtgatgaattaatctgtgcaacaaaccaccatgacataggtttaccgacgtacaaaccttcatgtgtacccctgaacttgaaagttttttaaaaaaagaaattgccctttgcttctttgattcttaaaatgtgtttcagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaaggtaaagtgtgtgggatacagatgtggtgtgtggaggatgttgcttttgatatgctctttgatataccataaacccatttctgtgatacagtagggaaatgatgttctaacgaaagtttaattaagttttatttttaataccttttttctgtttttcattcgttttgccctagttacttaagattcaggcctgtgccaactcacctgaatattggtattattgtagttattgatataactacattcagtttattcactgctgcccatgccaggaaaagtgatactggtgatggctttctttagcaggacagccattccctcagcaagggagtataatgatttttcagactgcaagaaaaggctcacttatgtttcatatttgaagttaatcctattcattgcatatctccatgttaaaggtataattaaggagacaaaagaatggaattttcatttcagtttagttacacgagtatttactgagcacatgttatgtaaacccaccacgctagctttggggatgtaagaataaaccagatattgcttgaaaagaaataataacctcagaatggggataaagataatttaaaaataactccaaagtaaggcagaatcacctaagtgctataagagagctaagaaacaagtgttgagtctaaaaggagggaaagattacatgtggttggtgaaatcaaaaagtttcttagaaaatatacctttgtgggttaagccatgaattggggaactatttggtacgtggcaaaatgtttcaatctttttcttgtgtttttggctctttatgtatgatttaaccaattattttctggctccccacaccccataaagaaagtggcatttgaggtggaccctgaagaggtagaaatgaggaaaacattccatgctgaaatggaacagcatgagaaagggaacgagtggagaacatctaagttgtaagaatcagtctggttttgttgaaatgaaaggtggatatggaggcatactgagaaatagagctggacatgtaaactggtgacatactgtggagagcctgggttcctgtaggaaggattttcttgatctgggaagaaacagggagttgtgtaaggtggtgacgtgattgatcattatggtcatttagggaggtgaacttggcacacgtgtaaggatcaaagaaaagaggttcaagggagtctctttcaatcttcccaactgcaggaatacattcctaacctagcgtaaaggcaatgggaatatacagggagataagggtgtagagattaaggaagtaaaatggcaaaaccgatgcatacaagagccaagagagcatgcagaaatgagtctatgatttctggcctatgcagagatttctggtctggtggttggaagaggagttggtttgaggagggttggagtgggggattgctggatgtgattttaggacctgtttagtcagaatcagaataggccaggttttgctgccataaaaacaatctcaaaatttcagtgacttaacacaaccaaggtgtacttctcattcatgttacctctccaacgtgctgttatagtcactcagaaatccacattgcttccataactactatggcagaggggcaaggatgtggcagactgtgcactggctcttaaaagttaccccacaagtgacacatgtcacttacgctcctatttccttagccaaagccagacacacagccacatctcacttcaaaaagagcagggaaatgcagttccccgtgtgtttgaaaggcggggaaacagtttgtgaccagctcttatgactacagacgtgaaatttgagctatccagaaaacaattagaaaagataacctaggccgggcgcggtggctaatgcctgtaatcccagcactttgggaggctgaggcaggcggatcacaaggtcaggagatcgagaccatcctggtcaccggtttaggtgaaaccctgtctctactaaaaatacaaaaattagctgggcgtggtggcacgtgtctgtagtcccagctactcgggaagctgaagcaggagaatcacttgaaccagggagtcggaggttgcagtgagcagagatcatgccactgcactccagcctggtgacagagtgagactctgtctcagaaaaaaaaaaaaggaatctagacagtccaagagaagagtcaggcagttacaaagatggggtacagaaataacagccaaagccatgggaatgaaagctaatctagggaaaaaatgtggagtatttctaacccacaaggtgataggacctgctatacttttgtcctctgcagcctatttataataaacgggcagtcaccgataacttcttactctttctctacttcatttaattccttcctcagattcaggttagattaccactgtggaaacttcgcaaactattttgcatcatctctgaaatctcttctttgtgcctttttcatgaacacaggttttatttctggtagttccaaggaagttgaaatgtatcatgtggttcatatttttttcacaggtctaatgcacttatggaagttggttttttaaggcagtgtggtgtggtacaatgaacactatctagggtggggaggaggcactgcagagagtgtcaagatgtatgaggttttggtcttggggatgcttaagtaaagtaagtgaatttacccaatctggaaacctattttacctcatttcaaaaatctttaagccctcacttggacttgggctgcagccctggtattgtatgatgctgagcaggggggtagggggcattgaagcgtgctgaaatccaggcagcagtggcagcaaaatgacccccacaatctggggaagcctcatatctatgcaccatggtctgaatgtttgtgtcccctcaaacttcatctgttgaaatcttaccccaccccctccaaggtgatggtattagcatgtgaggcctttggaaggtgattaggtcatgagggtagagctctcgtgaatggggttagtgcctttatgaaagaggcctgagggagctcactccccctcccaccatgtcaggacaccatgaaaggagccatctatgcaccaggaaatgggccctcaccagacgttgaattcatcagggtcttgatcttggactccccagcctccagagctgtgagaaataaaaatttctgttgtttctaagccacccagcgtatggtatttggtgatagtggctgaatggacaaagataccgtgcaatacgagtggaggagaagtatacttttgaatctttccttactggtgagctggctttgcttcctcaatgccatctgctaatatgacccctgagaaggaggcacatatgacatagaaaggaagaagtgggaaacctggtgcctgggtccacagtggatggtgggaaggaaaaaggaggtcagaggtagaaagaggaggtcaggtgcaaagatcctcatctcttccttgcctcctgagggagctgagaaggggagagtgccggagaaactcccagataggagatgcccctgcattctgcccagtgtcacacccaccatggaagcaggggaatggctggatgggtgagcctgaggtttggctggcacacagcagagactagaggtcaaaccaaaaagctgtcaagaaagagaactttgtacctgcagacaaaggaccaatgccaggagctggggcagtggattgcagtccagggccccaacagatagcatttgtcgtagctcataggatacagtacagggacctagcctgcacctgaggtgtgggaagcctggagggcagcctgcatacctgaggcatgctcgatactaagacatagtcccaccccgtctcacctctcccacctaccaaccaggcagaccagagctactacctgaaagagactgggttatttgaaagagggtgggtaaaccagaggagactgagaaacacggcaacacagtggggagggaattcatcagggaggattagatttgttacagaaaaataaagaaggctgaacacatgggttgtggtgtgagcacatttgtgaccccatttcatgaaattggagtcagggagaactatactgtatagggccaggagagtcagtgagaggagtttggatttaatttagttggcaatagggagccatcgaatgttttatgagcagggatgtggcatgaacagaacagtgctttaagaagattaatttgggattttatgataggttgattgacagcagtacaattggcttagcaataaaggagtttttctttttaaacaaaacataacatttgttttagttttgaactggcttacattttgactgaattatctttaaaagatggtatgactttgtttttaatgtttctttacaaagttaacaaatatgatccttagatcacagatacttttaaaaaatcattttgaactcaatacttaagggggagagtggaagagttatttatcctagcagaaatgtttgatttcccaagagtgacaggttttttttgtttgtttcaattactacttgctttctgcaatatttgcaaggtgcctttgactttcttcttcaaccaaaaatgtcagaacactttgaaaaatgaaatggataccaggcgcaatcctgcattatagagcaatggacttatctttcttccctgtctggttattttagaaagatattatctttcttttgtcatagactctgtacaaaaagacaccttagggggtcttttcttgccttccaaactggactgaacctgggccttccaagcggggaaagaaaaagagagagagaaagaatgtcagaacaagagctaatgattacatagctcttattattattctatactgttctaggtacattaatgtatttaaccttcacagcagccaatctggtagattctatcagacatccacttggcagatgaggaaactgagagggattcatgtttttttgttcaagtttatgcagctaacaagcggcagagccaggatattttgggggaataggaagggctgtcattgttctgggttagtttaggaaacacaaaggtagcttagatttcttctcctggtgtctctaaagctcaggattacatgaaaacatttctttggaaacaaccaagaagaaaaggggtgagtttgtctctgtgccaggcctgcaggtggctctctctagtggctgcttctcgcaccagtgactcctacattagcaatactgttgctccagtgagacctgctctgtctccaggttgcagaggggccgacagtaagaagaaggtttacacattgttctaaaggtgttgttgcactcagagccacagattcccaagtcccctgtggtgaagcaaatgggtttacatgaaaaaagtactttcgttcatacagctactcaggacgatgctagatggggagagcaaagacctgtagttcccccaagcccctttttggtccatgagttgatttgtgaactggaaggaatgatgagttcttaaggaagatgataagatttaaaagttaaagaatcactgctttgcatgcatctgaattaaacaacagtggagctggaattattatgatacattactaaagacatgcaatagaggaatttttaaattgtaaatatcatcatgtatttcattggaaaatgctgggtatgcccatttggcctgagatatgcttcagaatatgatcaatgctgtaactcattctccactggactcaagctctgtaaaagcaagggcctggttgggttttctgtgctatatcccccagtgtctggaacatgtcaaacacctggagggcgctcaataaatatttgttcaatcaatgaatggataaatgatttaaatattactcatccactaaaaaacccatagatctattatatcatttcctccttcacttccttctttattccccccctctttttatccctggcctatgtttctcccaccctccttccttaaccctaaccccaaccttaaccctaaccctaaccctaaccctaaccctaaccctaaccttaaccccaaccctaacccatccatgtctttatctatctgtttgacctggtaacaagtagtttttaatggcaagcttctggaggagtaatgactaagaagtgatatttaaaatccacacatggaaagatcaacatattcattgatatcaaaattataagttttaggttgttaaaaaataaaaagcaaacaaatataatcacttgagaaaaattctttgcagggaaaaatgacagagttgttatttataccttataagatggtataaatcagtaaataaaacactaagacttgaaggaaatgtaccaaaaaaccctcacattttctgtaatattattattttccaattttcctatattttcagtaatgtggctattttgcttttattatttgaaaagtacatttctagaagtgaagtacaggcttacccaattcaccctgtctgacgctcttccccagggggagcagctctggacctgaaagcctgtcctcccaaaccctatcgctggatccttgacatgacttggctgaatcttgtggagctgagtaaacttccacaatttgcagaaattatgaaccaggtaatacaataaagggctggttgaaagtgcagatctgcaaacccaaacatacctgggccgcttaaactggggcttcctggcagcaattccttcacccaaaaaagtcaacccaatagtttggatttgaggctctgtggctgtctgggagagatcttggacagatggacctcagggttaacctcttcatagttgcaggcaactatgttttcctcctgtgtggtgggcatgggtcatttttgtatgcctgttagagttgctgctggaatcagaaccagtagatggacccttttattgtagacgactcatgcttttacactttaacttctgcctatgattaagtgatttgtacagatttgaatgtgagtcaaattaagaggttgaggtccctctaaaaaattaattattttagtggtgaaatataatggtgaaaatggagaaataggtaccgatttgcttgttgtttttttcttatttgaaaatgtacattgattactgtggattaattgttgagtcaattgttactggaaaacaatcatgagactcagaataaagatagctgtttcttactgggttctgttggctgcaactgcctgtcactaatggagcctgcagtttcccagtgtcagatgccaataatcatctcttttctatggctgctagtgactgacagatggggccataggtagactgcaggttgtcagagcctcatgctgtaatcaccaatcccctgcccaacatactgtgttagctgcctctgtttgtttagtggcatttctgaaacattgtgtagactctacctattcagcctggttgggtctgagtcaattggataaactctctgggttccatctgtggatagacagtgagctttgttttgtagtacaaccacagatgagtcctccaagcccaaacaaatgcttggaaaaagaaagtgatcttgggctgggcccgatggttcacgcctgtaatcccagcactttaggaggctgagccaggtggatcacgaggtcaggagtttgagaccagcctgaccaacatagtgaaaccccgactctactaaaaatacaaaatattagctgggtgtggtggcgggtgcctgtaatcccagctactcgggaggctgaggcaggagaatcgcttaaaactgggaagcgggggttgcagtgagccgaaattgcaccgttgcactccagcctgggtgacagtgtgagactctgtcttgggggaaaaaaaaagaaaagaaagtgatctcggtctgatcagagattgggtaagggagatagtcaagaaccactggaaaaatcacttgaagcccacgccctctaatgatggtttatattgatacaaggatatttattattgtttgcctctgccaactaggttttaactactcatgaggtagaatatagtagctattactgcttactatgggataggtactttgcaacaataaccctgccacagaagggcagagttattgaccctaatttatagatgagataacagagattcaaagagttagttaagtacttgcccaagagcccattgccaataagtggcaaagctcatgctcttcccatgccatcatgagttatttctctcccactcctcttacaccaccgattgggccagaagtggggtgaggggcagttctcaggaaggttgcaaaagttcagcggagacctgcagtcaggtggccatcagtctggcctgcctgtgggaaggaagggaggaagcagaagatcaatctcccagctgagtggatgtcaggaactgaaatataatagagcagctgccctgaccttggcatcccaggccaagggtcaggaaaaggaatgagaaatggagatggacatccagaggctggaagtcatcttatcacctatcatggctgcagctcactttgaagctctactgtggtcaagtcaaaattagcaggtggaaagtcagtaggtgaagaatagtcatccgctttcttcctgtgcctcagctgcagatgtggaggaggcctgtgggggacactgtgggcaggggcaaggtagggctcgcaacacccaggccctggcatgcaggcatcttctttgagggcagccaaccagagagagctgctgcaatcttcaggagatagatggcagttgtgaaacatttcagaaatcctcttcttttttttttttcttgagatggagtctcactctgttgcccaggctggagtgcaatggcgcaatctcagctcactgcaacctccagctcctgggttgaaacaattcttctgtctcagtctcctgagtagctaggattacagatacacgctgccacgcccagctaattttttgtattttagtagggacggagttccaccgtgttgcccaagctggtcgcgaactcctgagctcaggcactctgcccgcctctgcctcccaaagtgctgggattacaggcatgagccaccatgccaggccagaaatccccttcatcttttagtgccccagggacaaagtgggagcaactgagttgcagaataactgttctgttattaatttatactctatctgtatcctgtatgatgaattgttcacaccacagatatgagactttggacagttatttaacctctctatgcctcaataaaaagtaggggtcatagaggaaaaagtgtaatcctcaggtctggcatagggcatctgctatgtgagcctttgctatttgctattactgcttactgtggcttttttattttaattttaatttttttatttttttgtttttgagggggagtttcgctcttgttgcccagagctggagtgcaatggcacaatcttggctcacagcaacatctgcctcctcggttcaagtgattctcctgcctcagcctcccgagtagctgggattacaggcatgtgccaccacgcccggctaatttttttatttttagtagagacagggtttctccatgttggtcaggctggtctcgaactcccgacctcaggtgatctgcccgcctcggcctcccaaagtgcttacaggcatgagccactgtgtactgtggcttttttaaaagcacacttacaaacaccgtctaaataacccagcctgattgttgctgaagagcagggataggctcaataatctatagttttcgtacttagtcttgatggaacttgggcgtcagtgagcaccttttaatgcctctgaaaacctgaagtccttttcatgcttctgaacaatatttaagaccagctgttggagagactcctttcgttattaggctttaggtctcaaggtgggggatcactaggaaaataaaagttttgattttgtcatctatcattatttttaagtagagatcaacatttagaggttgggttatcagaatggtctgtcagtggttctcaactgagggtaatctacccacccccaggggcatttggctgtgtctggagacatttttgattgttaggacccgggtggagggtgctactggcatctagtggatagggacgctgctaaacatcctacaatgcccaggacagcaccccccacaaaaaaaattcagatccaaatgacagtaataccaagcttgagaaaccttgatttgtgtttcttctggcccaatcatttggtgcagttgacacacgatcctaattgtagcgaataatgtagaaaaataatggaagaactggaagggaatagtaatatccaagttattcaagtcattgatcctgaagaaaggtttaaactgtgctgttatgcttgaaaaattatctgcctgtaaagaatgaccctctcaggtgattcagaatcctttgtaatatattccacttacatatagttctgtggcttgctaattggcttgcttcttttagatatctcgtaatgagaaggggtggaaaagctggtttgataaagatgctccagaggaggaaattatccctgatggatataatgattcactagatacctgccataaacttttacttatcaggtgagaacaggcattatcagacctagaagcatcactcataatattgctaaattacagattttatctcagtgagtttacttcactatatcactgtcattgaaagtaacggcaaaaaccgcaattacttttgtgccaacctaatattataagaaatgtatgtacttccaaattatggttttggatagcagttcttcagttccttgacaagcaaaataaaatggtgatggtgacagggaatgatgtattttgacaacgtattaatgatagtgcttttagcaaaaagcgtgaaaaatatgcttttaatattcactttgttcatgatttaccattgagtgtaaatcagttattgttgaatttatttctttaaaaaaacagacctcacaaagttacaagacaattagcttataagctaaagttaaattgcattcgagaaaaaaacccaataatattgcactgaatttgaaatatataaatgctacttttggctataaaatggaaacaaaagtttgaaattgatgttaaagaagaaaatcgccctctcttttcactgtttacattttctcagtatccagtaactcagagaccttccacattgaaaaaaatcagtgtgtgtgtctgcgtgtgtgtgtgtgtgtgtgtgtgtgtgtgtgtttgtatggtggatgggtaaggcagaggagtaaagcaggggagatgagacccccacatgaaaaatgagaggtagagttattttgaagcaattttttcttttctaatgttatacacctaagtttccacttcttagaaaaagctgtttcttagatattgtcaaccttcaagagtgaccagaacaacgctaatgttgacctcatagtccgcagagtatgaaaaggcttttttttttttttgagacagagtctcactctgtcacccaggctggagtgcagtggcatgatcttggctcactgtaagctccgcctcccgggttcactccagtctcctgcctcagcctcctgagtagctgggactacaggcgcctgccaccacgcccggctaattttttgtatttttagtagagatggggtttcactgtgttagtcaggatggtctcgatctcctaacctcgtgatctgccagccttggccttccaaagtgctgggattacaagcatgagccaccgtgcctggccagggctacttagttttattggaacaaatgtgtcttattttttaatccgtcacttaaaaattagatctatgtcaaatagtgcaatctagtagcaccaaaaaaaaaaaagtctgtggggcttgtctgtgctttaccatatcaatattaaatgacacttatccaatgtgtctgtgtgtgtagaacttgctatggtgtgcactacacaaatggtatgccacaaatgcttgctgacccacttactttgggcatctttggcatattggttcctcctctgaaaaggctgtggagcttcagagtgtgtggcaggtcagcccctaccatgtgttggagctggtagaggacactgtgttgttatgggctctgccctacttcttgccaatgcctggctggtaccaaaaccacacgattaagtttgtgctcatctgtgataggaaaccttgccattcctcttacttagatgtggaaaagtaggaattaacttgttgcccttttgctaattaaatgtatgtttttacttactcagataggataaaaattgaacacgtttagtttatttcgcctaacttgtattcatttttaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactgggtaagactagcaatctacaaaatgtagcaacacttccatatttttttgccccaaattttgcctttcgtaattttataactgattcttagaaatagatgtaaaactgaattcgaaaaatattaaacttattcctctttcatcctttcatacctcctaaagtgagggtatgatataggtatctttgtttagagaagaacatgctcatctagcatatagtgttttttttttgattggttgtgttttaagttctaaggagatagctgtattgcatggatagctgactaacaagaatgaacacacaatagccaaagtttatgttattgccatgtctatataaaattacagcaaagtttattttgtcacaaattaaaaaactataaccattattgtaatgcatagtagttagggattaattatttcattgctttcacttaataaccattcagtacaggcagtgtgctagatctggggagcacagagatgaatacaacacagctgggaaagacagacacgtaaacatgtaattgaaggcaatgtgacaactgcagtaaatgtttcatagaagtggctgatcacaggattcagagctactcggattgcctggggtataggggaaaacatcacattgatgatatttgagtaggaaattaaaaaatagataaaatttaccaggtggggtggtgggagatagaaagttactccagggagaggagatgggaaagaagttataaacacagaagtgtttataagtgtgactgagtcagtaggattaaaggacagggatgcagagcacatcttgacaggactgagccatcctgtaagaaggactttcttgacaggactgagccatcctgtaagaaggactgtttatcccttgcttcattcatactctgaaaatcggaatgctgttgacattggcatttgcaatcttctagggtcaggtatctgtaactataccttgtagggttaatccaatcatgtcttttgagtattacagtgattgattatgaatcactaaatctatcctgtgaagtaaaattacattaaatttattacatagtcgacataagcatgatataaaatcaattcagtcatgtccacgtactagccacatgtccctctgcataaaaccaagctacggtagcatggtccatgttcatgttctcttttctcatcttgacttcactctatttgttgtcaccacactgttctatattctcagtggatcagtgttcaaatggccacggtcttctgtctgaacactgataccaatgcaaagagctcccaggttctattggcaactgctcatggttaagtctcattcgctatcttcaaagtaggcagttttgctctagtatttactgcagcacaccagccgtctgagtttatctcagagtgatgcctctcgagtagccttatagtttgcaaatctctctcaaatctgttgctctatgagtgtttatccagctgcctctaagcctcacttctctctgcacacaggtatattttttctctcttaacacttaccattcttctccacatggcagaacatgtggcttctagtggctcatgggcttcactgcttacgtgctcagaatgttcagcaccctcagggaaactcctcttattgtcatggttccaagttccaatatccagggaagtaactcattgtctttgctttggtcatgcactcctttctgggccaatcaatgaactgtcgctctggagataggttcctagtagaaaccttatgtacagagctggaatgggggacatttcttagaagatacaacgcctagaagaaggagtattcaactagagttaccatttcaaatgttgtaatttgagaacataattaaaaaattcaaggtctcctttgggagaaattataactgacattaaatgaatgcagaagggcagacttgtgttatatcctttagtgttatcatactgctttgcttggcaatttggtggtttccgtttcttggtcctaccttactttttccaacaacaatccaggcttctattgattactttattagggtactggaacaacatagatttggctttaacactgaaggatcaaatgaattttataaacaattctactgccaaatcatttgagcagtattaggaagtctcaggctgcttgctgctttgggttgaaagtcccaaagatagctgttaaaatggaactattacacataccgaacaacatgttaatgtagtctcagctattaatattttatttgaaaatctggataataaataatcatagaatgcttcaggtgaatgtgactggaaatcttgaaatccaattacttttttttttttttttaacagttgggggaaactatggtctggagataaggccccagacctagtccgtggcagatctggttcagaacttatctcaggaaccccacttcagtgatctcattggtctttctttttcattccttctcattgttttcattgaatgaattaaccagctacccgaaaataacatacggatgggacagaatcaataagtttttgtagaaaaagaggagaagggaaactttggttatagatattgtcttgtactggtcaagatctgtagtgagaaatttggagcagataaactctgcacagagtactgggtacatgggcaaagtggagaaagcagatgggtttagcacgagagcctttctaggagcctgactactggaggagggaggtctcagaggaaggatgggcttaaaaagaacacctaaaaacaaacgaaagagaacaaatacataaaaccccacaaccacacaaaagtagtagtgggaaaactgatataacaatatgtacagatgaaacattttaacattttaaataataagagaatggctcataattatagtaataaattacaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaataaattacagcatctcattaaaattggcaaatttatagaaacatatgaatttagaaaatttcctcagaaaaggtagaaaaccctgaataaaccaataatcaaggggagaaaaagtagaagttttaaaattattacatcagcaaaggctctaggcttggataattttctgataagtcctttaaaactttcaaggactctcatatgctatattctgttccaaaagatggaaaaagagaatacattttcctttttcttttgagacaggctcccactctgtcacccaggctggagtgcagtggtgcaatcatggctcactaaagccttgacctcccaggctcaagtgatcctcctacctcagccttccaagtagctgggactacaggcacacaccactaatcctagccacattttgttttctgtttttttgtagagatgaggtctcattatgtttcccaggctggtcttgaactcctgagctcaagtgatcctccctccttggcctcctaaagtgttgggattacaggcatgaaccacttcatctggcccattttcctctttatttgcattattctgaaacagtaaaccgacccagatagtaactgcataaaagaaagaaaactggctgggcatggtggctcatgcctgtaatcccagcactttgggaggccgaggtgggtggatcatctgaggtcaggagtttgaggtcagcctgaccaacatggcaaaaccccatgtctactaaaaatacaaaaattagctgggtgtggtggcgggcacttgtaatcccagttactcgggaggctgagacatgagaatagcttgaacctgggaggtggaggttgcagtgagccgagattgtgccattgcactccagcctgggtgacagagtgagactccatctcaaaaataaataaataaataaatgtaaggatcttaactaaatcacaagcaagatgaatttatagtgatgtcagcaagatgtctcatatccctccacatatccctccctcatatcccaccaccacatcaggaattctgtatccatctacagacaaagtctctctgcaggaacctcgggatataggtagaaggttgtgaaaccctattaaaatccaagacctaggagggttgttttgagagcacaaactgacacccaaatggcagatctgccaattgtgcttccaggttcaagcctagaaatggccctgctccccaaggagtttggctatagccctttttggccttgagcctgcaactaaaaccaactgccaagggttgtaggtggaatcaggcacactagtgtctcagtgcagaggctcgtctgcctgccaacatcgatcttggcagtgaacttgaaagttgccctgtggcttgtctccaaccaccctcagctgaggtcccaactcagagctaactgtgcaagagcccagaaggaggcttgctcatatctagcagactgggagtctgagcctccatgaagggctcatcaacctctgtaccccagcagataccaagggtgcccactgtcagctctggtccctcctgctgcagtcagggaactatcctacctgtgcagggatctactgggagatacatgcccttctgagccaatgagatgagctcttcagccatcatcctccagcagatcccaaaagggcccagtctcagctccagttcctcctgctgtagtcaggaaactaatttgtgcagagacctgctgggagacacactcccatctgaaccaatgaggtgggcttgccagctctgccccacgtcaagtcctgaagggctccggtctcagccttggctcctcctgctgcatttggaaactatcccatctgtgcagagacttgctggaagacaaacccatctgggccactgggacaggcttctgggcttgtgtccctgaccaactgtctcacacagttcaggcacattgtccctaaaaaacaaaacaaaacaaaacaacaacaacaaaaaacttgttataaatatcagattttttggtaagcctcatggtaaccacaaagcaaaaacctatattagatacactaaaactaaaaagtaaggaatcaaaacatactactagagaaaatcacttaaccccgaccaagggaagactgcaagagaggaagaatggaagaagaaaggatctacaaatcaactagaaaacaagtaacaaaatggcagtagttagtccttacctaccaacaattaccttgaatgtaaatggattaaaatctacgattaagagacacagagtggcttaatggattttttaaaaaagacccagctatatgctgcctacaagagactcattttacctggaaggatacacacagactgaaaatgaaggatggaaaagatattctatgcaaatgggcaccataaaaagaacaggagtaactatgcttatatcagataaaatagactataaaccaaatactgtaaaagaaggccattatacagtgattaagggtaaatacaacaagagtgcatgtgtgcatacacacaatgcacccaacatcagagcacctaagtgtataaagatatataaaaattaatatatatattaattataataaaagatataattaataaaaatgtaaatattaatagacctaaaaggatagactgcaatacaataatagtagggggcttcaacatcccattttcagcaatggacaaatcacccagatagaaaatcaataaagaaacattagagttaaaccatactctaaatcaaatggacctaacagacatttacagaacattccatccaatagttgtaaaatatacatgtttttaaacagcacatggaacattcttgaggatagatcatatatgaagccacaaaacaagtcttaacaaattaaaaaaaactggaaacctaccaagtatctttcttgaccacaatggaatgaaactagaaatcagtaacagtaggaactttggaaactgtacaaatacaaggaaagtaaacaatatgttcctgaataaccaatgagtcaaagaagaaatttaaaaggagatttaacaatttcttgaggcaagtgaaaatggaaatacaacacaccataatctatggaatacaacaaaagcacctctaagaagtttagagcaataaatgcctacaccaaaaaaaaaaaaaaaaaaaaacaagatcacaaataacctaatgttgcatctcaaggaactagaaagacaagaacaaattcaactcaaaatttgaaggaaagaaataataaagatcagagtagaaataaatacaatagtgttttgttttgtttttttttatgaagtcttgttgtctcccaggctggaatgcagtggtgagatctcggctcactgcaagctccgcctcctgggttcacgccattctcctgcctcagcctcccgagtagctgggactgcaggtgccagccaccacgcctgactaattttttttttgtatttttagtagagacggggtttcaccatgttagccaggatgatatagatctcctgaccttgtgatccacccacctcagcctcccaaagtgctgggattacaggcgtgagccaccgcgcccggccgatagaaatttttaaaagtacaaatgatcaacaaaatgaagtgatatatttttgaaatgataaaatcagtacacctttggccagactaagaaaaaaagagatatgactggaaaaaaaaaaaaacagagatgaaaaaggagacatcataactgataacacagaaatacaaaagatcattaaagattgttatgaaaaattacatgccaacaaattggaaaacttagaataaatggataaatttctggacaaatataacctaccaagactgaattatgaagaattagaaaacctgaatagccaataatgagtaatgagattgaatcagtgattaagtctcccatcaaaaaaaaaaaaaaaaaaaaaaagcccaggaactgatggcttcattatggaattctatcaaacatttaaggaagaaataatacctattcttctcaaattattccaaacaattgaagtggctaggaattttttcagactcattctatgagactagcattactctaatatcaaaacacaaggacacaacaaagaaagaaaactacatacaggctgatatccctgatgaacatagatgtaaaatcctcaacaaaatactagcaaaccaaatcaaacagtgctccgaaagatcattcacattgattaaatggaatgcagggatgtttcaaggtacataaatcagtaagtgtgatatatgacagtaatagaatgaaggacaaaaaccatatgatcatctcaatagacacagagaaagaactggataagattcaacattcctttgtgataaaaaccctaaactaattaggtatgaaggaatgtacctcaacacaataaaggtcatgtatgacaaacccatagctaacatcatactaaactgggaaaagttgaaagcttttcctctaaaattaggaacacaacaatgatgcctactttcaccacttctgttcaacatagtacaggaaggtctagctagagcagttaggcaagagaaagaaataaaaagcatccaagtttgaaaagaggaagtcaaattgtccctatttgtagatgacatgtatacagaaaaccctacagatgccaccaaagaattgttaggactgaaaaacaagttcagtaaagttgtaggatacaaagtcaatctacacgaattagggtttctatatgccgacattgaactatctgaaaaagaaatttaaaaagcaatcccatttaaaatagctacaaaaaataaaatacctaggagtaaatttaattaaggaggtgaaaaatctctacaatgaaaattattaaacattgatggaagaagttgaaaaggacacagataaatggaaagacatcttgtgttaatgacttgaaagaattaatattgttaaaatgtccatagctacccaaagcaatctgcagattcacatgcaatctttatcaaaataccaatgtcattgtttatggatagaaaaaaattctaaaatgtatatgaaaccacacaaaatcccaaatagctaaagcagtcttgagcattaaaaaaaaaagtttaaggcaccaaactacctgacttcaaaatgtactacaaagcaatagtaaccaaaacaggatggtagtggcataaaaccagacactaggccaatggagcagaatagagaaaccagagataaacccatgcatttacaaccaacttatcttcaacaaagttgcctagaacatgtaatgaggaaagatcaatcttttcaataaatggtgttgggaaaactgggtaattatatgcagaataatgaaactagaccctatctctcaccatacacaaaaatcaaatcaaagtggattaaagactgaaatgtaagacctgaaattgtgaaactactatgagaaaacactgaaggaaatgctccagaacattagtctgggcaaatatttttttgtgtaagacctcaaaaacaggcaaccaaagcaaaaatagacaattgggattacctcaagctacaaagcttttgcatggcaaaggaaacaatcaacatagtaaagacataacctacaggacaggagaaaatatttgcaaactatgcatctgacaaggtgttaatatgcagaatatataagtaacacaaacaactcaatagcaaaaaaaaaaaaaataataatctgattattaaagtggacaagagatccaaacagacatttctcaaaataagacatataaattgcaaaaagatatatgaaaaaggctgaacataattggtcatcagagaaatacaaatcaaaactacaatgagatatcatctcaccccaatttacatgccttgtatgaaaaaaaccagtaacacatgctggcaatgatgtggagaaagaagaaccttcatacagtattggtagaaatgtaaattagtactttggagaatagtatgcaggttccccaaaaaactaaaaatagaactgctctatgattcagcagtgctgctactaaatacatatccaaaagaggtgcaatcattaagaaaactttgaaaggatttttttcattttaaatataaaatttaaaaaaacgaagtgaaatcagtatattgtagaggtatctatctgtactcccgtgtttactgcagcactattcataaaagccaagatatagaatcaccctaagtacccatcaccaaatgaatggattaaaacatgcggtacatatacacaatggaatactattcagccataaaaaaagaatggcattatgtcatttgtgacaacatggatgaatacggtgggcattatcctaaatgaaataagctaggcatagaatgacaaataccacatgatctcactcttgagaatctaacaaatttgatctcttagaattagagtagaatagtggctaccagaaactgagggagggtagaggggaggaagaatgatttctagtgttctagtgcacagtaaagtgaatagttaaccataatttattttttaaaaaaatatatagtccaaaatatctagaagagagaatattgaatgctctgaacacagggaaatgaaaattatgttgtgacggatatctaaattacctgatttgatcattacacaatgtatacatgtattgaaacatcacactgtacccataaatatttacaatcattatgtgtcaatgaaaaacaaaatatgactttgaaaaggaagaattcaatagaacatcaagaaataacttgcaaataataacgtgccttcaccaagttggaacacatgggcaaatataagaaagatgcaggattaagaaatctcatcacaacaataagagaaaaacttctccttaagctatcatactgttatcttgatgggtgctataaaagccattttataaaaattcaacacttatatttgacttttgaaaagtaggaacagaaggatattttatttatatgataatgattatgaaccccaaacatcgtgatacttattggcgaacaactagagacatatccattaaagtcagatacagatgtctgctattgccactgttatttagcattgtgttgtagaagatatggctaatgtattgaaagaatcataaataaaagatgtaactaccggaaaggagggacaaaatcaacattattcttagacaatataattgtctaacaaaaaatacaaatgaatcaacggaaaaactattagacttaatagtctaatagttcagtgaggtgactgtttacaagataaatatataaaaaatgatgctttcttgtaaaataagatgtaaaactcctcttcattatagcaataaaaataaaactgagaaataatttttaaaatactcatttaaagaaaactataaaaccttcttagagacataaaagtagttagaataaatggagaggtaagccacattcccagtatagagattcaatgttgtaaagatgtcaatatttcctaaattaatctataaattgaagccaagtctaattgaaactcaagcatcattgtttttctagttggatagtagagggatattagagcttctagaattgcaaatggacaagaatagctaagaaagcttgaaatggaaaaaaataagaataatggggaaccagcaccaccagatttttaaaacattatcaaatgccaataattttatcatttacattacaaacattgataaatatggagcaaaatgaaagggccaaaattagactcttgtatgtacaatagcttaatatgtgataagatttgcatttccaatcagtggaggaaaagtgggttagacagtaaacaatgttgagatagcaggttaactttagtaaacataaaagttttacctcacattaaactctaaatgttaggtcgattaaggcattaagtgctttaaaataaactataaaacaagaaaaagaatatattcaattagttatatattgttgagtggccaagattttcttaatcataatacctgagtctaaaaccagagggacaagatagataatatgactggaagaattttaaaacatctgtatgttataaaaaggaataaaataatggcatttgcagcaacctgggtggaattggagaccattattctaagtgaagtaaatcaggaatggaaaaccaaacatatgttctcactcataagtgggaactaagctatgaggacacaaaggcctaagaatgatacaatggactttggggactggggagaaaaggtttgagggtgtgagggataaaatactacttattgggtagagggtacactgcttgggtgatgggtacaccaaaatctcagaaatcaccactaaaaatcttattcatgcaaccaaacacaacctgttccccccaaaacctgttgaaataaaaaaaatctgtatgtcaaaagcaccataaataaaataaaagcacaaacaaagaaacaaggataggtgtgtaggctggggactatagcattccacttcagtgggagacactgggagtcctttttctttttttttttttttttttttttttttgtaaaggacatatcatatttattcatacacatgctggaattattggtgcagacatttaaatacattttctttgagaaagtcctttttttttttttttttttttgatggagtttccctcttgttgcccaggctggagtgcaatggtgcaatctcagctcacaacaacctctgcctcctgggttcaagcaattctcctgcctcagcctcccaagtagctgggattacaggcatgcaccaccacgcccagctaattttttttatttttagtagagacggggtttctccgtgttggtcaggctggtcttgaactcctgaactcaggtgatctgcccgccttggcctgccacagtgctgggattacagtcgtgagccaccacagctggcctgggaaagtccattctttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcaggggggctgaccccccccacctccctcccgggggggctgacccccccacctccctcccggacggggcggctggccgggcagaggggctcctcacttcccagtaggggcggccgggcagaggcgcccctcactgggagtcctttttcatatgttgtgaattttaaaaaaatgtttgaatgctgtatccaaactattctccatgtatgaattcctcctaagaacatattgagagacatacatccagatttatatacaagggtgtttaatctagtgctatttataatactgaaaaatcaaaaatgtcttaaatatataaaaaggtattgattgaatgaacaagaatgcatatgacatgatggaacaccgtgctgccattaaaaactgttttctgataatatttgatgacagtaaaatattcacaacatactgttgaaacgtagagatataaaataatgtatagtccgggcatggtggctcacacctgtaatcccagcactttaggaggctgaggcagaaggatcatttgaggtcaggagtttgagatcagtctggccaaacatagcaaaaccctgtctctattaaaaatacaaaaaattagtcgggcgtggtggcacatgcctgtaatcctagctactcaggaagctgaggcatgagaatctcttgaaccctggaggtggaggttgcagtgagtcgagattgtgccactgcactccagcctgggcgacaaagcaagattctgtctcaaaaaataaaataaaataaaataaaataaaataaaataaaataaaataaaataatgtataatacatatatgcatatatacattttaatatagataggtctacaaacccttggagtcagatatgtttcagaaatcagaatgttctggtttttagaaggtgatattccatatattatataatacactgcagctaagatataaatattcaggaagatagggataaataaagactataaatagcctcacatctgtttaggtcagcttttgcctccaaaatgatttacgattttcagagctttctgaattttgaaatgaaggtaagggattgtggattatgcatattaaaaggattagaataaagatctctagggaggaatattggtgatttttatttccttctttatatgctcctgtatttttcaaaccttttaatgtgaacatatattatttaattagaagtaaatccaaaaaaataagaaaaagtggaagagacacaagcctaattttggaaaggaatataaaggcagtcaaaattttactaaagtctttcaaatacaaacaattaaaacaaaacctaaaccaccaaagtgtaattatactgtatcacctgcagcaacacttcctccaatgtttcctgcatacacgcttctcttgagagtcccccttatgatatcttggcagtctttgccccccacctgtaaaaactcagcctatgctgtttcttgtctcattggcccctttccttccttgcgtgggaatgtttctcactttttcaatgccaatcaatctttttcttccccaggccactcagaaaagatataaaatatttatcaccttatattaaatgaagaaagattacaaattaataacaaccttccacattaagaaacttagaaaagaagagcaaactaaactcaaagcagtcaaaagaaaggaaataataaatatgcgagcaaaaaaagccagataatagaaaaacaacaaagaatcaagaagtcaaaggtatcttttttgaaagatcaataaaactgacaaatatttagctaaactaaccaagaataaagaagagaaagtgaagattactaaaatcagcaatgaaagaggggcgtaactacttacccaaatttaaaaactcctaagggaatactgtgaacaattatgccaacaaattagataacctagatgaaatggaaaaaatattagaaataactattgaaactgactcaagaagatgtagaaaatctgaatagagccataagaagtatggagatttattcattaatcaaaaaattcacacaaaaggaatcttagtcccagatggcttcattggtgaattctagcaaaattttaaagaatagcactagtttttctcagcttttctaaaaaataaaagaggagggaacacttttcaacccattctgagaccagtattaccatgataccaaatgcagacaaagacatcacacatagaaaaaactacagaccattatcccttaggcacatagaaacaaaattctcaacaaagtattatcaaaccaaatgcagcaccatataaaaacattatacactatgaccaagtgaattaatcccaggagtatgagattggttaaacatatgaatatcaatcaatgtaatataccatattaatagaataatagacaacaaccacatgatcatctcaacagatgctgtcttagtctgtttgagctgctgcaacaaactaccatagactgggtagcttataagcatagaaatttatttctgatagttctggaggctgagagtccaagatcaagaccttggccgattcagtagctgataaaggccggtttcctatttcatagatgacttctcattgtgtcttcacatggtggaaggagggcatcttttataaggtcactaatcccactcttaataccttgtcacttcctagtaccatcactttggggtttaggtttcaacatatgaattttaggggtacataaacatttagtccattgcagatgcagaaaagcattgaaaacattgataaatatggactagcaaactaggaataggaggaaattttctcaacctgataaaaggcacctacaaaaaactcacggttaatgtcacacttaatggtaaaagactgaatgccttctcccaaagatcaggagaaagacaaggatgtctactcttacgacttttattcagcattgtattggtggttctagatagggcaatcagaccaggcaaagaaaaaaaaaaaccatctacattggaaaggaagaagtaaaactgcctctatgattgtgacatgaatttgtgcataaaaaattataagttgtttaccaaaaaacaattagagctaatagatgagttcagcaagattgtaggatacaagatcaatatttaaaagctattgtatttctatgcactagcaagaacaattcaaaaatgaaatcataaacacattacaattcctttacaatattattaaaaataaaatacttaggaataaattcaataaaagaagtggaagatttgtacattgaaaactaaaaaacatcattaaaaaattaaatacctaaataaatggaaagacatccagtgttcatggatcaggagactttggtaaaatgccagtactcatctaatagatcaagagatttaactcaatccctataaaaatcccaacagccttttttaaaaatagaaattgacaagacgatcctaaaatttgtatggaaattcatgggacccaagataactaaaacaatcttgaaaagaaagaacaaagctataggacttatgcttcccaaaatcaagacttactacaaagctacagtaattaaaacagtgtgatatgggcataaagatatatatcattgcaaagaatatatatctcaatgcagaattgagagtccagaaataaacccagccctcacatattatggtgagttggttctcaacaagggttctaagaccatgcaatgttggaaaagacaatcttcttaacaaatggtgctggaagaactgatatgcatttgcaaaggaatgaagtgtggtttttacatcacaacatacacaaaaattaactcaaaatcaatcagagacttaactgtaaacactaaaaccataacatacttagtaaaaaaaataagagtaaatctttgaggccgtggattaggcaatggttttctagatatgaaaccaaaaacataagcaataaaaggaaatattgataaattggacttcatcaaaatgtaaaactttgtgcttcagagggcaccatcagaggacaacctataaaataggagaaaatatttgcaaatcatacatctgttaagggtctagtatccagaatatataaagacctcttacaactcaacaatagtcaaattacccaatttaaaaatgggcaaaggatttgaatggatatttctacaaggaagatgtacaaatggccaataaacacatgaaaagatactcagctttgttagttattagggaaatgcaaattaaaatcacaatgagatatttcttcattcccactaagatagctataatcaaagacagggacaacagcaagtattggtaaggatgtggaaaaattagaacattcatacattgccaacggaaatgtaaaatggtgcagctgctttggaaaacagtctagcagtttctcagaaagttaaagatagggttaccacatgactcagcaaacttgcctctaagtatatacccccaaaaaactgaaaatatacatccacccaaaaacttgtatgtgaatgctcatagcagcattactcatactagctaaaaagtgaaaacaacccaaatgtctggggctgatgaacagataaagaaatgtggtatatccatgctgtgaactcttagtcagccataaaaaggaatgaagtaatacatgctacaatatggatgaaccttgaaagcatgctaactgaaggaagacagacacaaaagaccatatattgcataattccatttaatgaaatgtctggaatagagacaaagtagattggtgattgctggggtgggaagggggaatgggaagtgactgctaatgggtatggggtttcttttggggttgatgaaaatgttctggaattagatgatttgatagtagtgatagttatgcaactctaaaaacatattttaaaatattaaagtatacactttataatgaagtatatatttcataatttatatggaaattatacctcaattataaaggttcagaaatatatatttattgagcatctactgagtgccaggcactatctaggtgctgggttggccaccatgtctaagtccctagctgatattctagactggggataaaacagacagttattgataaacaaggtagtacataatatcctaagaagaaaagtataaaatatgctaagaagcaggggaagggacagagtgatgggagaggtgtgccgttttagatagaacaaggtccgtcaggaaagtcttgctgacagggtgagaaaaacctgagatgtgaagggagtgagtctggaactctgaaggagggaacaccaatgaggctggggtgggcctggggaggaggctgttatggatggaggaaagtgaatggataggggggtggtgagataagaaaaggtgtgtgtgggggggagtggggggtggtgtgtggcagcagtagcagggactgattgtgtagggccttatagtctgtaaataagaactttggtttggattttggattttgccttggatgcaatgggaagccattggatggttctgagcagaggatgaacataatctgatttagggcttgagagacccctctggctgctgtaggaagaatagctagtagaggacaagggtggaagtgaggttgtcaccagttaggaggccattccaagaatctaggcaagaggtggcggtcacttacaccaggaaataaaagcagagttgggaaatggccagattctggatatgaagggatgcctctaaatcgcctcttgacccaatacctggatcaagcaacaactgtcccagggccacctgaacgaaaactagaccttccttgtagaaggtgtgtttcagaggagttggaagaagacagagaggctgtggctcacactcatgtgttaatactttttgagcctatcactttccctcattgatctattgaacatttgtgtgttcttccgaaataagtggggctcgatatctatccacgatccagaggctcctcccattcaagtcacgcctctcctttcttctgcttttataggctgggtgggattcttttcaggtgccagattccccttaggagctggaaagattcatgtgggctttggtgggaaaatccacctttgcttgttaatacttggcccatttcaattcctgattctccaagcagtgagtgctcttccatcctccttcaggctctcattgcaaagtgtctccctgtgaccctgagcccacgaataatccctaatcttgcaccctgcagaccctctcagaatatctggccattaaccacaggatgccatttaaatggtgtgtcctgacagtgtctctggtttctgacatacttccctccccaccccatgaagtctccagcttcttatagtctctaccagcagttaccataaacacacactggttcacaatgtctccattgattgcttttccttgtacagggattatgcctctagaactcaagaaaatttgggtccacaagggcttgcttaagagttaatttccaattgcagttgtgcaaacatgattctcagacttcttcattttagctaattcatgtgggaggtcacaagcatggttctctgcctgggacatctggtcctaaatggtgtattatctctggaattatgacatttctcatcgtggagtgttttcatgtttagttccaaggtggtgatttaatctgaggagcagctgagaactaggtcttagacagttgcccctgaatgtacccgtcacagggctgaactgtctcaaatttcatctcagaaaaatgatcaaacatacaaagaaaaccaaaacaagcagacagaaaacactgtgagcctgatatctaaaaggaataaacagaaaattaaatctttacagaagcgtctgctaaaacgccgaaaaggattctaaccaaaacttacagcaaaactaaaaaatcctttttccctacaaatacctgtgatagcattgtagttgcctctcccaccattgatcttgttcctcattgtctccaaagaatctcaaactctctaaaagcccaccatacgtgcctttttctctcccttcctgacccccaacccacgcttttccgggtggtgcctccaggtctctgctccatgcatttctctgatccacacaaccaaaggccaggcctgtttgaacagcaaagatttttttttttttttagaaacaatagaaggaggctataatcattcagaaattaatttttcattctaatcctgctgtaagagttgtgtttcatcatagtgaactttctcctatgttacagaatgtagaactatctcaatggggcaaggacaagaagtacatgctcgaaagctgattcagatgtcaatgcagcaggtatgtgacaagagactgctcctgctgcaacattattgctagaaaccccacaatcatggatgttaccacattcttctcgtgatgctcaatcctggtttttccatttttgtttatcattacctgtgaattttaaacctcagtctagtttcctcctgatattcgcatggaaagcttattccattttctatagtatatgctccattttaccttcaccaattttttgttcgttttatgatttgggagacacaccttctgatttctaagaatgcatctctagcagtcttggaatttcatgatcaatatgaataggtagtacttaaggagtgacagattgagacagttaaatttccattttcagttaaaggcagactttcatttttcattaacggatcatttcaggcaaagaaggaatatttaaggatgctatgtttaaatactgataatggttttcactaataattgcaagctgaatggagtgttgagagagatttcccatcacacctaataaatacacaggacattaattttctagaaatgctctgtagatagccatttcagctgtaataagaaattataccatttataaaaataaaataagatattggtttatttttaagcttttgatctcagaatgtctgtacaaactttggtgcagcttttccctgggaattaatgactagagagggttaatgggctaaaactctgttgggtcatcaacttttccagctagtcattaattctcaaatgccctaagcctcaatctttatcacttaattaaattcaataatttatttaatttatacatgtatatctcaaagcaattatacataattatttttactcggatcaaatgtttcactctattgagtgatttgacagtttaactttgggccttaaataatttctttagtttctgtgggtgcaaaactttaatttaaatacggtgttcatgttaactgtctttggaatactagcctttataacttccatggtctgtttgtcaaagtggggtaagtattgattatatggcataatcagaaaagaaaaccagacatgagcaggtgcagccatgttgccgccttgagggacaccatgtttagcataaagctggcattgtggaacacagagtggggaaccagaaagtaagtgggtccatgatgacacaaactaatcctgaatgctgttttcctctgaaaccccagttgtatagacggcacatcccctttactagttaagccggtgtgagttgtattttcgcttacagttgagacatggtatatatgccttgccatatatttatcatgctcactattttgtagttttatgtagttcaagatagctgattcctgtataaaggtattaaaatgtctagtaaagaaactatgttctcacagggcagtgatggttttgtgacatattgtttaaggtagtttgtttaatcaagtatttatttagaaagtgcttaataagttatgtggtttcaggaaagtgtggagagtgatgataaagaataaagcttagcattatggtagtaaatgtcaccaaacgtattgtctccagctttcatgagatcatgtgtatctttctttgtaactatgaataactgtgaaccagtcttctgggttttgggggtgagtcagttctgatttaccttaggcaggacaacttgttactgattccaaaatacccgttcccaccattagatggtgcacacactgtacttacacaagtctgccttcaagttttaatttctgttcctttctgaaccaggggtggcagaatacaatcattttgaacccacttgattctaagtaattagcttgtaccaattacttgtaccatagcaggagaaatgattgtattgacatataatttttaaaaatgtgttcaaaacagagtattcacatggtttttaaaaaaagtgcacattttgttttattaaaatcatagcaaaaaggttacaagaaataaatatgaacttatttttggatacagggtggttgggtattactacaaaattgccaccttggcctggaattcatggaagaattactagagacgctaattaccactgaagccagtgatgattctttccgagtatggataactacggagccccatgatcgatttccaattacattgcttcaggtttgttactaaacgtcttttcatcgagagtcatagtaataaagatgacatcattgacattgttgaaagatgggaacacaacagggctttttggtcctgtagggtctggactgcaagatcttatactataatactataatcatcaaaatcttgacatcaaggttagactgtagtaaatatttccatagaagagctctaagacttagtactaatttattgagtttcagctctgatcaatgtacttagtttatacaatgctgaactttgcccccactttatgtaccataagcatattgttttctgatatacaggttgagcatcctaaatctgaaaatcgaaacccgaaatgctccaaaatctgaaacattctcaatgccaatagaatgctcaaaggcaatgctcatataacaatttaatgctaatattccaaaatctgaaattcaaaacacttccagtcccaagcatttcagataaaggatattcagcctaatattgtaatttctattttattctttatagtaatttatagaaacaaaagcactgttttcttttcatgacagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggtaactgcagaaagcagttttcacatttaggagatggccagtggtgtgctgaggccccattggagaggcttccaggagggtgctatccgttgccgctctgtctccttactctcttttccttcatagcactttccccacctggtatagtgtatatttgtttatgtattttgtgtgtgccccctgccccaacccccaaccctgactattggaatgtaagattctccagggtgaagactgtcttttcgtaactgctgactctcctactgtcacaacagcacgcaggggattgtcagagctcaataaatatttgtagaatgagctaatggattataaagataggagcttggttttgaaagtgcctgtgctggccaagaattttatgtgcaccatctcctgtaatactaacaaccacatttcaagataggattatcaccatcccaaagatgttaagtactcttcaaatgtggttgctaggattggctgaactaggattggctggctctgatttatgtattgttttgactctatttattacctgatagtaaaagtggtggtgatgttggaggaggaggaggaacagcagctccctgtctttctcaagtcatttgctgtttgcttttacagtcttagtactgacgcagtaatttaataattttatgattaccaagcaacttgtctgttacgattttttaaattattgttagtgttttgttctgcatctgaattttatattttgttctgtaattcaaaagctatacattttcaatgcactggatccattccttgatttcacagagaattgaagagattcctttaagccctacctggagttctttctttcctggggttggggtgaaggacaaaataaatcagttggtctatcccaggagtcaggcttttagctgtgtacagtgatgggcagaacttcacattacctctccctgccctgtccaaagatggaggggaacttaatgctcatcccagaaaatactgtgtgtatttacccctaattcattatccctaccactttactaggttcctggctgcccaggagagggatgtggtgtttgtctgcctcccaacactgagaaagttaaaatcagattaaatgctttgctggtggttatctttactaagttccattgtggcctttggattgtcaattacagctttcaagtcacagaagcctatttcatacattcttatctgggaattgttcgctttgctagaccttatcacatcctaatacaaatattgctttaactctgctatttcattcccaattcacaaataatattttatgattgtgttcccagtagtgatgattcaactcttccactgtgcttatcatggagagctggttgggggtatttgccatatggttaatgtggcaacctgtgtttttagtggccattatccaagtgctaaagggaagaagagcaacaggaccatggtccagccatggggctaaagtgcccttgcacttaacaccacatgtgtttgggttaaaacggaggaaaaatattttcactgctagggcggtgaagttaccagtggagtgtccaggaataaaaggctgaatatctcttaaaatcaaataatagagggctagaaataacacttcactaagagtcaggaggcctggactttcgtgcttgctgtgaaatcagttagctgaaagcagttagttgatcaagttatgtctctctcagggcttctgtttccccatctgtgcagttagaggcagaagtaggtgatctttcaaggtttttttcaatttctaaaattccatcgcccaattctgtgacaatacagtgagtgtaggtaattctttttcatcaatttcagaagtgtttactgtgatatttccaaaatctcctgggaattttagacatatgtttcagaaatatcacagaagtgtttgctgtgattttgtgtaaatattttttttacttggttaggatagggacagcttgatagaaaaatccaaaattcttcagagacttgttgtcttgggccagaagcatcaacatcacttgggagcttgttggaggtgcatgtcagatctcgcctcagactctcctaaatcagtctgcattgtaccaagatacctacatgatttgtatgcacctgaatgtctgagactcaactgctataggaaggaatgttgtggattagattgtttgtgacttacgtttcttttctctctctagtgttgagtataagagccaaacatctgatttgttaattgattaattgagtcctccaaattaaaacaggtatccgttgctttaaacaaacatgttatatgtacttttgttcttgcagagacagactgaaaaaagaattaggcacaggatctgaagctccagaggggttcatgctggagttcatcccacattacaatgcagaacccaggagtaaaatagccaactccctgcctgctctccagtaaaaaatgtaaattctcccttggaatcctggtttgggtggcattatgccatcagcttaccccagttcataggcatgatatgtggattctacttcagttgcagggaacaaaatgagcacctctccttttctgggagaaggggaagtaaatttggctggtcaaggataacttgggcagaagagtggtggagggcgtggtttgctttattcttgaggtgggagcaggctttcccaggaggagggtgccctgggtgctgccatgggaacatgcatagatgcacgaggcaacgccgcactaagctctgctccctgccactccccttctcctccagcaacttactatccacacagagcagtagcagctaccctgagaggggaagttactgctgaagcccccacccctgctgcagtccagtgatgtctctgcttttgccagtggcccttctgccttccttatgggagccttttattcccaggaccctggtgtgtgcctgggctcggtttggctgccactccctgagaatgtttcagcatcctcttgaagattacttaggagggaagcttctctctggcctcggtattctgtctctgtgctttcctgggtggtgtagcatccagtgtagcatcgttctgggcttgagagcaagcccacattcaccctttgggattttaattttaagcacattttcctccaaagtcttagtcttttgaaactcaatcattacatttttagccacttcctaacacctcctgcagaagatcagaataatgttctatgggttatttttttcctattgattgtcaatgtgccactctttgaggtgtgtattggaccgagtaaatgtcttaagtggtcttctcagccaattatctacaattgtcttctcagccaatgcctgggccccagaacaggacacttaagtcaaaatccccaggaggccaaaaggaaggagctcagtctttttaaaaacttccaagtgatcctgatatgtggcaagaattgaaaataatggccaaatggccacaacccttaagggaagagtcttgaaccacttttacatccatttcatagtctggagtttttctccccatcaccttggtttgtccacattgaactgcgtatttctttatgacttttcaaacagcttatatataactctgtgaggtgaggtgctcttttctttttcatttttcttttttagctaaagttattgattaggatctctaagggcctatagtggcagttgcaaacttggaaattctatcgtggcccttaaaaattacttagatagtaaataaaaggggccctatcaatagggcccagggaatctcactattaacagttcttcattcggaaaagtgtttgcttcccctacatttcgttttctttctcaagtttgagccttgataaacattcctttcaaatttaatagtgcatataaagttcttgctttggggagagatggttataaaattcctcatttaaatgtctttgaatgattatggtaatatgatactggtttatcttttacactctgccccatagtgtttcccagaggttctggctgcttctgtcaactatttttacctagtaaagtttcccttacattgtctagtgtggcttgtatttttctttgtatattagctccagttattggagttagacagttaactccagttgtctggttttgaagctgtgaaatgattctgcagctctgtgggaactgctgaggtagaacctaacgtaaaattggaaatggctctgacatcattaaaatgattgaacaacttttcatcagtgttctaaggagtttttcatgattccacattttccatatttctctagtagttcagagttttgtatattctgtgaaatgaaaagaagaaactgtattaatcaaattaagtagggagtggactggttttcctaaaatcatcagtcaccatcttaatgatggacagtcctctcccttctgtcgaatgaagttttaacattcaaatttgtctgcattccatgtcttgaagcacgtgaccactgagttgctgctactcaccagaactagcccgctactgcagtagaaccttctgtctgcagcctttttctccacaagtcacaggatttgtgttcctagttttgctcatggcctttgccaagcctggaagtctcttctctcctccttgtaaagaccagcttcagttttattcttcccagaagcctctgattgaacgtctccttcaggcttatcattgtgaaattttgacagttaattatattcactatcccattattctttttcttgtctccaagtcttatttttgcaacagattaaaacttcttgaaaatgcatcctttttgatattttttattgtattgcataggactcatcccatggtttcaaaaatgttaattaaactgaagaaattcaatattccaaataagtccagcaaaaccccttgctttgatcttccaaatgagttcttaggttctagttgtttgagtctatcctgatagtattccaaggtaatttaaaaaaatagcaagaagatgaaatgacttcatttgtgaaagaaaaggcacccactaagattttgggctttttttcccaagatgagctaatcagtttatgactttagtgaaccaacttaaaaagtaaatgctttagatgaaaattggtagtaagaaatataaacatgaagcaaatctcagcattagggcaattttcaaaactcacattttaaagaacaactaaattgcagttgctcagtgcatataaataggagtgtttccatagagtcaatttgagcagctttagtaattggagttatttttcatttggccacccatctaattgaacattaaaatttaaaaattaaatcaaacacataggtaaaactaatggtataaattctgatcctctttttcaaaaatgggaaaacattcacatttcactaataagtcattagcattcttctcttcaaagtcctcaagatggaagaaattccaagaactaaaacggttagctgtatgaattttcatgttaatatcccataaccctctccacccacccttgctcctggtataatctggaagaggctcacctcaatgtttctgagtccacttcagaaattccaaacactgggtgagcctcagcattgacctcttacagagaaagggttccttttgccctggtaataatcgaccagtgtttattaggcaaccatgattctttcccccaaggtgcaaaaggggagacaaaaatagaagacgtgtttttcactgtcaagactcaaaatctggttacaggaccacatatatcaatatgaaacatcttaaaaaacccacaaaacaaaaaccaaggcaacatgaatgctgggactaggaagcaggaagctgtcaagagaagcaatgttagggaccaaggctcccacccttgcacctaggaccacacagtctctcctcccttccaggctatggcctctgctcctcctcacctcttctaagtacagggtggaagatggttcttcacagctcctgagtttacaagttttcttagtctaagccccagataacaattacaaaccctaagtccaaattcctgggagaaggggtctggtcagttctttttgggttggctgtctaccttggatcaaattagctaagggataggtgtgggtgtcacatagcgcaaatctctaatgcctgacaaccttaactaaagaagtttaggtctagaggtaacagtagtactttacgtttttaagagctactcctattattattattattattgttgctcttagtctgatctcccagggtcagaacatctagacccaaattaatcttaatggtttactaaatactttaaaagcataccctgaaactcagtaattcaaacctttgaattttctgaattccttctctgacttgttcatgaacttgtcccaacaaaaatttatttagatttttttttaaatggtggaattattcaggatcggaatcatggaacagctgcagcaagaaggattggaatggcttgtgaaaacggcagtgtgtgtgtgtgtgtgtgtgtgtgtgtgtgtgttgagttggggaaggcagaaaagaaaaagaaaagttagtatatacttagaggtaaaagagtagaattaaacattcccatagatgtatagggattctactctccacatgagtcctcaccttaggcactagaattagggtctaggaactaatctaataaatccctggcccttccttagagactgattatgtgttgcgataggaaaagctgatgccatagaaacatctggactcatctatgtgggttgttggatcatcaattcttggagctatcaggtctaatacttgccatacctttaaaatgctctctggaatatcaaaacaattgaatcatttgctctgagtccagtttgattatttattggtgatttgacaattgtaaacagttagccactattgcacaggagtctcttaggccctctttgattaagtagagggaaacaaatgagggtcatgtgaaagtttcaagacagacacgtcatgtatacaacagaaatttttagttttcaaaatctgaaatggcaagattgcaaagggaagccatcacagaatctaagtgctcttgagagaggtttagataatccaactgaaaaaattcaaacccttgcatttgacatttcaaactttcaagagtccattgtagaataacagttcattcaacaggtatttgttgagcatctactgcattttttgagttgtcagtggagacctagactttttttaaaacccaagaactccaacttggcaaatctttggagatttctttatataaaccccttagctatagagccatgaagtaatatttctaatatggctatatgccacataacgtttcagtcaacatggattgcatatacggtggtggtcctgtaagagtataatgtatttttactgtaccttttctgtgtttagatgtgtctagatacacaaatacctaccattgtgttacagttgcctgcagtattcagtcccgtaacatgctgcacaggtttgtagcctgggagcaatagactacatcatgtagcctaggtgcgtataggctgtaccatctaggtttgtgtaagtgccctctaagatgtttgcgtgaggaaattgcttaatgatgcatttctcagaaggtaaccccatcattaagcgacatgaatgtatatccaaaattgtatatactattcttttaaactaatgtcaatttattttgataatatagccttaattttactgtattttgatagcaataaaaatggaatcaggtacatgcaatacttacttttctttggtgtttttaaggagcgacgaaaatttggccccttaggatggaatattccctacgaattcaattctgctgacttttcagccagtgttcagtttattcagaatcaccttgatgaatgcgatattaagaaagtgagtgaaattatgccttttttcctgtttttattgctcttcttaaatcagggttctacagtcatttgaagtctatgataaggtgtgaatttgctgagccccatggagccccctttgaagggacttgttgctgtaatcaggcacttgctggggcagcctgtccctgcccccaacactcacatacctctgaagctaactaactcagtgtgttgcaaaataccgcagccttcctcatgttacactcagggaccacagtgcacttcaagagaaggtgtgctttaggtcaagcttctcctcactggtcctactcctgcctcctcagaagtgaagatggtatctgcctgcccatgcgaaagttctttctcaccttaagtcacttcttaactgctcagcttatgcatatgaataacaatactttctagtaatggtcattcatcatcatatgacactttgcagttttcaaagttctcatgtgtgcaggatctcacttttatcttcacaaccctgtgagatcaataaaaaaggcattattatttatttatttattacccattttactgatgaggtaacagacaggagagactaagagacttcctcaaggtcacagagctgagaacgtaaaatctgttgtcctttcacacatataaagggttggaaatttgttttttctataatctttggcaagttaatgagccttaaagcctgtttcctcatctataaaatgaacattgtttctgtgaggaacgaatgagttagtatttgtgaaagcacagtacacagtacctaataagagctcattcaatatgactctctgcagtctggccccctcttcttccacagagtagggcttcaaggtaattagagattctgaagcttccgtaatggggtggtaagccatgatgagtgtttactctagtaccaaaccgtcatttttccttgaaatgacaaagggatatgaaattaaaagtaaggcagtctgatgaaaagttatattctatgtgttcatattctgtggtcatttatcattttggtacatacaaataatagttaccttaaaatagttgctttgaaaggcaaccaagctgaaaaataaaattttaaccaagaaaaagtaaacaaaaagcaaatatccttatttctcgtaactcaaatgtatcaagggtttaaagaaactgctaaactgcaatatattgctagtataaaattgctatagaaattaataaatattttgatgtagttttagcacatagaatgagatgcagaggatggcagaggattgcattgaggaaaaatcttgtggataaataattttcttgttgttctcgtaatgattccagaaaatacattactaagaaagcgtattaaagcaatgattacttgatttttctccttttttcactaaacaccactttcctcctctgtaacagcttggcattactacaatgagtattataggtaattatatccccagagtgaaaattagtctttttccctattttaaataatatacgtgcaatatacttaccagtgtttagtattgtagattttttcttggtgaacaaactgtagtggttccagccatgtaatagtgaaagagttattaatataagacgatgaataattttaaatgtgagtctagtgagtgcttccttttccagacctttcctctagggaaagacccgaaatgtttataatgatgtgtttgggttgacaattaataatccttttttacttttaataaagggtgtatcatggaatacggttcggtacatgatcggagaagtacaatatggaggcagagtgacagatgactttgacaaacgtctacttaattgctttgccagagtaagtcaatttagaaaaataaagtttggagacacatttcactgtattttccaatttttttgtttgtaataggtctgccaaactcaagcatacagcagagctgctgcaaagaattagccaagaaacaaatgcatgtgtgcgcttacacacacgcacacacatgcacacacacacacacacacacacacaacaaccagcaattgggccaggcatggtggctcacgcctgtaatcccagcactttgggagactgaggcgggcggatcacgaggtcaggagttctagaccagcctggccaatatggtgaaaccccgtatctactaaaaatacaaaaagtagccgggcgtggtggtgagttcctgtagtcccagctacttaggaggctgaggcagaagaatcacttgaacctgggaggcggaggttgcagtgaaccgggatcgcaccactgcactccagcctggtgacagagtgagactctgtctcaaaaaaacaaaaacaaaaacaaaaaccaaccaacaatctacttgtggtgcagagcagagcagtggtcagttctcattgctctataactcctttcccatgtagatgaaactgcttgtgcccagggcctctcccccactgcccctcctccatcttccgcattcctgtgcacctcacttgtgaggaaaacactggccatcatttctctgcctctttctctgagtgaaagtcttatggtgatttcaagccccaaaataagtgattgggggattaatcataatttgagttttctcatctcttctattaggatagacaattggaaattgaggaagtgttcactttttctctgtgccaaataaaatccacatataacatgctgataaatattttctagagaaaattgtttattagcaattgtggctttcacatcaaggatgaatgtaataaataacacctaccagactcaaactcttcttaaaatgttttacattttagggaagtaatatataacacctaagtgagaaaaaaccagatgtcttttatggttattaaattctttatattggaacctataccggtaattctctacttaaatgattcttttttcttgacaaaattaaagcctcaacaacaaagcacaagctttgggagtattttgataagctgggggttgactagaaaacggatttttaacctttacttgttttagcaagtttttcttgaagctacatatggagaactgtgaaaaataataagtgttggtgagaatgtgcggagggaggagccctgctgctgggaggtcaaatggacacagacctcctggaaagcagtccagtaatacttactgaaattaggtatctcaggtagacatatctcagaacatttctagaaagagtccacaaatggacatgtacaaaaatattcatggcaacattgtgtgtggagctgaaggcaagcatcatagatggttttcctggaagcagaggtggagatttgcattcaagtgcctcctccccagccttcctgcaagacatgaccttggctgaagcagctgcctcctgctagggcagttcctggggagggacaatgctgtgagtccacagtagccaacactccagacagcggtggggagtgagtacctgctcctgaaagaggatcgagtggcacatcatagcatccactacaaaaacctaagactcctaagagaatagataagatgtggtgggtgagcaccatggcatactattgctcacccttgtggggtgcaacctgttagtcatagtcatatcaagtgtgtgatacgactaccttctgaaccagaatcctgctcctgagtatatgtcccagagaaattctcagaatgtaccaaatagattattcatagcattgttggtggtagtgggaagttgaaggcaacttaggaatccatcatggggaaatagttaagttacctgttgtagaggcctatggtggcatataatgcagcacttagaagcaatgatctatacgacatcatgcataggtcttacaaacagtgttgagtgcagagctttaaaaaaaagtaaagtgagatctataaaggaatatatgcatagttcacaaggataaatacatgttctaggacatatatcaagtacacttaaatagatgccctcagagggaaaaggagacagtgaatggatatcagggcagaatggggaaaaattaaaataaaaggggcctagattcataaaaataataaactcgggagtgtgagaaactgacctctgtatttgagattcaaaggagaaaaaaaaagatgtcttaataagtatactttgttagaataattgtaaaagtatctaaaattggagttttagcagcagagactaagatgtggttagcttcagaatataattcaccaagagtaacagcagaatgctgatgggatcaagtgcgtgggtgaaagaagaggggagtcaaggtcatccctagttttgacttaagccactggacacagaatggggctatttacagacaagaggaagggctgcagcagggaagagttttattggctggggctggaaattaagagtttggttttgatcatataacatttgagatgtctattagacatccaaatcaagttgtctcagactgtaactgccatgagggcagggactttgtcttattacatcagtgccaaactctgagcaccagaaacagagcccaacacatctaagtgctcagtaaatatttgttgaatagaagaacgaatgcatgaatgcaggtgaacaaggcacctggatgtacagatccggaggtcatggtggagctcaggcatggagataaggatctggaattcttcagcatgtagacagtggcaacggaaagctgctgtgttggtccagagcctccagggagatgtctgagccgggagcacacggagggggaggaagaagtgtcgctgtctcagcctgctccaccttcaagagctcaagcagggggattcccctctctgacccctctcctgcctttcttcctcttctacttcttccctgtaccctgacatttggcattttgggccacagaggactagtgagctgacttcaaccctctcctagaaacccaagattctctgtcctctgggcctgggatgtgcagacttcctgatctaaaagcacagggttccatatccaggccccagttcattggctgttcccaagtaacagcagctccctcctcacctgagttattttactcccttctatcatctgattctggtttctctggactccattctcagcaattagtgccttaagtcaaaagttcatcttactattttcccattcatttgcccctgagtggcttctgtgggctcattccctccccctctctcaggacttccctaagagtggcacaaccttcagtggcttcaattctctgactgttggccaccccacttccttatcctactgaatcttctctttgccctacatcctctccaacctcctgtcttgttgctttccctcattcatttctctgtctagcttggacctgtttcagatggtcatcaataaccagaggtgagtttgggtctctggccctaagggcatgagcttaccacatgaacctggcagcagcaaccctcttgagaaaggctgcacaaaagcctcacagcccccacaccctgccttcacctgtttgatctcatcctcagccccaggcttgccttctgaccagccacctgcctgcactacctccactttaccctaaccatgtcatccagagttgcccatgggagaagcagctccactgtaaactcacgcctgcacatggcatcctctgtccctctgactttcaatctcgggcttgtctttgaaccttgttttctctgttctcagcatcttacagagtctctctgctaaaagcgattgcagaactgtattggatgttcatggggtatgaccgctcacaaagtagctccatgtagatttcatatttcatattttgactttgcccccaaatagcctccaaatttggtgaaactcagctatttgtatgtgtataaagtgctgggaaaatagtaagaaacttcattttggtcttatacatacatgtcatctgacaacacagaattcagtgtggttatttgttatctgtgtgctgaggacccagggcctttgcccccttagggtgtcttcctgcaatttaagtcatccacgtcgtgaaaaatctaatatttctaagtaatgaccatgctcataacactattctctttaataactttcaactactctccatttcttgaattaatcaccagtcctcaccctgacatcaatagtcatccatgatatgacctcacctcacttttcctgtcctatctcttatgactacattgtgtccaccctatattccattattcccttaacctgcttctcatttttgcatcagttctataactttgcttatgtggcctccccattccaagttctccggtcaaactcctctccttcaaggcttagctccaaaaatcacctccttgagaagacctcagctgacatccacctggatgttttttgttcctgctttaaacctctttagtactttgcttatttttatttccttctgactcttgccttagtgcactttgtattgtggttattaagtaattggctcatccctccgctgggtcacaagctccttgaaagaaaggactgtgtgtctcttatctttgcattctgttctggttctaaactcagcctgctcatgcataggagttgaataggataaaacagagagaatcagtacacagggtatttcagagcaatcactggatctaaaaagagctggaggaaggagatggagggaaggtactagagaacgtgtgaccaaccagaggaaggcaccgtccctctttcctgtcaagtgctccgagtaattcagacgtcgtgcctgcatttccactcttcctgtcttcccattatttccttccccactgggaaaattgctgtgagacgtaagtcattgcctcaaatctggctcataggcatttagcatcatttttttttcctttctgagaataagtctattcacaccaactatatatttgttctctcactgttttgttaaagataattcatatggaataagaaagggatgtcttaaggcaaacagcaaggcagctgaatacatttacttcatgtggacagggacataattagcaaaggaagctcttcaactcaaggtgggaggggagagtttgcatggagctctcctggccgtgtgctggggctcattgctgtgtgagtgaaactgcgcacaagcacatccttctggtatgagccccatgtcggggagaagtggggtgatgaaaatgcccagatattctcttgtgtgtgggagtatggcctcacagactttgcagtatgttcctattcctaaaatggaattgagggttgtcaaatgactcaatcagagaatgggcatgtagagttgctctcttccttactcttggtgaatatcttctttggtgttaaatggaggccaggtcaaattgtgttctggactctctcttttctccatatatgtggtaattattctatcagtagtattgttaaagcattctcaaaatcaatattaaaaactctgttaaaatggaaataaggtggcccctctcctttcttgtagcagttttcatttagatgctcatcaattttatttcttttgttttctctcacatacaggtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtaagtccctggcattttttaatttgaaggggtcatttgtaactcagtctggcaaagatggtgcatttcattttctctcctaatctctctcctttccccctttttttattttactgtgaaaaatagtgtcgcttcctgtctcccaattacaactttgtcatatcttggcctgctctcctctcactaaatcctgatgctccagtgtttatgacaacgttaagctctaatttatgcattgattatttcttctctgtcatgtcataaaacgagttggtgttagtggtagcagtgctctccgccggcagaagagtggtctgccagctcctcatctctttcttcaaaaattcattaagaatataatgctcataaatagaatctaaaaagccaggtgagaacagatgggagggtgaagaatcgtatttctgcctggtcctctctttcatggcccctctccctcacttgctcatctgcatccttttgtcatgcactgcctgtggtgggtgcagtgcggtgagcacttgagtacccgacacagatgcacagccccgggaggaaagagtggaggggctcagctttgcgtgaggtccctgctccactcatcacctagagaagaaatgctccccagttccaagccccttggcatgaggtgtcaccccttctctctttaggatccctaccaaacccaagcacctgaactggaatcctttggaatggaccgcatgtcctctgcagccccctgatgaaaagtcacaaggtttacattcaggaaaatggtttcaggaagtggaagaaaccaagactcctctggcagattctaagttgagaatgccctaagagtggggcattcctctctcctagtccctggcctactgttgtaattttaataattctctgggtttggacatggacatttccctggccttgccagatgtcccaggagtcccagtttgctgccaatttccttgtcttcccgcctctgaccaccctcctagctccctgcatgaggatgcacttttggcctctttacacccaccttgattccaccttcttcatatcctctcatctcgcccaggctgcttttcatcttcaaagatgcggacatgattgaaaatacctacaaatgccaatgcttcattccacccccatgatggaaccacgaaggttcgttagtggcagctcttgctgttatctaaggaggctttcataagttatctggggatgggaaagaagtgaagaaataaaaaggattcctcagggattggattgacaatcaactcttaacgttttatgaaagaggagcataggaaagtagttttgctttagctgagactttaaaaatgtgagtcagaccacatcaacccctgctcagaatcctcccaaggttcccgtgacactctgagacaaggtcaaagaccgacagtgacctacatacagatgacctacaaagtcaaatagtgccactgccctctacctccccaccctggctctttcagtcctctcccaccttcgtgcccactcagctcctgttactcaggccagacagcttcctgttactcagacaggccagacagcacctgccacaggatacttgcactccctggaacctccctcctcctagatatcacagtggctcacttttacctcttctagtctttgcttagatgtagccttttcaatgatgccttccctggctgtgctatttaaagattgcaacccactccccaaaccctgcccaagaccttgtcctcctgacctgctcttctctatagtttgtatcacccactgacatactctacacttttttttttttgccacggaatttcgctcttgttgcccaggctggagtgcaatggcacgatcttggctcaccacaatctccgcctctcaggttcaagcgattctcctgcctcagcctcccgagtagctgagattacaggcatgcaccaccacgcctggctaatttttgtattttttagtagagacagggtttctccatattggtcaggctggtctcaaactccctagcctcaggtgatccgcccacctcggcctcccaaagtgttgggattacaggtgtgagccaccgcacccagcctcatactttacactttaattactgatttgttattgtccaacaaccaccactaaaccataagttccactacacctgaaacttttgtgtgtgttttcactgctgcatcccttgtgctatagcagtgcctggggctcaggaagtatttgttgactgatcagtgctgctaaattcttctagagtgtgaaggatgtgatcaatgaggagattccatagaaagatcccacaagttcacgtgagtggacagagaaagaactgataagtcttaatgcacttgcaaatttgtgactgaaaatgttctcatatgagggctctgaactttaattccatccttgacaagagactggggagtcacgagagctggttcctggataatccacaggatcccaacaagatgaaaccatttcaccctcacccagggtgatggtgcacctaggccttgttcactgcaggctgtttcactcaccagctctcaagaaagatgaaacagggctagaaaaggtccagagaagtacaacgcaaatgtaaaagcaattggagacaaagacaaagacaaaccattttttccttgactttttatttggaatgattacaaactctcagaaaagttgcacatacagtaaacattcatacgctccatcgagatccaacaattgttcatgttttgatccatttgctttttctccttctatatttatatctctgtatgcttatgtatctacagctatatctatgtataatcacatatatttctctgtgtgtgtgtttgtgtgccctctcagtggatagagctaggaagcatgtacttttaaaaacatcatgagttaatacaaataactccaattccagttgtatacctcagggttgttctttgtcttcccccattccatattgatatctcctttctcccaccgtaaaaactctggttcccagcaacttcaatatgtgtattcatttacttgcaattactatgccaataccactaccagcaacaaacctattaagtagaggtcaagatttctttgcagttctttttgtccttaggatatattccactaggtataaagagtactgtgttcaaaggtcacttggattaatgatttttttttctgtgtggttatgctatcaactgatatatagttatgtttatttgtttctgtttgtattacatttaagggtttttttcccccacatatgctattgttttgaatatgtaaaatatgaacatggttcaaaagttacaactttaagttgttcttagagaagtctcagaccctttcaacccatttccctcttcttttatgggtaaacaaacacagtttctggtttatcttctctgtgtttctttttgcatgtacatacatatatacatattgttattaccctttcttatacaaagttgccaaactatatctattgtgttgtgtcttgcttttttctcttaacaatgtatcctgtaaatcacttcatatcaggtcattattatcttcctcatatttttttttacagctgcatgctgctccattgtttatatggatcatagttgttcaaccatttgcctatgtatgggcatttaggttgcttccaatattttcctatctcaaataattcttccattaataactttatgcttgtggactctcatattattagagatgtattttcagggtaaattgttatgggtgggattgctagatcaagatttagcgaatattgtcaaattcccttacatagggttatactgttttgtacttttacttgcagtctgtgagtgcccattttttcagaatctcatcaacagagcgctggtgaggcatttgaaccttcaccaatatgacagtgagaaatgttatctcagcatagttttagttcacttctcttattttgagtgaaattgagaaaattttcatatacttaagggctatttatatatagtctgtccattcctttccaatggagtttttattctttttatttaattttaggacttatttatatgttagggataacaaccctttgtttgtgatgtggattgcaaatatttttctcagcttatttagcgttgcttgtgattttcccccattgatcaggtagaagtgttattgtcgtttcgttttatttttatgcagtcaaatttatgactacataaattctgttcttgctgttgttacatctggatttttagtaatagtaagaaagcttcttccctcatcagggtataaaggaatcatctacattttttttttttttagtgcttgtatggtttcacgtttttacatttagttcttttatccattaggaatttacctattaggtataagtatggatgaaattctttttcagaatagcaatccagttatcctatcaccagtgactttttttttcttttttttttttttttgagccggagtcatgctctgttgcccaggctggagtgctgtggcatgatctcggctcactgcaaccacctcctgggttcaagtgattctcctgcctcagcctcctgagtagatgggattacaggtacatgccaccatgcctggcaaatttttgtattttagtagggaaggggtttcaccatgttgaccaggctggtcttgagctcttgaccacacgtgatccgccagccttggcctcctgcttcctttaacatagaatttccttccataggtactcgggtccatttctgggctttctattctgttttcctttctattttgtagcagtctgttttaagtttagctagtctccagtatgttttattatctgatagttatagtctcccctcattgctctttttttttttttctgagcttgtcctagctattgttgcatgtgtgtttctctattgttgtcagaaattggtgttgaattttgttgaatacctttcaacatttatggaaagaatcacatgattttcccctaaacacctaaaaagttagtgaattatattaatggatttcctaactcaaattttctacagataatctgaaattaataccactgggttcggaggtattattctcctaaggtagtgatatactctattaatggttcattggggaattttgcattgatattcataaataagaatggcctggagttttttgtggcatctttatcaggtttaattactaatcaatgttatatttgctttgtaaaaatgtggaagtttttctaagctctggaacaatttatgtagtattggatgctttaaagtttggtagaattctcctgtgaaaccatctgggctcagtgctagttctttgatatctttcgtatttctctgtcaccactgcagtcaatattttgtcagttgtgttctcctaggaaattatttgtttcatctaggttttcgtatttattttcacaaagacatgcaaactagtctttaatctggtctaataagctggactcagtacaatgtggtaaagaatgaaatcacttcttccttaccctatactgagtccaacccattcaataaaattgttacagaagtgtggacataacactagctctgtagaccttggtctgaaatctgatgacaacttgaagccactctcgtgcctctcctaaaggaatgtactagccttcttaatataatctatcgaggcagctctgttcaaccacttcactatggtgttgccaacacatcccagagaaaccactgagaaacagtggttatactgttatatggtggttatacttacttaatactaagaaggaacttagtattgacacagatgaacacttcaccagagccagaggctcctcttcacagggttctcctgctgtccggcttagcaggttctcagtcctcagtggcaaaatcacactgtgacagagtaacaaaatttgttgcaaaatgcaaaaggctgcaaagcatgactttaatagcatcacccttcagtgtatggtccaggtagcagtgtgatctagtatctctcatgctttaaagagccttcccttcccttcacatgcctataaatctatggcctatgttctactcacattttaacctcttttatagtcatgtccaccttccctcctgagtagagctcatctatgccaatggcctttaaaacatcaatatgccacatatatgttgtctagacctttcctctgtgctccacagtcatttatacaatttctatgtgacattcactggcatgtctttcagacagcttgacctttaaaagccccaaactgaatctcctccatctacttctcctccatctaaatggcttcctacagcagttagaataaaagacaagctctctgccatgtgacaaggctcatctagagcacccatgatgactaatcgacacctcgggtaccctgtgggtaagtccaggtgtgtgaggatgcaggcctagaatagggatgatcatggggtggagtgaagctgcaggacaggtctcaaggggggactgataggacttagcgaatgcagagcaatggctgagaaccttcttctgtagctgttaatctgtttcttgctgcaaactggtgtgttagagaggacacggtgagccttctgtgttttgtcaagtctctcttcacagctttgtccagaagcccacatggtgttgctggcatgcatgctgtaggatgccgtaagcgagcttctcccaaaatagtgtcaggatcttgcaacctttcaccacactagtgaggtcaggtagaaggccctggacccctgcctaaaatgggggagtatatccactagagcaactggcaggcctgtaagaccttcgtcctcctctgttctctcttcatccttaacttcccatatggtctgccttggggtctctctcacccacccctgatcccctttccccagcatgtcttagcccatttctggttcctgctcaggtggttggctctgttctgcagctctgtgtttggtaatttttttggtctctgagtacctaggtttgattcttctttcctctggctctgaaatatctggtggatggaatcctggcaagtgagcttgccttcttcaaggacttctctacgccccttgctgttcccccaccggccaccaggaagcagtaagcaataacagatgaagcatcccagctgaaacccacctctggtcctcacccagctccagcaagatgtaactctccaagttctgagtgaaatgaaagaaggggtcaaagatgccctgacattgcttgtctgggagctggggtagtggaggagttgggaacaggagtatgttggaggagaagttacagagttctgttgggggcatgttgagctgggaaagaacatgggatataaatgaatggggtgagaaatatggactggagcccaggtgaaagatttgaatgcatgtgtgcagagataacagcttcagccatgagagaagactctctaagatatgctggctaagtctgtgtgaatgtccccagccagaggaatcattaatttatctgaccatccatggtgttcaacagcattcttgcttctttttgtttgtttgttgttttttgttttgttttgagatagtcttaccctgttgcccaagctggagtgcagtggtgcgatctcagctcactgcaacctccgcctcccaggctcaagcggttctcatgtctcagcctcccgaatagctggaactacaggcatgtgccaccaggcccggctaatatttgtatttttagtagagacagggtttcaccatgttggccaggctggtctcgaactcctgacctcaagtgatccacccaccttggctttccaaaatgctgggattataggcatgagccacggtgcccagccatcacttgatgataggctataattgggccatgatggagaactcgatgccccctgtttattggaatcttcactctgaagttagcatccataaatttgagagaagagggagatttgggcagggcgaatcacaagtctctctcctcagtccttgcataagaatgcagaatctctgaagtggagggggaaatcaaggtgaataaatgctttaaaataagtaaaatctctctcaagagtttagatagcatagtgataagaaccatgaaaatacacagtttattcacattttattatgtagatttataaggtaccaaagactctgcaaattcaactctttcaatgtcaaaaatggttgcttattttcactctttttctcatcagtggttatgcatgtttctttactttctgaaatttatcaaatgccttattacaacctttatattcatttcaatgcaatacaaattgaaatgtattcccttgagtatttgaggacacttttgagatttagattttttgaaaaatttatgctcattgatatttcatgtgcaaagacgtatgtaaatctagactgatttggatattatggtgcactaatatctcattaggtagttgtttatttcatagacagctctgtttttcagttgttttgcatttctattatccatgaccctgacttcccagaaccaccaagctacaagggcaatctgagcttcttcccatatttactctaaagagaaattttcttcaagaaataacttagaaccaaccctcaaggaatattatagctcttgttcttcatctcagagcatttatgaggactgttctcctgaaagcccttgggcttttgtggcatatagagagatttgcaattctctgttatagctagctaactaggcttctgcctttcatatctttgcaaacataaaatcacattgtggaaaaagaaatgtgagttgttcagccctggaataccagggaatgacattctgtgcatagtaaaatgtgtgttggggagagcttggctagctcttattcacagtggatcagcttttcaaggcttcttcccaacatctatgttttgaggcccgtgttcagatcatctcataaaaaattaaatcactcatcatgaaagtgatttattaggtgggatctagcagcagcagcatctccatcagcctctccttggagcaccagtgaacttggccagagtcagcagagagcaaaatggtcatctctgcaatggtgtgcactgttgggacctagcccctggtgctgagcacacttccacggagggctcaagctgaaggtgactgagagagcacctgagaatttggatatgggggctgtttttttttttttgtagctagaacaggtaggaatcatgaactctgcttttcttagcatgaatggaaatttactgtggttttcttgtctttaatcattaaagatctgcattgataaaataataagaagaatagttttacttcactctcaaattatatctttctgattctcctgtgttttgaggactatttatatatggcacaaaaggcatttgcaacccattcctgaattttgaagtagggcatgatcacagtttttaaaagtcatataaagtataagaaaaatacaagtaactctgagagggggaatcctgtgaaaatatcctatgaaaacaaatgaacttatcaattgtcaaagactcaagaagagatagatagaaagatagatatttctaatatctatagatgtatttattattatattgtattgtcatattatataatagatatataataattagaaatgaatgttcctaattcattattagaaatgaatacaaaagttgtaataaggcatttatacacacacacacacaaacacacacacacacattcattgaaaggtgccaggaaataaaaaaacaataataacaatatactatgtttttaccataagaaggaataagtaaattttcatgtcctttaaatattgaagaattgctgtcctttgtatttgaggtttaataaaatgcaagccaattggcctcaattcaacaaacaaacatttgttgagaacttactgtctggctaacctggggatacaaagatgagtaagatgcagtccgtgctcttggagcgcatcatctgttggggaagatgatgaatggcaaatgctgatgaggtacaatatggtaaactctaaaatcagggtatgtatacattgctatgataacacaggtggaggagcaatcaattccaatttagggatcaaagaaagctagtgagacaggctccatttaagttgtgccttaaagcaggggtccactacccctgggccacaagccaataccagtccgtggcctgttaaaactgggccacacagcaggaggtgagcagcaggtgagggagcactaccgcctgagctctgcttcccgtcagatcagtggcggcattagattctcataggagcgagaaccctaccgtgaactgcgcatgccagggacctaggttacacactccttatgagaatttaatgcctgatgatctgtcactgtcttccatcacccccagatgggaccgtctagtttcaggaaaacaagctcagggctcccacagattttacatgatggtgagttgtataattacttcattatatattacaatgtaataatagtggaaataaagtgcccaataaaagtaatgtgtttgaatcatcccgaaacttttccgccgcctcccctccagtctatggaaaaatgtcttccacaaaaccagtccctggtgccaaaaaggttgggaaccgctgtcttaaaggatgtgcaggagtttctcagattggagatgaggtgggaaggaagtgactgcaggactggggtcaaggacagagtacaaagaagaggaacataatgagcggtaaggaccaagaacttagactgggatgcacacaccaaggaacaatccaaggaagggaatgcaaacatgaatgtgtgtggggagttctgggaaccaggtccagtatgcctaaagcatgagggaggggggtgcttaaagagcggagtggccgatgcagagtgtggcttttgaaggttttgccaaaagagtttggggcaatattttaaattggaatacggttatttaatcatttatttaaatctacttaacctactctaccttctacatggccatttctgcttgcatgagttgatgggaattagcattttgcatacagagatttaagccttttcctgccatcacataattcaggctgaagttggaatgaagataaacaagcatgtcatcatgtacagaatgacaagtacaacaataaaagcaagcactgagagctatgcgcacacatagggagaaagtctagggaaggctgtctagaggtgaagacatctaagctgagcttaatattaatagctagttaggaatgagctataatcgatgaaaaaatgagggcagagcattccaggctgtggaggtaacttgggaacagtcaaagaaatatgaggggagtcatggaatgcttgatgagcttcaggtaactcacagcacagggtagagtgtgggaagaagaaagaaggaagcaagagcagaagctggagatagaaaaaggcttagtgatgaaaaaggtttgtatgccatgtgaaagacttcagattttatcctgaaggttatggggagtcttcgaatacatttaataatcacttttcaaatgtcaaaacttaccttggaacagtggttggaggcaggaggatgtgttaggaggtgatggcagtgccgcacacagaggatgatcaggaagttagggggcagaactgaaggcagtggggatgacggtgggtcacggggaggggatgctggaaatgatttggaactagagcttggaaactaagaaggtctggggagccacagcaaggaggaagccatctctgagggttctcagttgggcaactgggcagacattgatgtcactaaagtagatggggcaaggagcagtccaggagagggataagggagaactaaaataataaggttttggatttgtttggtacaggaaacaaagagctctggggctccagggaaatgtggatgcacagagttcatgataaagtcagaggttcaatgttacccaggcttacctggtgtttcgtggctctctgtaagatgtcagccatggtgacacccctctgtcttccctaacatagcagttcatccacatattctatctgtagtgtacctaatgctagagagagctcatggagtaatatgaatcacatacaaatttaaatttctgaaaatgtatatagtaacatgtggatccttgacttttgttgacttcattttgttgtctcatcagctattttcattgaactttcttctcagacttatttgtatttttcttatacggtactttatatgactttttaaaactggggttgtgccatatttcaaaatgtcggaatgggtctcaaatgccttttgtgtcattttactagaatattgtgttctctgttcatgtattcaactgcatgcatgtttcaacttttaagataagtgtcttttgggatattccaaatccccaacatctgaatagaggttgctcacagaaatagtaaaagaattttaagttatatctaaaatatactatacagtcaatttttgttcattaaaaatcaggttttacttcattgatccttactgggaaagtcatgtatttaaaggtaatatgaagctaatattccaactctggatggagttacaaacacttgctagatctgatactaggaccctcgtatcactgtatctgactgaaagttctgtatgtgaagcatgacaccttatgcatttatcatggcatgacttttggaaaggatgcagatagttcgggtatgcatgtttgggtccagatgtggcattctagctgctaatcaaataaaaatgctgaagacagagcatctcctccattcttcagctttattcctaaatgaatccaaaggctgctatataggatttcctctactccccaccacacgcagctttttcataagcaaagaagcctggttaactttcccagcagcctcttaggattctgccaattcgtgtggcaaatttcacaaaaggctgtggaactgacaccagggaaggaggagagaaaaggatgcaattctctctttccatacactgcagagaaaaggcagaagggggcgctttctggtggggcataaagagtaagggtttgtaagatgcatctcagtgaacctgaaatatttgtccctgatttatctctgttaacttcttgacaactgtgatgggctttgccttatggggatttatttttctctgtttttcaaactgaaaatgatttttaatattctttattctaaaagtcctacattcttattgagaagcataaacaatagagaaaaataaacagcaaaaagaaactaataattacataaaaagctcatcatacaaaaatcctactgcaaaaatacccttctagtttttttctgtgtctataagcacaatattaacaacaaaattagatcataccataactgggtttgatgccatgttattttattctataatcccccaatgacacctcgcatgatcaatgaatatacagctacatcagcatttttattggctatatagatttttataaagctttactaggatttattattacaaatactgttataaagtcatatagattcatctttgtacacttgtctgattattgcttctaaaacagccttattaaacattgaataaatacaaaagaatatatatactgtatataaaatgtaaaggacaaatatacaatgttgcttttttacgccactctttctatgttttgcttcttttcttcttcttcctttttggcttttgctaaataagacttttcccatttcattttttttctcttctctagtttggaaattatgtactctgtttctgttcttttaccagttaccctagaaattttaacgtcagttcttattttggtctaaaattaatatatttatgctaggcatggtggtgtgtacctgtagtcccagctccttgggaagctgaagtaggagaattgcttgagcccaagagtgttaagtccagcctgggcaacagagcgagaacctgtctctttaaaataaataaataataaataaaatgaacatatttactttcctttctcttagataactttagctacagtcactctcctcctgacatttcagtattttaattttatcttttataatcccacaattagacatacaatgattgttttatactataatgcttatttagacttacctatgcattggcccattcttttctatacttcaaaccttccaacagaataacctccctcctttctaaagtatactccaccatgagggggacattcttttatggatgataaactcttctatttttgtatgaaaatgccttattttgccttccttttttgaaaaacagcttttatgagatgtaatctgcatatcttaaattatctcatttcaagtggacaataaatgatttctagtaagtttaccactacaatataacgttataagatttccatcactctaaaaagaaatgttgggcccatttgtgccaggctgtcatccccagcctcaggcaattgctaatctactttctgtttctgtaaatttaccttttctggacattttgcataagcagaattatacattatgtgatcttttatgtctggattctttcacttaacataatgtttttgaagttcatccatgttgtagcgtatattaatacttccttggtttttattgccaaatagtattccagtgccacattttgtttatgcatttaccagctgatgaatagttgggcatgttctactttggggctgttaagaacactgctatgaacattcatgtgcaagtctttgtgtggacatgtcttttcatttctcttgtgtagataactaggaatgttatgtagttattgggtcattgggtcataatctattcttaacatcttaagaaactgccaaactgctttccaaagtgactgcatcaggccgggagcagcagctcatgcctgtaatcccagcactttgggaggccaaggtgggtgaattgcctgagctcaggagttcaagaccagccttgccaaaatggtgaaaccccctctctactaaagtacaaaaaaattagctgggtgtggtagtgcacgcctatggtctctgctactcaggaggctgaggcacaagaattgcttgaacccaggagatggaggttgcagcgagcaccactgtactccagcctgggcgacagagtaagactctgtctcaaaaacaaaacaaaacaaaacaaagtgactgcaccattttacaatcccctctagcaattacgaaggttcaggtttctccacatccttgccaatatttgttattatgtgtcttgtgatcataaccattctttgtaaatgtgaagtggtagtattacattgtcgttttaatttgcttttcctaataaataatgaaactgaacatattttcatgtgcttattgacccatctgtatttcttctttgatgaaacgtttattcaaatattttttcttgccttcattcttgaaagagagttttgtttggcacacaattataggtatatagttattttatcctagcaattagaagacacttttccattttcttctggatttcattgctgctgttgaggaattgactgccagtgtaattgttatttctttctagataatctgctctttctctctggctccttttaagatgttcattttgtttttggttttctacggttttactgtgatgtatctacatgtagagtccaagggcgggagggatttggcttgccattactggctttgcaaatatagaaagtgggccacaagccaagaagtgcaggtggcctctagtagctgagaaggaccttcagctgacagccagcaagaaattgggtacctcagtcctgcaatctcgaggaagttaattctgccaacaacccaaataagcaaggaaatggatcctctcctacatcctatggaaaggaacccagccttgctgatgtgttgattttagcccagtgagacctgtgtcatatttagcacctacagaactgtaaaataataaatatgtcttgttttaagctgctgactttgtggcaatttgttatagcagcaataaatagtataggttttaagttttagttatgttttatttctagaacttctttttaactctttttcaaatatgctattcatgtttatagtttcctctttaatacttgtattttcagtctccttttaaaactcttcaatattgcaaatacagtattttgtagtgtgcatctgaaaagtcacttaagatctccacaggtctgattctgatttctgttgtttctactggctctttctcacagttccttgtttccttacaactttttaaacttttgactttgagcttatgtctattggaaattgactgttggattatttgagacctgagtcaaaggtatattgttccaggaaagagttgtgtttgcttccatcaggtgccacctaggacttcctaggaccaccttaaaataaattcttggcttgagcttttccaaattgcacaggtaatatgagtaaatgttaactaatgttacaaacatggtgaattcagaattttcaggaaagatttttcccccacttagtgctaagctaggtagaacaagttacctatcatcttcttctgacaggtggaggttactttctagtttacccttatactgaggttgtagctgtgtggggtcccagatttatgtaggaatttcctattatgctttccacctcaggtatgagggcttctctcctgtctcattgcactatccaaacagaaactcaaaaacaccagttagttgatgcccccagggtaaaatctggctttatctctctggattccagcattcactttatttccagcattcattttatttgaccctgaggattttttattgtattgccagttcagtgatgtttttaaaaggatgtttttcatatcttctccagaagttttagttgtttcagaagggtggttcacagtaacatttgcaccataccgtcagaaatgtaaatgtcaaatgtctctttctttttaaggattaattcttaggtgtagaattgctatattaaaaggtatgcaagtataatatttagatgtatatatttccatattacaatggcttgttttctgttcaagaaaataaaacagaaaaacaagccactaatctcaagcatttgctgaatcccttttagatttgcctctcacatctacaaaaggaaatatgaatgtggttaacatctggacaagagacaaaattagcaaacaaaacaataatcctccaaaataaaattatgtgaagtgtatagatggtaaattaggagttcagaaaaggctgaaaaatttaaatctgaccatgtcacacctggctagggaaatcttcagtggctgcccattgcctttagggtggtgttcagaatcctacaagttcccatataaccctgcatggtctggctcctgcctcttctctgtccttgtcgctcctcctagctcactagctccaagctcactggccttatctgtgttcctcaaatgcactgaaacccttttcaccccaacccttacttcttatctgaatgtccttttctgcctcccaccaccccaccccactgcgtggctgacctgttcatccttctggtctcagcttacatgtgactttttaacttttactaatcttctagtgtaaattacctctggcacacaaacacatacacacacacaggcacatacagcgccccaccccccacccacccacacacacacacacatttctactcaaatgtccaggtaactggtcaacccagcatctcagggacagagactaaattcatgcatctcagagtgtctggtcgacctgaaagaaagctagagagtgggaatgagagaatcaaacctctctgaaagcatcctgttctttccctccacagcacttgttagaatgggattatctaatatctatctcctccactagagaacagaactatgtcctattccctgccatattctagaacttagctcagtgcctggtacatggtaaatctttattgaataaatggatttaaagatgcatggctgcatttgaacaggtggagccgatgggcgtcaatagatttccctggaaatcataaaactagtggaaaaatgagaaaaccaagcagaaaagacgaaaatattttaataggttataactcagtgaggaaatatgaatgttcctctttgagccaacaagctgtcctataatgatagactcttatgaccagtctatagcaggggagagtgaaaggaggtgtgcccgctgttcagcatgaggtggtcaggttagctacaaccaagatggtgaagaagcgatttggatttccaagggtgtttttgggtctctttccttgaagatggagagtgtttcatttcagtgatgttcttgatgtcctattaggaggcagtagaatggatctctagtttctttcattcctctaggttgatggtagttaacttttcttcttttttttttttttgtagcttgctttgatttaagtgattctatcagttcattttaacacttgacacttatctcttacatgtttccctgtaacattctgaacagctcactctttttactaggtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtaagtcttgctggtttcccactggcatacagggctatttgtatatttaaacagtaagtttgattaccttgaaaagcaagaaatctacctgttggtgactatgtggcagattacctgtgtgaaaaattttgactatattactaaactctgcatctctcattgttcacatagttctctcttcaaaacttaaaaatatcagaagaaaacattttccatgatgcttttctgttgcattcttttaaaaattccttcacaagttaattcctcctcaatcaaagtttccacggtgacccatttatatatcaatttctatgataccttaagctgtgctaaaaaaaaaaaaaactcaaaaatctttaaggccaaaaagcaatggtgttggtcatttggtattctataagacgttccaagtgttttaactgtaggtagatgatccacccatctattccattgatttttaatcacttctgaaactcattgaatagggtagaacaattagtggagatattatgaatataagcaccctgttaccaatctgaagtcttctaagaaccacacttattcattgattagaatggggtggcatgggacagtagctgtgtttttgagcactcattacaagccagacactgtccgaagtgcttcatacacattatgacactcagtgctcaggacagcaccagcagaaatcaagctaagtggcagagcaagaatttgaatacaaagtgatctgactctagaacctgcagtcttaactagttttagcatgcaatgagtgtcccaacaataaaaaatgttttattgcctcttaaaataattattgtttccattgtgtagataggtaccaagacctttggttaagatattgaaatcaatagcttcatgtagagatagttatagtaaggggagaaaatatttttaaatggataaatattgtaagtatacactttcaatagttttattggtgtgatcttcaaaaaacaaggcagcatacttgccttcaaagatttttaatactggcatgtgaaagtgagataaaacttactctaaaagattacaccacaggactgctattgccaggggaaaggttcaagaccttgtgataattcgagctgtccagtcttagctggggccacttcaccaacaagacctttgttctggtgattattccagcagaaacagcatcaggggtgtaactaaatggattcctatatgggaaagagtttgtactaagagacatctaaaacttgtccctgttccaagatcacttactttttagtgtcttattttatagaagagatctttcttgaacaggtggctgtaaagtgaattttgtaaatcaaaatataattataccattgagttctgtagtaaaaatgaagctacattattgtagagaatactacctggtcccagaaacataatgaaaatgctatataaggctacagcaagtcttaaattttattaataaaaagacaattttaggctggaacaataattatactcaaaatcaggactagaattacattttctagggtttaaggtttttctaagcatgtctctatctcaagtaaagtttcccttttaaaaccctaagcaggacaaggtgatttgtttgaaactgttaatatactagagatacctgggctattgatttgatactgtagtcaatacctgagctttattttccactcatggggttgcaaaagtatttctataatttcccttttccttaagagtgaatttccactcttgagatggattgatttaaagggaattatatatagatataatttatatatatatatatacacacacacgcacgtgtacgcacacacacacacacacacgtatgtatgtatgtatgtatgtatgtatgtatgtatgtatgtatagcatatacatatgctgttcagccactggaggttgaaggacttgggatggagatgagaatgaggcactggaggctgcaaaaatgtaggctctagaaccaagaattctgaagagtagctgaaggttgctacgtcggactgcgttagggacctccactggcatgcttgactgattttaatatagtttgctccacccgcataggtagtcctattcaggctgcctattttatatctgtgctcagtgttatatctccttccctttttgtgctttccgtcttcctctttcactcactagaaacaacccaattgcagtaaacagaggtgtcccttgctgaaaggaaacttctgcaccatactagaggcctgtcctataaaaggaggagaatggttcagatgactctgaagcccacccatctctaacattccaggctttatgagggggcagtgggcatctctggcagagaatcctgcagttcctggcctcctgtgatcctttggattgatacctcactttgagttctctcccactccatgtgtcccttccttgttcctttgattctggcatctctttgattgtggccagcagaaagttcaaatccctttatgagttcctgccagtatttgtagtcaatcttttgttgggcatatgtcaccaaattgaaatgtgtatattgcattggcttgttttccaataattgtcatattttattgttcccacaaccagaggcttttgtattgatctcttcaaaatagtcaataagtgatacatcaaaaggaacaaatgacagatatttaactggctgtcccacaaaatcaaatattttcattgattggattaggaaaggctctctttagctgtcatagctaaggcaacaatgatctttggaaactatagctaatcatatttgttggtaactgctctgtaaagatttttgctgtattaactttctatgacatttctaataactctgcaaacataatgaagaaaaaaattccactgtacccctatgaaggttagattgcaaaaagaatatctaactgacacccagtacttaatcatgtgaaaggagaaaaaggtacaattttatttcagctctttaaggtacatttccaattattagctaagtacaatcagtaagaaataaaaatcattttagttgaacagtagttttggaaacgcaggaaatggaaagtttaatggcaagtttggttctgcaagacatattttagaattcatttgggctggtagagatacatctagaggaagaaaaagaattgagaaagaagaggttattggaagagaaatgtcagatgagaaaatctcctttattgcattgtttactttgttttaggtgaaatctcgtttgataaagatgggccatcttaattcaatgaacatatttcttagacaagaaattgacagaatgcaaagagtcatttcaatactccgcagtagcctgagtgatctaaaattggccattgaaggaacaatcattatgagtgaggtgagctgttattacatcagtaggcatttccttctttgttgatgtttcttattcatgtgttttaactttttcttctccagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggtatgtgctcataggagatttggcaagcttggaatttgtgtattgttggatagtagcatcgtgtgataaatatataccatataaaacaatatggaggcgtagcttgctgggtgctgcacatagccattcaaaggcgaaagaacacaaataattcttctgtatttgttttacaaattcaatctgaagctcttcctatcaattctttacaatgtggtagcaaaatccttcctttttcttttcaccaacttcagcaaaccatcagtctggggttaggacacatgaaagagtaaaaagaagtttctctctaacttatagtttttaaatgtttgtgaaatatcaaaaatgaagcaccaaaagatgcaaaaattgtttccagggtttagaaaattatattggtttcaaaaatgactgtgacaaaagtattcagagaacttcaggggggtcttcccccactcagttttctagttttctttttcttttttcctgaaagagtgctttataattctgcttcatttattccttccttctagaaatgtttactgagaaagttaatggcttgatgtcatagagtttgtaaggttcagaaacatgacacattttgtcttactaaaatatggatagttttacttcaagtaattcttggtgaaaatgaagaaatgttgaattccttatggttcagcagcttatggctccatttgtaataaaattttagaaacattcacacttacagatttaggatgaattattgtttcttgtagcaatataggtgcatctcataaaataatgttgagtaagggaaaccaaacagaaaacattacatgcggtatggttccatttatacaaagaagaagaacaggcacaatggctctatagtgttcaaagtcaggataatgactgtagaaggagggcagtgattagaaaaaggcacaaagggccaggagcgatggctcacgcttgtaatcccagcactttgggaggtcaaggtgggcaagttgcttgagcccaagagtttaagaccagtggggcaacatggtaaaaccctgtctctacaaaaaatataaaaattagctgggtgtggtggcatgtgcctgtagtcccagctacttgggaggctgaggtgggaggatcacctgagcctggaagatcaagattgcagtgagccataattgcaccactgcacttcaacctaggcaacagagtgagaccctatctaaaaaagagagagagagagagaaagagagagagagagagagaaggcacaagggacttctggggcccaggaatgtttcacttctagatctggatactggttatgtggctgaattcccttggtgaaaattccttgatattgctgtatactgatgatttgtgcagggttttttttgtgtaaagcatactttgatcaatattatacatgaaaaatatgtatttaattgtcctttgtatacatacattcattcactgtatgcattttccaataccttaaaaatgtttaaatttgaaacactaaccatggtgatttctatgaacatatcaaattatacatagtattttataaagtccgtagcctttagagttgtaaagggcagcccccagatttcacttatctatttttctcccagaatttccattgagttaggggaggaacattttttattatgggtctcagattttgtgtgtctacttatgagtctctttcctccgtatgagcctcaatttgagtaagtcgtcaccaggtaatttctggctggggagcatgaagtaatagcatttaacttaataaggattgtttgaccacctcccatttgccagcccctctgctaggtactttcaatgaagagagatttgagacttggttcctgccctaaaggagcctataatctggttggtaagacagacacatcagcaaccttaatgtaatgtgataagtgccccactgtgtgagaactaagtgccatggtagcccagaggacagagagattaattctgccaagagcttcacacaggaagcagtgagtagggtttgcagaagcagggatgccaaaaaaagagcgggtgctttccaggtagaggcctgagcaaaaacaagtcttgttcaggggaacagggagaccagtgtggccagggctcaggagcaaggctgggggtagtggggaatgaggctggagtatgaaaaatcttccggggcctcaggggttggggctgtatatcagaaggtaatcccaagagaaggcaagtgagggactggaatatggaggcccagtgcaatgagactcttgccaggtccaaggaagagggcctgggaccttaaccaggtgccaaggagggaacagatttgatggagtgattaaatgggggtctctgagagagcaaggagggacaatgtaggctggaggcaaggtacaagacagggaacattgggagagggacaggtagggcagagagacagggagcactggagaggtatgttggcagacttggagttgggagaggcgtaaggaccaatgattttcaaaagtgtgaggttattgaatgtatctttgatatttagaaaccaagggagtggagttggttcatccctggctttccatagtcacgaatgcacataatttttttcagtgatttttttcattcaaaatataactttaaaaagcaaagtgttaatatgaactgatctttaattgttaatatttgttaagaaatgttacaaagccaaacaatacttaaagaaatacaaatgtagattcacatgatatggtttggctctgcgtccccacccaaaactcatctcaaatagtaatcccagtgactggatcatggaggtggttttccccatgctgctttcgtgatagtgagtgagttctcacgagatctgatggtttaataagtgtttggcagttcctccttcactctctctctcctgcctccatgtaagacgtgcctgcttccccttctgccatgattgtaagtttcttgaggcatccccagccatgcagaactgagtccatttaaacctcattccttcataaattacccagtttcgggtatgtctttatagcagtgtgaaaatggactaatacatcacatttcagttaatgccttactttccttcatttgttaataatacttatcttttcccttttcttcagttctgctttcaagttagactttgattctttctctcaggtctctccatgtcttggaaagccctaacttattcaaacatcctaccctttacacacaagcacacacacacccttatccatgactgctttctgttagtcgcacagaagactggaagtcaactcttcctgcacactaatcacttctctgctctcttttcattctcttgacatgagggacaaattactttctgttccacctcacttggccaaatctggcaaataaagattacagctactccatacatgttcccagggagtgtgcaaacagatagagtcctttcccactggaagcctcgctggacactatttgacatcaacagttgatctcccaacatgaatgtatctcctgggttttatgtcctctaattcagtcctcttcaatgaagtaatttctttctttggttcaaaacatttaagtaaatggctttaaataaaaaaccctacataggcagggcgtggtggctcacgcgtgtaatcccagcactttgggaggccgaggcgggcggatcacgaggtcaggagatcgagaccatcctggctaacacggtgaaaccccgtctctactaaaaatacaaaaaattagctgggcttggtggtgggtgcctgtagtcccagctactcgggaggctgaggcaggagaatggcgtgaacctaggaggcggagcttgcagtgggccgagatcgcgccactgcattccagcctgggcaacagagcgagactctgtctcaaaaaaaaaaaaaaagaaaaaagccctacatatttaagtaaaacacagtgcagtttgtataaaggctgtagtttcatcacaaatatatatgcagtaatcaaaatcacctggaccataaggaagactatagaacacctgcaaaggctttattcacgtgtgattgctaatgtttataattgtataatgcaatgtggcatctgatgctgtttagtgtgtttccctcattgaccctctggtgactgctccacaggcctaagtgactttgaggtccgtgctacctcaaggacaagtgacatgccttgcttgcccctggtcagcacctgagcttctgctgtttgtagcactgctgtttgccttatgggtggcctgatattttgtctgtcatatttgaagaggctgagtcagccaccgtggagctcatctggcattttcagcacccctcacaatcatttctgtagcaattgatgagctcaaccatgtggcaattagactggatgattaaaatagtcaagctctctatatctgtgaccctgtgatagttttttcaatgtgcagcttttttctgtgtgtggatttgtctcccagcagattactcaggccaggggaacctttgtgctccactgggttttcccagcagttgttggtgcacatcttcccacattatttaagattgtttttctcgggtgtcgcaaaggatggccctggtctgtttttcccgaaggtgcgccttttcagtgcatcgtgtaacatgatttagattctggtgcatgagcttgcaagtgtgtgtacatgtctgtgctgtgtgtggggatgtgtttaaacccaaagaatatagtcgtaatgagcctgacttcaggccagggtattgactgcctttcagaacatcttaattgatagccatgctttgccatttgatgttagctatgactcacaggggctgctaatgaaatggaggcagaggctgagtgtgttccccaggtctcacacctctatagtagattgaaccatgcagtcccgttattttccgaacgtttagctcaatctggagcttgatgccatttagatgccaaattgtgcccacttttttctgttatttttttctcagtgtcttgacaagccatgccagtcagttgtgtcagatatcagtgacaacttcttccgtaatgcaaatcaagatttttcagttagaggcaatcctgctggatcaaagagatggatcatttttgttctgttatcttgcattctgtaaaaataatctacaactttttgcctgtgtgtgtgttttcagggaaacatcatcaactagctacaatctctgaatgcttgtcttgaagagttataaaagtctgccgtttgtggaggtgggaaagtgtgccaaggactaatggacctttaagattggaagggacttggggatagcttctaatctaatagcaattctaagcatgccccagtgccactgtttgatgaatgagagctacccttaaacatcttgggaaatctaggtgagtggacctcaagtcctaaacttcaacgtgagtgatagcactaacctgccctgtccccaaatcacagaactatagaaatgcctctgagtgaataacaacccatcctccttgactttctgtgtgagcagcttttacgcactggccttagacacaaccacatctcttgtaattccagtttctgcatgtgtttaccttccttagcaaccacctagtcctttgtaatctggctgggctccatcactgtgctgaagctgctctctccacggccctcatatctaacgacctccctgatgacatcattgcccttgactagagctagaatgctgactttgaaaactctcatgccttggtttccatccatgcccctcctctgatctcttcctacctcagagctcactttgtgtgctcttctcggcaacttctgtccttggcctcggccccctcgttgatgacctcagcctatgagtggctcatctaatgtcccactgtagcatgctcattcctcacttccacctgccaagtaggaatttcatcctcctgcaaaggtcaccagagccatgatctgcccatcttcctcctgagtcatctgtgccaggattctgctgaatatgcttgtgcaccatcctccaggtcacctggactcttgtgaatgggctcctcatgtcaaacagtgtggaagagggaaaccaggacagcatggtgtcatggaaggcaaggagaaggagagtagtaagtaagtagtggcaggtgctccaagagggcaagtaagatgggccaaaaatggccagatggatttttcaacaagaagactgttggcagaagtctcagtggaataggtggggaggtacaggagtctgatttgggggtgtgtgagtgaaacgaggaaatggagactaggtgagtatgcataacatggataattctctcaagacatttggctgggaagaggagaatcaagttggaggagtaggtataagaataaaaagttttctttctttctcttttagtgataggagaggcttaaacctgttcaaatactggtgggaaggagagagaaagatagaaaaggggttgtgggaggaatgaaggagggagagagagctcaacaatcccagggaggaggtaaaagaggcaggaggaggtggacacagcactcacagatggagaaatgtgctccaggcaggcggcacctcgcacactgtaacaagagtaataaggaaggaaagggcatagatgcttatggtgatggagcataggtaggcttgctggcaagaagttaagggcattcccatttgatgctttctactctctgtctgaagcaggaggtgaggtcctcttgaaagcaagaagatgttggtggagagatttttaaaagagtggtggaagtttgagaaagagggcagatgagggggacagggaaggactgataagtggccttgagaattctgttgaggctcttcatggtgaactgtggtgatggtggctgtgtgatggtttctagtttcattcagcagcctcgtatagacgtgagagaggggggcatttggattcatctgggattgcggttttgccaggcaagagatgaaaaggatggatctgaactaaacagggaagtaaatgaagaaaagggatggagttgagaagaaggtcataaaaaatgatgaggccaaaggtctgagaggtcagatgctgaatggggtactggagagacccaggtgttgtcagagtgcttaatgggtcgcagcagatgggtatatggcaaggacaatgagaggagggacatgtggccagaggctgtggttgtcaatgcagcagaaattcccttaaagggtggaggaacagctgggaaggacaaggtctttagggttgagccggggcaacctggcggaaggtggaaagaacattctgtgaaaaggtggaaaatatgagagtttgtcaacagagggaacattggaaaggtttgcgagagaggggagaagtgggaggttggttaaagggaaaggaagcataaactagctcaaggaaaagatagttcagggcagaaattacatttttaaatgggtttagctgatcccagccttgctaagacaggtagtcccaactctcctgtttataccgaagttttactggagccaattatgtcctggattagtcatttcagagaaggtgtgtgtctcaaggggccctggaaagagtcagcttgtactagtgacagtcttcttaatattgtgcctgtactcttcccacttgtcaaacttgttcttaaaacaactgtgcatcagtgactgtcaatgacttgtctgcagagctttttacggggcagtggttctcacacctgcctccacagtaaaatcacccagggagcttttaacacatactactgcctggggccccagaacaagtatatcagaatctctagggatgagccctctagaatccatacaatcaattttcttttcttttcttttttattttactttaagttccgggatacatgtgcagaacgtgcaggtttgttacataagtatacatgtgtcatggtggtttgctgcacctatcatctaggttttaagccccgcatgcatcagctatttgtcttaatgctctccttccccttcccccaccaataggcctcagtgtgtgtgttcccttccctgtgtccatgtgttctcattgttcaactcttacttgtgagtgagaacacgcggtgtttggttttctattcctgtgttagtttgccgaggatgatggcttccagcttcattcatgtccctgcaaaggacatgatctcattcctttctatggctgcatggtattccatggtgtatatgtaccacatttactttatccagtctatcattgatggacatttgggttggttccatgtctttgctattataagtagtgctgcaataaacatatgtgtgcatgtgtctttatagcagaatgatttgtatttttttgggtatatacctagtaatgggattgctgggtcaaatggtatttctggttctagatccttgaggaattgccacactgtctttcacaatggctgcggagaaataggaatgctgtcacactgttggtggcaataaattttctgaaaagcttccttggtcattctaatgagtgaagaaccttgaccttggacctttgctacccagtatgtggtccaccagccagcagcgtctgtatcacctgggagcttgattgaaatgcagaatttcaggccccactcttgatctacctactgaatcagaacatgcacttttagtacatccccctcctcaggtgattcccatgaacattaaagtctgagaatccctgccttaaaacaaatctggtgcctgggttccacctccagagattctgattgtatttatctgagctgtgacttgggaattgggagttttagaagattcctgggtgtctctaattttcagcagtttaatgtccctgccttacagcaaagaaccggggaaggtgcttggtgcatttttattcaacggggttgaccaaccctatctttgtttaatgatttctgacctttggtttaatttaccaatgaactacatttgcttctcatttgggggaaaaactgcctgtcttaaactcgtggcaggaacatcatttctcctcatcttcaaagatgctgctgggaagcttagtaactgattagacaggaaatactgcacagcctaaggcctattgcataaggaccagttcatttattaaagaaaagaaaatgttgcttatttttagtgtaaatcattacaaaatgccaaccaactccttataaatttgagaagagcaatcttcctgattagttatttctttcaccttttctaagaccttgtatgaaatgatatttaaagcactcttcagctttctttaagccagctgattgcacaagtcaaacaacagccgtgagtgtgttgaactgttggattactactattataggaatggacacataacaagtgttactttagacctgagtttccaaagtataatcctagcttaaaagggaattttttaaaagaaagaaaacaggaaactgtattgtattgggaggaggctggaggggagatgaaaaaaatcatttggattttgtgtgtgtgggtaagtggggggtagctgtctataactttcattaagtgtttttttttcttctctttataaagtaagctgcaggctttgggttggcaaaccccagggggatgcagaaatctgaggctgctacctttttatctgccttcacggtactgtcctcttcccccagctcctccctgaccctatggaccaggcctcagactttccagctaactgcttcctgtgagccactactctgatatcagcctataaccaaaggagctggggggtccaggcttggtgaccaacccttctcagcccactcaatcagggtgcttcccacctgcaggcaggaggcaacaccctgtctgctaccatcctccccttccagagcccacctgcctgcccagccctgccctgccctgcccagtcgagccataccttgctttgtcccacctgggggtgccctgctcagggatgggctggcagggctgcactcagcttctctggtaagcagagattcaagaaacctctggggtcttgttttctggtcgtgtgatcccaggggtgcacatgttccccttgggtgtctgaacagaagggcctgggagggagggccacacccctgcagtcttgctgtgctggtgtagtgggcagctgcctacccccatcccaccctgcactgtgggctccagaatcggcagattaagcattttataaattgtattttagatacatatttcaaacttgtgagttttttaaaaagaacaagcttgacaagtgttttaagaagtcattatgctttatgggtttgagggggaagaattttttttaaagcatctgatttagaccacatgtaactcagatgtttaaataatcaaatcacctgttttcatgtgggtggtttactctcatgaagaatagaaggttactattgttgaagattttccccaactttttgtttctccctttggagttaaacatatgaacataggaatcatttttgcaccactgatgattgaaatttggtttaggaattattaaaactaaattgtgccagccaggggtgcagtggctcacgactgtaatcccagcactttgggaggccgaggcaggcggatcacgaggtcaggagatcgagaccatcctggctaacacagtgaaaccccgtctctactaaaaaatacaaaaaattagctgggcatggtggcaggtgcctgtagtcccagctacttgggaggctgaggcaggagagtggtgtgaacccgggaggtggagcttgcagtgagcggagatcacgccattgcactccagcctgggcgacagagcgagacaccgtctaaaaaacaatcaaaacaaaacaaacaaacaaaaaactaaattgtgccaaaacaaaagtactgctttcaagctcttatagagaaaaatatatcaatagtctttaaaaattatacaggcttcaaaaaatcagcttttcattccattagacttgctatcagtctacaagaaagatggccattcattttttaaattcaataatgaacagttcattggatttgctaccctttgagtgctgcaaggatcatgctgtctttaggaagcagagacaaaatgatcaagacttgaaaggacatgtatcttctctacgttctctgaacatgggaatggcccattaacgtttcctatctccactctcagactgcaaatatatttaacattttcctttcttaatagtacaaggtaatgtaagtgtgttctagagttcacctcctggcattgctaagcattaggagacttatggctgaagtcagctgcccaacatcattcccattagggagtgcctctccccattagggagaagataagacatgatgtctccttattttcactagagtttttcagagctctgatgatggcttaagtctttgtagcagatgtgctaaataagcgagaatccagctctatcctcctctggcacctatgacattgtcttggtcattgtctagccacaaggaatgaggtcaaatttgcagtttagctggaactttaaatgttataggaaaatttaattattcaacttgtacaaatggatggttaagaccaggattcatgccttgtacattatgaccttgtagattcatagatcagtaatgaatcttaaaacatcataaaatagggttgatttaattccaagtccacaaaaccctactaggatatacagtgtctaatacatggatgcacgctgaatgttgaatggtgaaaatgacattttcatggagtgccttagaatggagaattgggttttattatttttgtcatatataccattgactggaaaacacaccacatgttttactgctaaagtatgggagcctggatgtttaaaatggaagttgcctggcacagtggctcgcatctgtaaacccagctactccagaggctgaggtgggaagatcacttgagcccaagagtttgagaccagcctgagtaacatagcaagaccctgtctctaaaataataaaaaaggaagtcaacatactcacatgctgatcaaatcccctgaagtgactccacacagagcacaggcattgaccagccattgctaccaggcaaacttccactacatttcctgcctcctatacttaacattttgtatcataaaaccagtctctcctactaggcactcggtttcatgaaactatagctttataagaatcttctataaaagtccttcactcagctgctttggttgattggtcaactcttcttttgggttaatgcaaaggcccttctttaccacacctaatcctattttagtgggcactccgagtaaatgtgtcaagatgcaaataaagccaaaccatttgaatttttatttaaattttcagtggcttctctccatccacagacttaagtccaaactctgaccttgaaaaatcactgctgtatcttcgttctacccttatctgctgtcactgactccacactctctcagccatccatgtgtgtgtgtgtgctgttcctttacctggaattgccccatctggcaaactcctatgtagctctcaagagtcatcttccacttcatcttctcaattacgctttccctgagttgtcttcccgagtagttaactttgttcacgccttttttcataatgacaacgttgtgtcaatgtccagcctcccccacactccctctggactgagctccttgaatgtggggcccatggatggcctcttcatctttgtggtcatcccacatagtgcagggcttggtacatggtggccacttcagcaaggtttgacagagcaatgaaagcatgaccatatgagtgcctctccaagtgtctcatttaataatggggagaacttgactcagtaaagccaggctaggacctattctttctttccaactccaagggatctcgactcagtgcttataattatgccttgcaactctcccctcccccaactcccattcaaacctgataaaatgttcacttttgtgttgttttgtgcatacattggtatgtgctggtttggttctcagagctcactaatctaggagtagcgggaacacacacattataaaattttactcattggagagctttatgatttttaatatttacatggaggccaaaataaaatatgtagatcataaatatgttttcttaaggttttgaagtccagtttgaagtttaggatatttttttctaacattgattgttactctccaagaaaggcttatcttattgaattgaatgcatggtttgcaaatattaacttcaaagaaaagccacagtgtacgtaactgcatattgtcttaaaatcactgtattatgcacattaaaatatgtagctttcctttccagggtgattgctttgtttggtcaaattgaaagtcaggttttctattttggcattatgccttatttccctagactaaatgaaattgttccattatagcaaatagaagcttgataatggtttgattcaaggctaattggaatgctattctcagaatatttcaccattccgatcttattcctcaatattatattttcaaatagagactgtgagctagaattgggttacaagcctttaagacttgagcagctgaaatctcaggagagtttcaaaccaaggcccagtttgaagtataaacagtactgctttcctgctgtcagcaggcgagaaagatttagctcattgcaggtccccacagaaacgaaacactgagacaaatgtctcccctggggtttggcctcaactccttttgagatggatgtgtagtttggagattgataagcaagtaacacttaacattgcttccttcttgtttttaaagcagattgcaacaaggcttcaacatctcttctttttttctttaaggcttcctcacagcaatgaggcaagaagtgacccgtgcccacaaaggctgggcactggacactgtgaccatccacaatgaagttctgagacagaccaaggaggagatcacgtcaccccctggggtaggcgttgctgggcaatagcagggaccattctggagccagagctgaaatttcaagttctgcttaaaactgagctatgagtgccttggttaggtccatttgctttgcagtgagggttccctccatcatagccagaagacatcagtgccaaagcctcccccatctgccagagtggaagattaatgacaaggtctaatgagctcttagaactccgtagactacatttctacaaaattacaagttacacttgtgtttgctaaaaaggctttttggccaagtgcggtggctcatgcctataatcctagcactttgggaggctgaggcaggaggattgcttgagcccaggagttcaagaccagcctaggcaacactgggagaccctgtctccaccataaacaaacaaacaaacaaacaaaaactagccagtcgtgatggcacacatctgtagtcccagctatttgggaggatgaggtgggaggattgcttgagccccggaggttgaggctgcaataagcagtgatcacaccaccagactccagcctgggtgacagagtgagaccctgtcttaataaataaataaataaataaggcttttctacacatctccagctactgctgtgggctactcacagattctactgtaggcagcagagcagtgctgagggcagcagagatgaaggggactagcaggttggagccaggggccagttccaggggtgtcccctttgagtggaaaggaacatggctggggggaagagcccccacttcctggacactgatctgctcaatgaatgtgggaaaattctttaacttttttgagtcttcacatcttcatctgcaaaatgagcatgataattcaaccttattaaaggagttgtggccaggcacggtggctcacgcctgtaatcccagcactttgggaggccaaggcgggaggatcacttgaggtcaggagtgtgagaccagcctggccaatatggtgaaacccgtctctactaaaaatacaaaacttagcctggggtggtggcaggctgtaatgtcccagctacttgggaggctgaggtgggaagattgcttgaatacaggaggcggaggttgcggtgaactgagatcccgccactgcactccagcctgggtgacagagcgagactctgtctcaaataaataaataaataaaattttaaaaaaggtagttgtgaagatttaaatgtgatcatttaggtgtggtgctggaccccatgtagactctcagtaaatcagtctccctttccctttctctgattttcattccctcatttgtcaagtaagggggctggaccagatgatttccaagttctagccaagttccctgccaccttataacgagggccacgtttccttcagtttccagtattatcttccacattcctgtctgaggcctcaccagaagcaccttaacctccaggttcccaccaacaatctcttttaggcagtttcaaaattcctccagcctctccccattatgcaattccagaataccttccacatctgtaggcatttgttaccacagcatcctgcttcctggaatcaaaatctgtgttcctttccaaaggctgtcataacaaagtatcattaccttgggtggctaaaaacaacagagatctattctctcattgcttaggaggccagaagtcaaatcagggtagggttggtttctactggaggccccaagggaaaatcttgttctaagcttctctcttcgcctctggtggttactgacaatctttggctttccttcatcattacaatctctgcctccattctcacattcatctgtataagtatatatatctctgtgtcctctcctcttcttataaagttaccagtcacattggatttaggacctaccttaattcagtatgtccttatctaaacaatgtgtgcaaagtccctatttccaaataattacattctaaggttctgggtggacatgaagttttgggtgacactattctatctaccacaccttctcactgactttttaaagttctgaggctgaaagcaccctggagagggatacaatttaccatatgatggcttttaagtggtcccattattcatgtagttgattgtcacccactgagttaatgatggtaaccatatgtcctgattttctgggactgcccatggttttactgtcaaatcatgtgcctccgtttttggttcaaaaaacacagtcctcacacggtgagcccccacagggggattccagaaacactttgcaatgaatcttactgtctttcgttctaatcagcatttacttccctgatccgatcctcactggagatggaaaaacggtcaccatcctctacatttacctatttggtgagctggcatgattgttggagcctcccctgtgattctccttcagcctttctttttttagtgaatatactgcctacaggatccagtttaaactcttcagcttagcacccagatccttccacagtcaacccctgacttcttttacaaccatcgagccctctgataaaggaaatactggggcttttccggctcgccctgcctttctttgtagtgttacttctgcctgtgatgcctacgctctctcctctgtctttccaaacacagccccctgctgcaagcccatcaaggcccatcaaggccatcccctctacagaggctcctgagcactccagccacagggaccttgcctcagaattcaccgccctcacccccagaacagttcaccgggcaccaccagtaacaagtgtgtgctgctattcaattcttatctttaaaaaatttttctgcacctatgcatcttatctccctgatttaatgatgaggaaccccagggtagggcctattgtatgagagagacactggggagggtggccagatgctgccctggccatgattcccctggctctaccatgcctggcctctgggggcgctctgactctcccgctagctgggcctggctgtggaaacctcacttcatcctgtgactgagatgaagttgagacacaggttggttggccgggggcaggctgagatcccacctgacagcagctctagatcctgttccatgctcccaccttccaccaactcaaaccagacctctcagagactttcacctccctatagaggtgatctggtgctaccggctaagcctgttgctcagggaggccaccccacacttaaataactaataacaaacacgaacatctctacagcactcatagcctcaacacaggctgcaggagaaaactgggctcagtatttcacgaatgcaatgtacccggtggtgctttctccctttggtagtgttttaagactggtgtgtgttttatttccaaactgacagcctttatgactaattttgcagcacctagtttaaaaaataaatcctattaccttatgcttgactcttccaggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttctaaaattgctagtgcgtgtgtgttttcctcacatatcaatattcaaaaagataactctaaatgaatgttttttattctgggaaatcatatttcactataattactttttaaagataaaaccctgtttggatgttagaacactttggaagctctgaattttaaaaatttgaaagtgttgatatgtgacatcctaaaaagagcctagtagttgtaaacttttccctcaagtaggtaccaatttcccttgaataaaatctagccatgtctatgtctg

SEQ ID NO: 863 - DNA, 29324 bp, Homo sapiens
attcttttaatataaaattgtttaatgtttttctttgttgcagtacactcaatccagatgtagtggatgaggtggccagattttttcaagattcttagtccaccaggagctgattccatttgtgtcatccctactctggtcacagaacattcacatctttaattccaaatactgagcgtgatgtaaatgatgtaatcagtatctaacacgagtatatactttcttggtggccactgcatgacatatcaacagtgcagcctcaaaaaaaagatgttttgtaacttggccctttccaaaaataaatatattaggacactaagcttataccttaaatgagggcagaataaatatgaatgaagtgcaagctcctgtgaggagcagtgcatgcagatgatgtacttgcttgtatggtgtggccagctgtaacagaaagccactggaacggcacagtgcctcctcacaaagcccatcctgggtatcatgaggaaaaagaatgacacatagcttggccaggctgctggaacccatgttccagtggcatctggagttcactgtattttcttttttctttctttttttttttttgagacagagtcttgctctgtcacccaggctggagtgcaatgatgtgatctcagcttactgcaacctctgcctcccaggctcaagagattcttctgcctcagcctcctgaggagctgggattacagacacgtgctaccatgcccgcctaatttttgtatttttagtacagacagggtttcaccatgttggccaggctggtctggaactcctgacctcaaatgatctgcctgcctcagcctttcaaagtgctgggattacaggcatgagctactgggcctggccagttcactgtattttcgaacaatttccaacagaaagcacagcagtgacgtttccttactggtcactgctcccgtgctgtgaggcctggagctgatcaaggaagcttacacatttcccggcctgagcagatgaactctagggttgctaatctggggacgtgggttccttcaagctctttgtgatgagaaggattttcatcctccttttctcactgccgatcgtgcggtagagagagcatcttcatttgaatgagagcttcagtttctgcttgagcctcaagccctatttctgagcgctgctcctctcacacacgtctccaatctgcagtaatgctcaaagaaacagtctagagctgggtgccaagctccggcagcaagaataagccctacctagttatgtatgatcaggagatcttccaaaggacgtaggcgagaggaaaaagcttattttaccaccatgcagacaacccatctaaaatataacccaggaaattatagcttcacaatattctggatagtatcaaatagataaatccttcaaccaaaagcaaatacggttcccttgaggaaaaacagatgtgaatgttgtggtctattggcaataaataaaacagtaccatcggtgctataaaaacagacaatcagcgtgacatttaatggagttagttattattgcttctatttagtatcatcacagattacttatcgctgccatgaagtccataaaatgtgtgactacctgattcctgggcatctaggacagggtcttttaacctgtcaagtcagtttcattatggccaattttctagcagtggttggggatggggagaggagagctttgatttttttgtgtgtagaagaactttccataagcctgtttggctcatggacatattttacaatgtaacctccctcagtcactcagaggggatcaagaagggccccctaaaaccaggaggacagatctagttgggcagcaaaatctggctatttctagaaatgctccctctccctgcaactgagcagttgtcccctacaagccactaaagcccccaatctttacctgtgaacccatctcctgactctgtggaatgcctgcagaggcatggtagggaacaaccgttcagatgttgatgagccatgctaggcacgtctgtgtaaatcatggccatgcattgggatgaagaaactttactttggaatctgtttaatgtagactctttttttttttgagatggagtggagtgcagtggcgtgatttcagctcactgtaacctccaccttgcaagttgcagcgattctcatgcctcagcctcccgagtagctgggactacaggcatgtgccaccacacctggctaatttttgtattattagtagagatggggtttcactgtgttggccaggctggtcttgaactcctgacctcaggtgatccacctgccacagcctcccaaagtgctgggattacaggcttgagccagtgcacccggccgactctctaccagaaacttttcttccaatatgaaggaagcatggagtgtaggctacagtcacttaatgatccttccaagttcagagtcatgataattcaggcagctcagctccacaggaaggcccagaaccacacagcccaggcagtgactgaattcttcctagtcaccagtggagggctgcctgcctgtgagggacctcttattttgtgtacagaatttatgttagacagggtcctgcttcctaaagagcagcagggatgttgtcctgaacagatgcaagattgccacagaaaagatgaggggtcatggggttggggaggacggaggcatcctcgggaaaggttctgctttgccagtctggctagaatcacctgagacatgaggatgctctcccactttctacttgacactcagcctaccgtcttgctctgccactacaagacctgggtcatcctctctgggccaatgttctcattcatagaaccagggataatacatctacttcagagttgtgaggaggtttaagtaagaaaatatgtgtgagagcccctgcttttatagtaggcactcaataaatgttgaatgaatgaaaaatcatctcaaatcacaaactataggatactgggttaaacaaagtggctgctggggccaaagctagacccccatatccaaggagagaggatctgtctcctctatctctaggcttgagcaaacagcctggagagctggcaatgcctcctcctgggtctgaccatctgcctctgtgggatgtaggaactcagcctaagtgcgatgacaccaatgatgatactgaggggaaatgaccgaagggacattctctgggttctatgatggagtagggaggcttcgtggaggagatgaggctcggtcttgcattataccttcgccctggcccccgcctccagatgctgctcagtagttttaatttctggactctctaaaggagagagggttaaggaaataaaggaatctcaaattaggcagtttgctaatgctactaactgagcagagattggaataatagaaaactattgactacaatagtttaaatttctccatattcccctagaaaatggaaagctgggcaggaacatgttccaaaggctaaatcttggcggagatgatgactctaatgaagggagaggtataattcttggtagacagtgtaaataactaatattaagctttggctaagcctaggaatgcctggttcttaagacttcactgaagaagggaagaaggaagaaagcatggatctgctctgggatgccctgaactccattcacataggcagggtaggcatggagcagggagacggaatccaatgccttgccattaatttaacttagatgaactactcctggtccctggagccactccccaggaaggatcctgtgaagacacatctggctctcgtgcccatgctcctgccactctgcccaaccaacgaagttagcaaatagtaaagtgttcatcattacctagttttgtattataaaatggaatcaggaacataaataggaacaagtagcaaaaccccagccctgcgtaggaccattatcctctcagccacctctgcgtaggccaatgagtttggaaagtttctcacagttttcaagtttcagcgactctgctttctgtttcaatcgttcatctctgtataatcctgccaaatttgtcagctctgactctgaaagataaaagaggtaaccaattcatcaagagctgaactcctttgtttcatttcaatgtttctggagtcaaagctccttttacttcatttcaagctttttcttacaattaaatataagaaacatttagtcatttattcacaaaacacgtcttaggtactagaccaggtgtggaggattaaagggcacctgtgaccctgcagtccaacagtatctgtgctctcttataaaagcactggacttagttcttaccaagaaaacatttggcaccagacttaggaaacctgcgcatgtgcagtgagaccaccctatagcctcctacaaacgggattccaacagcagctgggagagaatggagtccagtggcctattcctgtcatctgaaacagacagctgctttattcttctcctgcattgctgcatcataactcacatgtgcgaaggcacacagagcctactgctgccgggtgtgcgtccacagaaggccagggcactactggcgctgttcattccctcaccacacgtagggtccccaactcaaaggccaaaggcagctgggcctttctaaaagttgaatcatctggatccggtgacctttgtctccttgactaaattaatttcattttctctttatggtggagaaggtcattctatttttaaccagaatataatctctgctgtgtttcctgactcaacagtggtttggttgcctctattttttattcttttgtgaggtttcagacatattcagggaggaatgcctgaagagcacctttagagacgtattgcgtattaacaggatggcatgcttggatgtggtgtgtgtttcctgaaagcctccaacagcaggcagctactcaatgtttaaaggaccagacttgtaaaaatgctattttaattgttttgaaatatgcctatctattcttaatcatcttgctgacagattttgtttttcttggtggaacgaaagacacctgtctgattaatcagcaaactgcctggaaacggaattattatttagccagggggaacaatgggcattgctttctgaatacgtttctatcaacacaaaacactgtctggcatttctgtgcacaatgatgctatttacccccaagtaaggcccaaagtgcagattaagtgcaggactccagagtgagggatggatatgcataaaaaccctccctctacaatggaggccgcacagcctgggctctagcccagcagttgcttggcaagcagtgggtctcccaggctccagaacaatgcgctctccctgcttggtgagggtgcctgcagcgcctgctagccagggcttgccttggcacagtcacccttgcaggtgatggggcgtcatggaggatcatgggccatatccaaatgaaagctctctgctcctgcatcctgcccagggctcggcactaactccaatctcaggctactttggcatgtgggtaaccttgcccaggaggcctctgtgaagtcagtctatgcctttagtcctctggagtcacagttacaccagtattgaaacagattctgtggttttgcttttctttgaaatgatttcctcaggttttccatttgctcagcttttctaaatgcttcattccctgaaatcttgttccaggaaacattaagggctagtgactctttatattttctacattgaaggccacttcaacaagctgatgaaagataactgcttttctcaaaatatcacattgcttttcataaagttcactgaaaccagctcagagacccctgctccagagcaatgaccttgtacaaggtcagtgtttcaaggaatcatgtcccacatccccactaccaagcttaaagcaacttctctccaaactgccagtgaatcctttcatccttcaatgaacaaagggtcaacttgaagaatatgctacttttgacaaattctgttaatattcaataaattctaagtaattaaaaaaaattttggggagtggcaggttccagagaataccttttcttcttagcagaaagttccccttcctctgaatgccactgtaacagatggacagagcattgagccttaaagataaactgactcaggcaaattgccaagagaagcaagacccagaacctctcctaaggttctctgcaaaagagcccagattggtctcaacagctgaaagaccgcaacagatcccaactgccctcatgatccagccccatgagatggtgctacatccagtctacagtgcaaagccaggtaaagccaggactccaccagaaattaggcactttctatgtgccagacactgtgctaagagttacacccataccatcttccataacccacacaacctctctaggaggaagtggattctatccccatttcaaagcctaagcttctacccactaggttatcctgctcaagggtgtggaaagaagtgctcctctaccagtctgggccaggagctcagctcagctcagctaggccaagaggcagttcctgcctgctaccttcgtccagcccagcctagtggtgtggccacttgccctggcatcaggcttactatctagatgcagctgcgaagaagtaaacaggacaattagtgtttatagtaagggattactcataaaggtttgcccagattggccgggtgtggtggctcacgcctgtaatcccagcacttcggaggccgaggtgggcggattacctgaggtcaggagttcgagaccagcctgaccaacatccttgaaaccccgtctctactaaaaactacaaaaattagccaggcacggtggcatgcacctatagtcccaactactcaggaggctgaggcaggagaatcgcttgaacctgggaggtggaggttgcagtgcgccgagattgcatgactgcactccagcctgagcgagagagcgagactctgtcaaaaaaaaaaaaaaaaaaaattttcacccagattaaacattctaaggaagagcagagaaaaataaatgaaccaaacaaagatttaaaaagtcaatggctaaccttgctaaaaacagtttgcatttggtattttgccaagagtgaactttgttctcaagtgggtttatttttacaacctccaagtgctaaatttaaccttgttggctgcacttgctgctggattcggagggcagatgctgcttgttctcaaatggcacttgggttgtgtggaggctctgcatagccgctgtacttaaatgccagaaatagatttttaaggggtttgtgctgataactgccatttggaacttgtgggtacacgcatcatgcttactcactggattttttttttttttttttttttttagatggagtctcgctctgtcacccaggctgaagtgcagtggcacgatctcagcagactgcaacctccgcctcccgggttcaagagattctcctgcctcagcctcccaagtagctggaattacaggtgcgcaccaccacacccagctaatttttgtatttttagtagagaaggggtttcgccatgttggccaggttggtctcgaactccggacctcaggtgatccatcctccttggcctcccaaagtgctgggattacaggcatgagccaccacacctggccactcactggatttttatttatacctggagagtgccgaagctctgaactaggcctcatggggatggggacaaaagctgagaaactacctctggtgcaatccttaccatgagctctttgtataattccagcatcttactgccacagaggaagatgtggggcaggcgggtgtttgaagaatgtgaaatgcagattttcatccagttcttgcagaaagcaacaaagtcaaagccctcccaggacccagacaatggggattttcaggacatacactggctttcacctgatttggatccatgtatatactgcctttttattgagacaggatctcgctctgtggcccaggctggagtgcagtggagtgatcacagctcactgcagccttgatctcccaggctcgacctcctgagtagctgaaaccacaggcatgtgctgccacacctggcttatttttatactttttctagagatggggttcccaggctggtctcaaactcctggactcaagtgatcctcctgcctcggcctcccaaagtgctaggactataggcatgagctaccatgcctggcctatatactgccttttaatatgaggcctttatcctgctctaaaattctttcctgatttttgattcttgtaaaatctagtttagcaatggggtagagtatttcctgaatcctcagtgtttttcaataaattggaatttcctcttcctgtttaatttcctcttatatcccagagtcattgctcaccaacttcctaatgcaccttgagagaacattaggactttgccgtacagaaatagggggcagagaccaggtccctaagggtgagctaggacactaaccctgctgttgttattcacaatcctcagcattttcattgttttctactcctgagaatcctctcttcaaaagacatttgttgagcacttgttctgaagcaaggactgtgccagaaccctgggacacaaaattagtaagaccaagttcttattcccagacagtccatagtcttgcaggggagactgacatatatccctggaactctaacactgtgtgattggtactatgttagcaggctgaacaaagtgctttaagaacacagaggaaggagagcttaacttgagggcggggttgggagtgtgtgatggtcaatgagggcttagcagcactgtgactgaagagctaattttatcagactccattaggtatttaatgatactcagtaataaggctttagaaatgagtcagaatttgctttttaaacatgagccaaaacttcagttaaaagggtacctcctgaaaaataaaaaagaaaataaaaataatcaaaaccaagttttagaagacacagtcactaacgcggtatgtgtgtgtagaattcaagtgggaccaaaggtgaagctgttggctgagacggggctacccctgctgcagacactcctagtaacacttgctggagctgtaagccagtggcagatgctatcatccccactgtctccagagagggaaataggggggaaggcctgccacacccaaaggggcagacccaaggggtcgcttttgttctgtgtggccacaaccagctggaggtgagggtaggggacacctcattccataccagaaacctctaaacctttgttctgtttcaaaaagttaggctggctcgatcagatttccctctagggagtgtggaattgggaaactgtggaccaaatcagcgagcaccaagaacttacagacgtgtgtgctgcagaaaggggcactgactggtgagactggggaatttgagagagtgataagcagggtggcaaccactgtaaaccatggcaaacaaggttatgcaaaagggaagctggaagaaagaaaggaaggcagctggtggggagaggagagggggcagattggcagagagaggtagagactcaaagagagacagacatacagacaggtgactagtgccgcctaaattcctaagatttccaagtcctggccacatgtatcctgtcaataaatttcccctacttttttatagtatcctgaatggcctttgtcctctgactctgttcacataaacatgcgtagcctcaaacaagaagagaggagggatcaggaggctgggggtgcctcctgctgggaaccacagccaccagctaatgccccttttacagtatcttactttgttgtttctccttccaacaactagtctggatataatcaatgtaatccttctctattgttttctccaagtcatgcagagaagctcctctgtaggccttgtcaaagtttttatccacaaagtaaggcacctgcaggttctgagtttctctagaaatggtgtagcccaaggtcctgaaacaaggagagagaggctcatgtgagctcataatatttggcaatattactcttagcactgccctcacagatatcatcatcatcatctgctcatagagcagaggcagatatcattttctaatatacccaacacttcttatttccctagcaaagttgtaagtataacatcatcataattgtattatgtaagcaagttcatactatgaattcagcttcagcatagtttattctcttaaaggactcacctctcttatactgctctctgtgctaaaagtagaatgctgaatgcttaaaacaaacaatttttacgttgtgtaggatctagtatggtacctgacagagtaggctattataaatgctggttgaatgaactgattatgttatatagcaaattatttacaaaaaaaacagatagctcacaccaacctagaagcaatattttggacatgataaaaagtacttcgcacatagctgctaactgagaactgcaagaaactcagacaaaagatttcaatgatgctttagagctaactctctgtgggtccaagacatccaaaggtatctggtgcttagcaacattaataagagtactgagctgactaattctaaccataaggaaacatagaagggacctcaaactcaagttaaaacaatgtgacagaaatggttttcttcaaactggacaaattctacattaaaggggctatattttatttggcctttttccggccctctcctttgatcctctctaattagagtaagagctgaagccatgactgctctcccctcactctaaggttttgggggagcttacagagcaggtccgtgcttaccccgctggcctcacaagaaagaaagctaaagtgccatatggaaaaacatgagaagctgggaaacagagggaatcaggccagtgtggcctgatggcaaaaacctctctatgaaggctaggtgcagtggctcatgacggtaatcccagcactttgggaggccaagaaaggtggaggtcaggcgttcgagaccagcccagccaacatggtgaaacccagtctctactaaaaaatacaaaaattagccaggtgtggtggcacatgcttataatcccagctactcaggaggctgaggcatgagaatcgcttgaacctgggagaaggggattacagtgagccaagattgcaccactgcacttcagcctgggagcctgggtgacagagcaagactgcttcgaaaacaaaaacaataaaaagaaacctctctttcagcctcagcttcgctctctgtaaaaggaaaatactagccgggcgcgatggctcatgcctgtaatcccagcactttgggaggccaaggtgggcagatcacctgaggttaggagtttgagaccagcctggccaacatagtgaaaccctgtctctactaaaatataaaaattatccgggtgtggtggtgcgtgccgcctgtaattccagctactcaggaggctgaggcacatgaattccttgaaccagggatgtggaggttgaagtgagcccagattgcaccactgcactccagcccaggcgacagagtgagactctgtctcaaaaaacaaaaacaaacaaaaaaggaaatactgacctggattgacctggaatgatggtcttgtctacagtgatcactgacaaagactcttcctgttatatattgtctaataaattctacttttaaaaggtttttttcccactaaattataataatgaataataatttattattcattattaacaaaaaagataatctagtgattctcaaacttcagtgtggaccagaataatctagagggttttttaaaactcagacttctggtcctacccccagagcctctaattcaatggatatggaggggccctagaatctgcctttctaacatgttgcctgttgatgctgacgatggctggtctggggaccaaactttgggaactgaatcaactgaaagaattaattgaagaaatttttaaaaatcctatcagagtttataatctatacgcaaaaagcattacaaggaatttctctattttcaacaaaaacaaaaaaattgaaaataatcacttgatccccattattaatactatgctccgagacccacagggtccagcaatcctatcaacagcttaacagagtctttctaactctaccatggtgtgataatgagttcatctaaaccttaaattctactgatccttcaaaaaccagttactgctgttctgcagctgaccagatgatgtcactatagaacaagacaatctatttcccgaggcacacaggagactgcctcagtatttttgagtctcagcaccatgactacccagctgttcctttaaacatcaaatcggtgttttctacagcaaaaggtgaaatgaaatgttagtaatgtatcagcaaaaccttcaagtctttcacccccagactgttactgagaaagatttagaaataccagacttacgatttatagaacagactatatgggggattagtagccagcagctgagtaatgacagatataatcacaatcacaagaactggaagtagctgaataaatgcagaatatgtagtctgaaaaagaaaaaaaaataaaaacttgctgtaagtgttcttttttttttttctgtcgcccaggctggagtgcagtggtgcgatctcggctcactgcaagctccgcctctcgggttcacgccattctcctgcctcagcctcccgagtagctgggactacaggcacccgccaccacgcccggcttagtttttgtatttttagtagagacagggtttcaccgcagccaggatggtctcgatctcctgacctcgtgatctgcccacctcggcctcccagagtgctgggattacaggtgtgagccactgcgcctggcctgtaagtgttctttatcaatataaagcttattgaaaataagatagttgctccaaagaaaataacaaattatcaatgcactgcataggaggatccacaaagccccaggcttttctgggaaggctgtactttcagctgagaagtacaggttgggcagtcctaatcagaaaattcaaaatcacaaatgctccaaaatctagaactttttgagtaccaggatgacacttaaaggaaatgctcattggagcattttggatttcctttttttttttttttctgagacatggtcttgctctgtcacccaggctagagtacagtgacacaaacatggctcactgcagccttgacctcctgggttctgatgattctctcgcctcagcctcctgagaagctgggaccacaggtgcacaccaccgtgtccagctaatttttaaatttttgtagagacaaggtcttgccatgttgcccaggctaatctcaaactcctaggctcaagcaattctcctgcctcagttcccccaaagtgttaggattacaggtgtgagccatagcacccagcctcagattttcagattaggaattgtcaaatatataatggtataatgcaaatttccaaaatccaaaaaaaaaaaaaaatctgaaatctgaaatactactggtccaatttacttcagataagggatactcaatctataccaaataacctttactctctctgctgagcaggctgaaggaggtccaacaacaacctggattgacacccagtaatccccctgcagccccattaataagaccaatgaagcaaacatctctaggtaaacctgcccagactgtgcctcttacagtagtggggctctaggagccaggttagcatcatgcttggccacagctgattggactcaggggacatccaactctggcagaggtaatcacgttttctctcctaggaatttggggttgaaactcatcacccttcacttctgggtcatcactttaaggaagaacacacactctcaggcactgtagactggctatttgcaaggggaagtagaacaagcaaagctgcttggtgaaaacaaaacagaggcaaagagtggcaggaaaactggagacaatctgggcccaaagagtcctgcagagcacagctgcttgggagcctgacagtatcccagttccttgttcctgtctgtcatgaggcccagctgtgcttcttgtccttgagcttcatgagactcttttgatcccttaccttaaaccccctttagttctaaatattttgaagaggattcctattttctgcagccaagaaaattatgaagccggagcggtggctcatgcctgtaatcctagcactttgggaagccaaggcaggaggatcacttgagcccaggagtttgtgaccagcctgggaaacatggtgagaaataatctctacaaaaaatgagctgggcatggtggcacgcacctatagtcccagctacatgagaggctgaggtgggaggattggttgagccctggagtttgaggctgtagtgagctgtgtttctactattgtactccggcctgagtgacagtgagaccctctctcaaaaaaaaaaaaaaaaaaaaaaaaaaaaaaaaagccttgatgaagtcagccccacagattgctgagattctgggagagccacccaagaatgggcagagggaggggataccattctgcctatttaggccaattttccagctcttctaaccattgcttttgctttcctaaagcacatctttcctaaagcaacatatctcaggttcaacttctaaaacttgaccatgtaccatcaaggttggccaagtacaactgtttatgggcagcagtgctcctccctccctaggtacctgaggtttctcttcttcctcctccttctgagtctgtgtcctctcatgtcggtgccgtcgacggtaatagtaagtgtcatctgtcacatttgaaaacatatgaatatttcctggaaaagaaatacatggtatgggatatggcaaacactccttccctgcctttttcttttttttttggagatggagttttgctctgttacccagactggagtgcaatggggtgatctcggctcactgcaacctctgcttcctgggttcaagcgattctcctgcctcagcatcctcagtagctgggattacaggcacccgccaccatgcctggctaacttttgtatttttagtagagatggggtttcaccatgttggccaggctggtctcgaactcttgaactcaagtgatccacctaccttggcctcccaaagtgttgggattacaggcgtaagctaccgcgcctgacccttccttgcctttttcaaggtccttgttcccagctaggtttgttaaggatagagtattggcctattttacccagtagaaaaataagacaataggcaagccaagtgaaccagctggagctaaagcgtgctgagctctcctgacttcatttaaatagtcctttgcaactagtgagagagaaccccgaaaggctagaagagagagagcattagggccgtgaatcctatctggcatgttcacgtctgcttccgtgcccaataccatattgtgtcactggtatcttttaatagcaactcataaaattcaatttacttcctgggcattgaattataccaacttccaacttgctggggggtactttcctatcttctatctttgtaagtgctattttacacaacaataataggcattttgttacttatttataaggcacttaaaaatatctaatcctcacagtgaccctgtgaagtaggtattattaacagccccatttttcaggagaggaaacagggtcagagagactaaatgatttggtcaaaattatgcacagctgggggctggagacttgcctcaaactcctgctcaactgattctagatccttgctgtttccatcataccattgtacctctattcagattttcaaacaggagcttgctgagagccataaataaagaaatatgtttaagaatgataatttggggagactaacctgtaggaaaatgtcctccaaagaagacgttgaacagctcttctggagtgatgtcagcttcaaaatccctgtaataattataaggtctggctcgaggggcagtgaaagtcacctgttcatctccgtattcatcatagcgaagtctcttatcaggattgctcaggactgcaaatgcatttcctattgctgcaaccaacaagaaccagcacatgaggacacagtctttgctatggctgagagtgatcacagcagcagtgacaaagagcctagaggtgactcgtgctggacaacttcgcaggggcccaagaagagatgcttgggcctagaaagttctccacagtgcttgcccttcaggttttccctgatcgccagaaacaacaacattggaatcacaggaattaagaacttctgctgcagtgagttaactcccaatcaacagtcctgtagtcatcccagctgtcctagaagttaggaagcccccctcagttcgggttcccagtcaccacaagtcccaggcatgttggggaaatgttctccaactggtcagcactctcattcataaaaaatgtgttctggccaggtgcagtggctcatgcctataatcccagcactttgggaggttgcagtgagccgagatcatgccactgccttccaggctgggcaacagagtgagactttgtcacacacacacacacacaaagagtgctctttactttaaaaaaaatttttttagagatagggtcttgctgcattgcccagactagtctcagattcctggcctctagtgatcctctcaccttggcctccaaaagtttgggattataggtgtgagccctgcatctggccaaaaaagtgttcttatttcacttgagtgcaatagtttatgttggaaacagttcacacatcagtagtgatattttaacttgtagtccaaaaaatttcctgaattctcttctgaaacaatcttagtagaaaccttcctgcttgactaaaaacaaagtcttcatcatagtcttatttcagtttactttagacaaatattttctgaaattaagaaatgtatttccaatgtctcaaggagggttcaaaggctgaatagttacatatgtttaccaacatgtctcctttctatgtacagacgtgcaaaccttgcccaatttcatttaaacatacaatccgtagcaccaatcaatagaaacctcaaaaaaaagaaatcttttaaggcatcccgcactccctacctgtaattcagtcaacactgtcagaaacacagaaagagtatttcttcatgattcttttacctggggaattgttaaatgtttgccttgccactctgttacctacaactctatatatacatatgtacatatgtattgtaataattatacatttattttgctgaaccatttgaaaataggccacagatattacgtcaccttgcccctaaatacctcaacatatatctcccaagaagaaagacattctcctatgtgatcacaacaccattatcacagctaagaaaattaacatcagtccattatcatccaatgcatccatgcaagatcaagtatagcatttagtttcttttaagctaaaactgtcccaccttttttgtttttcattatgttaaattttttggaagaacagatcagtattcttgtagaatgtttcatattgattgtttcctcattattagattcaggtcaaacattttggcaagaataccccataggcgacaactacctagcactcaatggttttagcattcactgaagatctttgcctgtaacaatgacttggagtgcagtggtgcaatcacagctcactgcagccttgacctctggctcaagcaatcctcccacctcagcctcccaaagtgctaggattacaggtgtgagccactgcgctcagcctgaagaatatatttcttaaaatatcatggaggatgggcacagtggctcacgcctgtaatatcagcactttggaaggcctaggcgggcagattacttgagctcaggagtttgagatcagccagagcaacatggcaaaaccccatctccacaaaacatacaaaaattagccgggcatggtggtgctcacctgtagtcccagctactcaggaggctgaggtgggaggatcacttgagcccgggaggtggaggttgcagtgagctgagatgtcaccactgcactccagcctaggtaaaatcaagtgggagctatgctgattatcactatttaagaggtgtggcagggggaaaaaaccctccttatggccttataaaacaactatggggaaggctaaaagcaacttattatgaccaaccatgacaagggcaccattgagcattggttcaggatcagacctttgaaagcatctgttgctccaggagcacagttcttgtcagggtgaaatttcagggcgagttttctgtaagctttcttaagctcttcgtcactagcatctcgagaaactcccagaatttcatagtaatttctgcatttcttgatcctaaaaaaaatcacaagcatgtatgtctataaaggtcccttttgtacaactaattgcaagataatacatcgatcctacctccaatctgtgggacccaaaacaaacctataagaaaattagtgcacacgttaatgaaacattcaaattcattaacaatgtccttctcccacccagaacttaatgcctttcaaagtacttttacatctactatttactcttcctatatccctgcaagtgagtagaacaagtatgctaattgttacaccaaggttcaggctaagatcctgagagatgaactacaggacagcaaagccagaagaaacagttaatcaccctgtttgtttataattttttctctctttttcctatggctatctttttaaactgtattttttgcttttttttttttttttttttgagacgtagtcttgctcttgttgcctgggctggagtgcaatggcgcgatctcagctcactgcaacctctgcctcccaggttcaagcaattctcctgcctcagcctcccgagtagctgagattacagggatgcgccaccagccctggctaatgttggtatttttagtagagatggggtttcaccatattggttaggctggtctcaaactcctgaccttgtgatctgcccaccttggcctcccaaagtgctgggattacaggtgtgagccaccgtgcctggctaaactgtgtttttaaaaagttaacatacacatgatagaagaaaaagagccaacagaactaaagtttatacagtaaaaattttcctgcttcatcattccctgtcccccagtttcccaccacagggataaccatcattagaagttttctgtggatcctatgtacagagagtacaggtatagtcctctccattttttttcttgcctaaatggaaacatattataatcacttttctacatcttgctttaaaaaaaaattattttgggctgggcgtggtggctcactcttgtaataccagtgctttgggaggctgaggcaggaggactgcttgaggtgaagagcttgaggccagcctgggcaggatggtaagaccctatctctatgaaaaattttaaaaagttagccaggcatggtgccttgcatctggaattccagctactcaggaggccaaggcaggtggatcacttaagcccaggagtttgaggctgcagtgagttatgattgttccactacactctagcctgggcaacagagcatgatcctgtctctaaaaaacaaacaaaaaacaatttatcttggagatcaatccttaacatatagagatgagaagtatagaataatagtttagactagacagtagtttagattagagtggcagttctgaacttttgatctcagcaacgttttatactcttaaaaattactgatatgcatggtacaggaagcgaaaaaaaattactgaagacctcaaaagagctttcatttatatgacttctatcaatccacatctactataccagaaatgaaaacaaaaaatttttaaacagtgatgatgtaattacatgtcatgtagcctctcaaaaactccactgtataatcatgagaaaattagtgaaaaagacaagtaacatgtttatatcattatgactacagttttaaacttgcagacctatcccctaaaagggtcttggggttccccaaccaccctttgagaactgctggattagagatgagctctggagtcaaaatgccttggtttagctttgattttgctgtgtacttaacctctatagcttggtgttatcttctgaaatgggctaataattatatttcacagagttgatattgtgattaaataaagtcttcatcaaagtgcttgagagcatttaatactaaataaatattacctagtactatatatctacctcttttttttttttttgagacagagcccaggctggagtgcagtggcgcgatcctggctcactgcaacctctgccttctgggttcaagtgattctcctgcctcagcctcccgagtagctgtgactacaggcttgcatcaccacacccagctagttttttgtatttttagtagagacagggtttcactgtattggccaggctggtctcgaactcttgacctcaagtgatccacctgccttggcctcctaaagtgctgggattacaggcatgagccaccacgcctggcctacctcattctttttaaaatctaaatattattgcattgtatcaatgtataatatatacattacctactaatttgtattgagaaggtcttcagtcttttgctactatataattcagtaaggcaggcagagattcggagcttcgttgggaaattcatcgtaagtcagtaacacaggttggactctaatgcagggtctgggctgtcagcagatcccttccacatgagctgcccatggggagtctttgaatccccagcccagtttccaatctctgcttccatggcagacactcaggactccctctcctaaatttactatttgtttaataatgctttattgagaaataatccacgtaccataaagttcacccttttaaaatgtacaattcattagtttttaaatacatttttagaggtgtgcatctatcaccactatctcatttcaggacatttttatcaccccaaaaagaaactctatactccttagtagtcactcccacttctcccccagcccctgggacccactaatctactttcccctctatagatttgcttattctgaatattttacataaaaggagttatataacatgtagctttttgtatctggcttctttcacttactgtaattttttcaaggttcatccatgttgtagcatgaatctgttcatccctttttgttacaaaatagtatttcattgtatggatatacaccatgttgcttgtccattatcagttaatggacattgggttgtttcccctttggggtcgttatgaataatattgctatggacattcatgtacaagtttttttgtggaagtatatttatatttctcttggaatatactaggagtagattgctaggtcaataatcttaattttcttctgaaccttaagaggaattgccatattgttttccaaactggctgcattcctaccagcaatgtacaaaggttccaatttatctgcttctttataaacacttatcatccacctttttgactatagacattccagtgggtatatctcattgtggttttgatttgcatttccctaatgactaaagatgttgaacaagtttacatatgcttactaaccatatatatatcttctttattcatatatggaggaatatataggaggaatgcctattcagaccctttgcccatttttccaattgggttatttgtcttcttattgttgagttttaagagaactttgtacgttccagataaagtcccttatcagatatacagtttttaaatgttttctcccattctgtgggttgacttttcacattctttttttttttttgagatagagtttcactcttgtcatctaggctggagtgcgatggcatgttttcgactcactgcaacctcctcctcccaggttcaagcaattctcctgcctcagactcccgagtagctgggattataggcacctgccaccacacccagctaatttttgtatttttagtagagacggggtttcaccatgttggccaggatggtcttgaactcctgaccttgtgatccacctgccttggcctcccaaagtgctgggattacaggcgtgagccaccgcgcctggccacagaactttatttttttttagagacagggtagggtccctgtcacccaggctggagtgcagtggcacgatcatagctcactgcagcctccaactcctgggctcaagtaattctcctgcctcagcctcccaagtagctgagactacaggcatgcaccataaccctgagttaatccaaaagaactttttaaaggcagtcccttaatggcaaagtacttcctgacttcacgaagaaaatatcaatggagccagtccagaaaaagggctctcagtgcccaggccttcttgctgtacaaccaaaaggctggcagctggtgttcatcttttccattcaaggctcaggggttagcaactttatatataatggcagcccccatcataaactgaactgcatttgcacaaaatagcagagttagcctatcccttcctgccttatatcctgatgctcacttctcatccttactagtacaatgtcctttgtgacatttcttttccagaatagggcacttttgtctgcactaaaaagttgatgaggtagggctggccgcagggttcacacctgtaatcccagcactttgagagactgaggtgagtggaagccttgagctcaggcatgcgataagtaataatcacatcatggactgtatgcctttcttatagcagtcctgcacccatataaaagcttcattttcaatatgagatgaaaaggtattttgcaaaaagtgcaatgttttcttacctgctggcattaagtgcaggtggatcacaaggccaggagtttaagaccagcctggctaacatggtgaaaccccatctctactaaaaatacaaaaattagctgggcatgatggtgggcgcctgtaatcccagctacttgggaggctgaggcaggacaatcgcttgaacctgggaggtggaggttgcagtgagccaagatcgtgccactgcactccggcttgggcgacaagagcaaaactccatctcaaaaaaaaaaaaaaacaaaactggagaactgcaagagatcactttttactgctatacataatttactcaagagacaaactgctcacaaagagatgattagcatcatgtggcattttaagcagatactcccaatacttgaggctcagcaaaataacaggagctaactacaaaattattacagtagtacagtactactgttaattttatgcaggtgtgattaatactgcacctgtatgtttacatttttctcaaatgcaaatggtaccatgtagtctcaagtgtttgtgagcatatgttttgatagattttcactttttataatagatttgtgtatattttatgatagtaaatgataaaatagactagaatctagatatattttatgcattcatataattttcttaattttttggtatgtccatgctccatggtttgtgagatggtgatgatgatgattattatttgagacagagtttcgctcttgttgcccaggctggagtgcaatggcacaatcacagctcactgcaacctctgccttctgggttcaaacaattctcccgcctcagcctcccaagtagctgggattacaggtgtgcgccaccacgcctgactagttttgtatttttagtagagacggagttttgccgtgttgcccaggctggtctcaaacttctgagcccaagtattcttcctgccttggcctcctaaagtgctgagattacagatgtgagccactttttcaaattgttgcaaatctaaaaaatttttccaatgtatttatcttttaaaattgacatataaaaatccatggttcaaactgatgccactcaaacctgtgttgttcaaaggccaactgtatctcttttttaaaactatttatttatttatttgtatatagagacagggtcttgctttgtcacccaggctggattgcagtagggtgatcatagctcacctcagcctcgaactcctgggctcaagggatccacctacctcagccttctgagtagctgggattttgggtgcatgccaccacacctggctaaatttttatttttagtagagacagggcctcgctatgtcgctcaggctcgtcttgaactcctagcttcaagagatcctcctatctcagcctcccaaagttttgaattacaggcatgagccaccacacccagcctcaactatattttcttaatttcatttttttattgttcattgctagtatatagaaaaatgataatttttgtatattgatcttatatcctgtaactttgtccaacttgtttattagttctaacagtatttgtgtgtgtgtgtgtgtgtgtattcattaggattttccatttacaagatcatgtcatctgtggatgtagttttactcttctttccaatttggatggcttttatttctttttcttgcttaaatgccctggcttgaccctctagtacaatgttgaacagagtggcaagagtgaacagacatacttgtcttgttcctgatcttggtgggaaaacacctagttgttcacctttaagtatgatgttaactgtggatttctgtagatggactttatcaggtcgaggaagttcccttctattcctagttaagtgtttttattatgaaagagtgttggggctgggcgcagtggctcacacctgtaatcccagcactttgggaggccgaggcgggcagatcacaaggtcacgagaccatcctggccaacatggtgaaaccccgtctctactaaaaatacaaaaattagctaggcatggtggtgcgcgtctgtagtcacagctactcaggaagctgaggccagagaatcgcttgaacctgggaggcaggggttgcagtgagccgagatcgtggcattgcactccagcctgggtgacagagcaagaatccgtctcaaaaaaaaaagagtgttggattttgttaaatgctttttctgtacctattgaaatgatcgtgtgatttttgtcctttattctattaacatggtatgttacattgattgacttgtgtgtgttaaacaatcctgcaatactgggataaatcccacttggtgaaaatatataatactttttacattgctgtatttgttttactagtattttattgaatattttaaaatctatatccataagggatattggttgataatttagacttcttatgatatttttgtctggttttggttacagagttaatactggtctcaaagaatgaagccagctgggcctggacttttcttcattggaagtttttttttttttttttttttttttttcagacaaggtctccctctgtcacccagactagagtgcagtggtgctcactgtagcctcgcccttcctggctccatcaatcctcctacctcagcctcctgagcagctggaactgcaggtgtgcaccaccatgctcggctaatttttgtggggtctttttgtttgttttttattgtactaatgaagtttcgccatgttggccaggctggtcttgaactcctgggctcaagtgatcctcccacctcagcctcccaaagtaatgggattacaggcatgagtcaccatgtccagctagaatttttttgattgttaattaaatcaccttatttgttgtaggtctacttgggttttccttttttttttctttttcttttttggaaataaggtctctgtcaccgaagctgcaatgcagtggcactaccatagcttactgtaacctcagattcctaggctcaagtgattctcctgcttcagtctccaaagtagctgggaccacaggcatgtgccaccatgcccaagtattttttttttctttttttagagataatgtattgctgtgttgcccaggctggtctcaaactcctggtctcaagcaatcctcctgcctcagcacccccaaagctctgggattacaggtgtgacccaccatgcctggcctccatttttcttgggtcagtttcagtaatttgtgtctttctaggcatttgctgattttatctaggttatctaatttgttggcacacaattgttcatagtatttggattggtagggatatccctctttcttttttttttttttttttttttttgagagacagggtcttgctctgctgtgcgattatgactcactgtagcttcaacctactgggttcaagcaatcctcctgcctcagcctctcaagtagctgggactacaggttggtgccatcataccaagctaatttttgtatatatatattttttggaagagagggggtttcactgtattgtccaggctgtctagttccttaaggtagattaggttactgatttggagtcttttttaaaaaaataagcatttagagctataaatttccttctaagcactgttttagctgcatcctatacattttagtacgtcgtgttttcattttcactcatctcaaagcattttctagctttcctagtgatttattctgtgacttgcttgcttattaggagcttgtagtttaatttccacatatttgtgaatttctcaaatttccctttgtttttgatttcagagaacatacactgtatgatttcaatctttttaaatttattgaggcttgttttatgacctaagatatggtctatcctggagaatattctatgtatccttaagaagaaaatcgttctgttgttgttgaaagaatgtcctgtagatgtgtgttgtgtctagtcggtttctgctgcctctcttaaagtagaagcagggtagtcagttcatgttataccctaatattccacttctattcagtcttccctctgaggtcaagaagctagtatgcctcaattatcatcatcatcatcattatcatcagtcaatacttacatagcacatccaggcactcttctaagcactttccataaaatcactcatttaatctcaccacatgctcacctttgtaccccaagcagctgttcctcactatacgtggagttcccctcaccctgccgggtctgagtccactcattctcagacttcttttccttttgtgccttcatgcagttacagcagccacaggggtcatgactctcaggaggtgtgtcttctgggtatttgtttcttctaactgcgtcaatgtaagctgcaaacaacagcccctccattaggtctccatctgaccctgaaaatcaactttgcaacctgcctttcctctctgggaggctgctcgtaagcatgagaaggtaagcatgatggccagggctagaggcgtcatgctgacttttaagcactcatacaaagctgaataaacatgtttctctgtggtccgtggtcagaagagacactgctcgtaaaatagtattttttgttgcagtgcctcccacccctaaaatttaaagtagagaggagttcaattcttttacactaacaattatagaactaatatataccaaggaacttggctagaagatcaagagggcggatgggtaagatctactcctgaccacaaagaggttagtttaatgcaagcttgtccaacccgcggcccacaggtggcatgtggcccagcacggctttgagctcaatacaaattcgtaaactttcttagaacattatgagggccgggcgcggtggctcacgcctgtaatcccagcactttgggaggccaaggcgggcggatcacgaggtcaggagatcgagaccatcctggctaacaccgtgaaactccgtctctactaaaaatacaacaaattagccgggcgtggtggcaggcgcctgtagtcccagctactcgggaggctgaggcaggagaatggcgtgaacccgggaggcggaggttgcagtgagccgagatcgcgctactgcactccagcctgggtgatagagcgagactccgtctcaaaaaaaaaaaaaagaacattatgagatttttttttgcaatttttttaaagttcattagctgtcatcagttagttatttagtcgtcagttagtgtattttatgtgtggcccaagacaattcttcttccaatgtggtccagggaagccaaaagattggatacccctggtttaaagggagaagattcaataacaacacctgcagaatgtaaagagggtcataagcaatacagtcaaaaggggcagagcactcatgtcttctctggaggacctgagaaaggctttaacaacatctttcttccgcttaacatccctcagctacctccacccactgctcctggacagtcttcctctaagtcggcctggctaactccgacgcatccttcttgtcaccatttgtaacactttctgcaagaaacctcccttgacagccagtctgcgttaggtaccttgtaagtgtgctctccaaatccctgaccttgctgtgtagcccaggcgttttgtattattcgcccgttttgtaattggctgttcagtcgtcaaactctctcagtgggctgcgagttttgtgagctaagggacccatgtcagtcaaatccccactgcagaatcagcattaggcggggcacacaataggtattggatcaatattttttgcctgactgtagggtggaaaaggctggtcctgatgccggctggagcgacatgatcaaacagggactgaaggtcaggtggcccagttaggcgaaagataagggccaggttagcaagctgcggagagaccgcagcaccccacgggccctccagtcaccttggcatgggcggggcctgacagctgcgggccctgggcggggcacgggcgggggcggggctgggggccggaggcaacaagtcgtcaccggtgactctgggctcgcggtcggtccccagcttccctaccccatccgcaaccctactcaggctcagcatcttttcacaggcctctatccatcacctcagacccaggatctcagcccttgtgcgtcttcaggatcctcatccctgatctctcccgaaggccgccctatccctccttcaggcggggacctagtaccttccgtccagcgctccccgctgcccagagtcgccgccatatcggttcccaatcagcaggtccgccgagcctcccccgtgcccgaggctgaaagagaagggggcgcggagcgcggggcac

SEQ ID NO: 864 - DNA, 1502099 bp, Homo sapiens
  misc_feature (369735)..(369735): n is a, c, g, or t
  misc_feature (455030)..(455030): n is a, c, g, or t
gttgcagcagagaaggaagtttaatcataaggctgccgaataaggagacagggggaaacctcaaatctgcctgtctgagccgtttaggtctaggtattttaagggagttggagtgaccgaggtgggggatcactggttgaagaatacaggatggtgagatgaagaaactgcattttcatgctgattcagttcctcttggggagaggcggggggcggtcttcaaactggttggcaatagctcttttgctggaattcaggatctgaaaaacatcttaagccatttttaaacaaacaaaggccttatgattctaacatcagaaatcttctctgtaggaacaatgaggaggcaaatggttagcatctggtgctctgggacttttggttacgaagaagtgggccaaagtgcagcctgattaatgcttaattacaactatatttctgtccagaacccagcatctaattcttgttaaccctgtgaggatggtttcaatagaatgtttccattgtccttaaagggaggtatagttagtcccattatactccaggtaatgatgacagtcttggcaaaatcttaggaccctaagttgtttgccacctcacaacctatattatccgtcctagtcttagttaccacatctgactgctgggaagactgagggtgatttgtttggtctgtgcacaaaacctttaaagagaaatacacatgttagttaacttaaaaatccacaggtactgtggcaatagtttgtgtaacaagttagggtaaatatctttctggtaagatgtacaagggaagtcaatttacctggaagacaggaggtgtcaggcctccaggcaagacagaagcaaaaactgacaaaacaaagcctacaggaaatttgggtaataagtttgaatcttcttaaagttcttaaagtgtctagaaaaagcattctaagacaaaactcctacaattcagcaagccttgggaaaaaggctaaagctttctagcctctacctgaaaatacccactgcatagaaaacccaggagaaaaaattcaacctaggcagtcaagtctgaggtattgtcaccccatttaaatttgaacagggcactctaaaatgacatactggccttcataagaggaacagaaagaggtttgtagtcatgcccataggcctatgttcttaggtaaactaaactagcttgatccttaaaaaacgagagagagatggtgaacagtggaaaaggttcaaaataaaatatgaaagacagcctctgttatagcacttgccatatccccccaggcaactgagtgcagagctgacaaacttatgacatgggagaatgaaataagctttctagaatgcaaggatctgagtacaacaccatatttgaacaacaatagggggcaaggtagtctgggtctttaactatttagaatactctaaaaagagggctggggagagaaaggccaagtgcacatatatttaaagctatccagtaaagacttacttacatttcaaggtgaaatcagaatacaatgaatgtgttttctagctaaaaatcatgatcactaagtggttgatacaattttttccaatcaattgctaacagcatttattcactaattttgttttttatttgtgtctgatctacttctgcaacttataacatgaacatatttattcacaggtcagatgaagaattgcctaattttaatttggaattatctaattctaaaaacaaaaaagaaactatttataggagaggatctgtaactggggtccatgggagtttattaacaggtttgccagaaaaaaatacaagataccagttaaatttgaatttcagataaacaagtaatttttttagtctagatatatgccagtattgcatggtaaccctatatttataaacaaatttcagagagatagatacatttctctctctctctctcctgtttttttgaaactgagtcttgctctgtcacccaggctggaatgcagtggcatgatctcagctcactgcaacctctgcctcccaggttcaagcagttctcctgcctcagcttcccaagtagttgggattataggcatgagccactgtacctggccttctttaacactttttgtttacaggccaaacatcaccctcagtcattccagcagtctactatgtgaactgagactaggagggataatatagattgccagatagatctaggcatgagctcgttagacactgcataaaaatttggagtagaagcattttgacaaggaaattggctatagctatctttctaccagagtcttaaacctatgatctctcaacagttagtcatcattaagacaaagattaattctatcaagccttgacttttccctgtggcctgagcttcctaggagccgaacataaagggaaacatgaagggcaatttaccaaatagcaactgaagagaagagtccactcagtgaaagcagaggagtttgcccgggggcgtgttagggaggcagagaaagctggtttacagggctttgcagacagacttgagcctaagggccatgtcacacctttaagttaagttggggttgaccttttaaacaagaagttgtgcatgacagaaggtctgctttgtgaacattggattctggaggagcaccaccgcaggaaagactggagaaaggtggtggtgggctgggggcactggcttggaagaagagagtgaagaggcaggagagttggaagagactgggaggctgggaatacagtactcaagggccagggttttctcccctccagctctttgtcctttgcagccaccacccaaggatgctggtgaaggtgtttttgtgcatccccattctgagagtgcagcctctttcctgaggcccacgggagggtctgggtaatgacgaaatgcagtctttacctgtgtcactgaaagtagacccgcagagctgcggcttctgctgccatttcctcctctgatctccaagaggcaggaaagtcctccttgtcatgtttctggagctttggagaaaaaaaaaggaagaggctctttcatgggcccttgggatctccttgaacaaatttcggggggctgggggagactgaacaaaatttgcaaattagaggccagtaggtgtatcttttaattgtttcagttgctacaacttgcaaataggctttatacaagaatccacatttaaaataatcagatcatttgccatcttgtaatcatctactgaggctgaggggggtgatgatatgatataggtctgtgtccttgcccatatctcatgtcaaattagaatccccagtgtcagaggtggggcctggtggcaagtgactggaccatcaaggcagaattccccattggtgctgttctcatgatagtgagttattgggggaccttattgtttaaaagtgtgtagcacctccctccactctctcttcctcctgctccagccacagaagacgtgcctgctttcccttccgccatgattgaaaggttcctgaggcctccccaaccatgctttctgtacagcctgagaaaccaggagccaattaaactgctgttccttataaattacccagccccgggtagttccttatagcactgtaagaatggactaatacaggtgatcacagattgggatgaagtgggggaatggggagcatttgccattcccagaatctcccccacactcttctaattttcttatgtttaacaggcatcattcatttattttacttcctggattttgaaggcattgagtttgccaccaacccataatcccctccttcaaggtggcctgtggtttacctcctactctctttggtttagactctcttgcatgagctctgagcagttttgttcagtgaaccaaatttatgataatgacacaagggccatgagaactgagtaagtaataagtatttccattaaaagagggttcaagcagggaaacagtaaaaaagagattaaatgagaaaacaacttacaaaaaattaacaatttgtctcaaaattaacacttgaatcatttaaattcctcctcagattacaggcatatttaaaaaattgtgtgtatgtctcagatttacatatagagtgaatacaatttcaattctatcagagaggatgttctcagaactctcttccttagaaatgctcaattttctcccttaacctcctattatgattcaatttcattaactaaatttattgttcctgtgtgtggctctatacattgtaaaatgccgcaggttatccgttcattcttcatgggaatgcacagtgtagtattttgtgttatgtgttaaaagtcatttgggattgagacaatttaatagcaccaatgatagctagcatttatgatgtgaaaggcgcacattatttctttgatatacattatttcgtttaatccttacaataactcataaaactgacgctacttaaccccatgttactgtggaggaaactgagttctgaggaagttcataccccggtccaaagatcacccagctaggtagtggggtaggtgccagtattatccccaacaacttttgcctttttattcatcctgagggatctacagtgtccctaaagagcatcccacagatactgttccactccattttgaaaaaggtcaacttaacgattaaaatatcgactttttaaaagttgatcctttaaaaataattttgccaactcagcaaaaagtctatcaactaataaatgacttttgctatctcaggccccaaactctaaatctaacctagaggcctctaccctggcagcttgcagcagatggagaaatttccccatttattgcagctcaacattgatacagaaggcaaaacagtgagggaaccatagcctcgcactcccgctgagctgtatttccactcctggtaagtaagtttgagcctaaatgaggctcattagcatataaccgggccacagatacatttatgagggtcatggatcttcccttcagaatttggctgccagcacgctgattttacattttgccatgtagatttaattctccttagtgaaagaaaaccacattaagaagtcatttcctttcttgcagaggcaaacatgctgcagttgctacaggcaaggcaaacgggattgctattcttctactcaagaactaattttcattttgatactaccttgacgtctgttataaatccatcttatcttataacaattcaataggatgacaaagagatatgcaaagcccaggaaatatggccttcccacttctgctactgccattggaagacacagaaataaagcattaagtggcctcaacaacacagatcataccagaggaatccaaataatttagagcctgtgaatgttaatgccttcctggttattaggcaaccgtctgttattgtcatatgccttacagatggcaacattgtgccaatccttagaagaagtttttgggaaataataggaaataaataaaacaaaaactaatcatctttgcaaaaactctgttgtacctagcttttaaaagttatgagatttccctcctaaaagccccagatggaagcatgtggttctgtttagaacagcggcactcaaccctggttggttgcccactgtaatcatctaggaagctttaaaaaataaaacccaccccagggattctgatttaattggtctggggcagcctgggtttggggatttaaaacaaaacttctcagccaattctaaggtgcacttactgttgagaatcactgctttttgggagaagtgtgtagatagagcccacacacatatagaaagaatccgcttgcctttaagcacattgcttgtgatcctatcaacagtactactgctgtcctttgcaaaccttgccctagaactgcttttcttctgtttatgctctgtccatgggatgtctggcctacaaggcttgtcttagcaacactaacatgcggatgcagttcagcagcctttgaatgtttttaatctctgcagaaatagggagcctgggaaaggccctggtgggcaagacttgtgtcctagaagatccatccaggtgacttgaagactaaaaatgctacagtttggagtaaagttccatttccctaaagcaacccaagaacctggtggctgcaacttcttgcctggctaacggagagaaagccctaatgatcttaaatagtagtttatccaaaaggcagtatttgccgtgggtgaactttaatggaggagtttcacttctgataagccttctagattactttggctgcccacaggggagggcggtgactacttgttaacacacaagacagttgctctgtctctgtaatgccaggggccagacctagcactggaacactgaaccagacagactcctttattgttctcctggggcacccaggtagggaggttacacaccaaacggctgattcttagtgagatgggattacaaaatgggaaggctgctggatagagctagcctcattgcaaaggcttttgagtatcaccttggtttcacaaagaaacgttatgaaaaacagtgatggagggaaagaggttatctacggatcatccaaaaatggctctccaagaaggcgagagttagttaggtctgagcttgaacaatgagaagaacaaaagttcctttaatctctttgtgtctcagttttcccctttgtaaaatgggagtaggaaaaagagtggtgagcagtgccgtgcctgacacatagttaagtggtatttaatattccctgctgctgctactactgtcagtcattagcattatttttaggctaaataacactgacctaatgacagcgagcactaaaaattccacagaggttgtttctaggagtaaaagtatttttcatctccatggttccccagtgatctgtatcttttggacctaactaactactttgtagaaggattaaaagttatgatcagaattcagatccaaaacaacttattataatgagacactcaaatctggggaggaaatgtacctccttcagctctaaagtgaccctcactaatccctaatcctcagagctgtcctaaggagtgagtaaggtattaatcgaggcttctcatggtaaaagctaaggtcctatggtaaaagaatgtggtggaggtcaaaggtagtcaataccccaggagtatggttgccagatttagcaaacaaaaatacaagacactcagtgacttgttttaggataaggatgtctcatacagtattgagacgacatcctgatatgaaacaatgatttgttgtttacctgaaatacaaagttaactgggattcttgtattttatttgacaactcaacatagcagaccccttaaaaaggtgtcacaggaagaacttggcttgcatttggtaactaggttgttcccaaagttgcctggctgtgaatcctggaaaaaacagaggggatcatgtgcaggaagataaaattcaaggccatcattttgtgcactccagggcttattattattgcatggtcttattgcacggaatgcagtgtaaatcaacctgcactattttaattccttagttcaccagttctaaggtgcacattttttcatattttaacatctttgaaatcaaaacatgtcctataaccaaaagtgtgtcatagtttaattggcagtgtttttctttcttagtagtacataaaataacagcacttccaactgactgtgtctgggattcagtgcactatatttctccatctctcctttctgcaggtaagtcacgtaagttaaatgtgactctgcttgctctgaaaatgctcaacaccaacgctgatgtattacatactggtttccttctgatgcaacaacaatagtcaaaacggttttcacagaagctttgttctttagaggaaagtgcacgccaaagtgacaacgtttgcaaaaacttgaaccaaagtctttattcacattcaacagactgaagtctgtgatggcctctccaagcaaattctatttctgcacagctttgaaaagagatttaaaacaaaaaatctatcttcagtcatcccactttatctgctagaaatggtttttggggaaggtagtgttaacaggatttctgactgaagaactgatacgtgtcgattttgacactgtgctccctcctgtgcactgagtgtgttatcacaaggtatatggggtaatgatgaattccctgctgtattgctcaaaccgcctttgctattgacatctttagagttctgtaatggaatgcagtaggaggaatggttcacaataatttaaatgtttttcagaatttggaacgaacctggagtaaaatgccaaattgtcttcaaacgggggaaaactactttaatgctcttcttacagaagcaaacggctgaatataaacttggatgtttttataaaaacatatttcattattatcacttttataaaacaacatacagaagcagagagcttaaataaaccatttcttatgggttgacggttctgtttacacaggggtttatataaagtctcaaaaggaaaataactgtattgtttttttagatctgatcctctcttattactttctattcaaccaagttttgatgaacacatgatatattccaggctctgttctaggtcttatgaaagatgatacaaagataaataagcccaagatctttgcctcctcaggttcaccatgcaataaggcagacagattcatgcatagataatttaatactggcctaactaccgaactagaagttccatcaaagtgttcttggagtatctggggcagggggagacaaaataattcttgctggaattcaggtctgagattgacttttaaaaatcaaggacttggactgggcttaaaagatggtaatgagattttgaagaaagggtaattctgggcaatgggaacagcttcgttaaacacatgatgcgagtaccagttccccagcaaggcaacttgtacccatggtcagcttcaccaactaattacagcactgttccctgatgaatcctgacctggcttctaggcagctactaacaaacatgtatcagagttagcaagagagctgaaatttgccactttgagaagccttaacattccattgtttaaagatggaataggcacgcacaacaggggtctaaaagatggtctccggccctacaaatgcaaagctgcaaacagctttgaatcttactgagagaaacttattcccttttcagtgatctttcagtccctctgactgttcaagaataaagtctcagcggactagtacgtccttgataaggcatcaacaacacctctaagagaaagagaagagccatccagactggctagaatataataagattgttttgtttagatcatatttatttttagggacatctctcatttatgacaaatcatgtcaagtctccttttaaagtaaatttaagttaaacataaaagaatcaattttaaaaatatatgaaatgaaatggtgtgaaaatatggcattaacagcttgagaaatggcccctggggaaggaagtacaactgaggtgggaaagggtgactcaagatgtgagggtgatgcattggcctttaatgcttgtgggtggcagtttctactgggctgagttctagaaagctacatttttcatggatgcatgggagtcaaaataatttcatgttataagaactccgtcaaaaaatggtatgggggatggtagaactttgggtagggcaggcttttaaaggaaggcttcactgaagatgtagcatataagttgaggtgtgaataatgagtatttaagtaaaggggcaggaaggaatatttcaagcagaaagaacagcaagtgcagaccttcaaggaagtgtggtggttgggtaacaggctggaagagtgagagagaggacttggggggatggcagatcatttgcaccctgtgggcagggctgagaagtttggattttatttttggtgtgatgagaagataggcaaggaagtaaaaggactagaataattgctcataaagaatgtcctggaaggataatgaattaaagggagaaagtgatggcaacaatcagaagagaaagtttgggagagggggctcatttgccccataggctagttagcgtcatggccactaagtgagaggacttggcccctcactatagatggaccttgtcatctggcagctttctccctggtgcttgtctgtaaagcacacagagatcctggcttccctgccaagattgctctgaactagtgtgaaaatcactcagtttttgcccaatatccattctgcctctcttctatcattcacttctcaaagttcccgagaagccttcctggaccattctgattgagtcatatttcacgattctggatgctttcatgcttctggcacctccctggcactgtcctttcagtacatgtttcctgccagacatggagcttcctttgtctatgtgctggttactgagcagactggcgcccacgctggactttcttggtggcccaatgaatcaccaggtgctttcacttgaggcagaaaatggtcttggaccacaaacctctgcctgccacttgtgataccttagaacgctgaagttctttgaatattacttagtagaaaaatatgttcattgcttcccttctctatcctgtgaactggaccttggactaagcactagactgtgagatatctatgtgcaaacaaattaccttcaggtccttctacttactgtgaaagttcaaaagcccagttcctcctccttttctgaacagaaattcaagtaatcaatggagcattaatcatttgattagttgccaaagctttgacttaagcataacttacttgagtaaaagcaagtatttttagtgctgcctgtggggccaaaatgctgaaataagctcttatattaattagtggcatcccattttcaaggggtatagagtgttggatgtttaagaatttgtaacccccaaaagtaagtattaactagaaaatcacagtgctggaaaataattatgccaaaccactgtactataacagaccccaattgcttatccaattatacattgaagtatcacattgtcaagccgattgccaaagcggcaaatgagactttgctagcatcataatttggaccagatattactccactaactacactatgaatagtctttggaacatgctatgtaccctatataaacctccacgaaccaaggtgggcatttcaggtttgttggagtacgcccatgccatcaaaaaaaaaaaaaaaatcactggaattgattagacatgaaagttcacagttttccattgaaagcctgttaggagcatctcagcaaagagcaactgcagctccaggttctgagcagagttgatttcaattaaaatatcaaaggtagtcacttcctgtcagggagaccatcagtaattctatcctcaaatgtgtatctgagaaaaacaaccccagacactgcctcctggatctgcaacactgctccctgattgattggccaccatttagaggtaatttttttttttttcgagacaaggtctcactctgtctggagtgtagtggccagctcactgcagcctcaacctcccaggcttaagtgatccagccacttccgcctcctaaagtgccggggttataggcatgcaccactgtgctcggcctagaactttcttacaacacaacatcaggacagctgaagaacaggagcctggaactgggctgtgaggagctactaaggggttgatattcttaggacaccccattgctatgattttcttctcaaccttgtaagggattggaacgatcttgcccaacagttgggtctgatatgtcagacgaaaatcccactgtggcaagagcctgactcccagggttcagtagagaaataatttgcactcgcccagtagttctttgcttttcaagtaatagtaagccctaaacaatatcaaacttggtaaaaacaaaatcttcctgtctagtccccacattgcccagtcagagtaacatccatcttcgtatcctctcggctagctgtatctgataccagtataggaatcccccttcttcacccagtggatgcctgaaaccagggatagtactgaaccctatgtatgctctctgttttcttctacacatacacaaacctatgataaagttgaatgtataaatcaggtacaggtacaggttaagagattaacaaccaagaataaaatagaacaattgtaacaatgcactgttcacaattgcacaaacagaagatccctgcttgcagaggatcttagcaatttattttattttttttttttcgagatggagtcttgctctgttgcccaggctggagtgcagtggcatgatctcggctcactgcaacctctgtctcctgggtacaagtgattctcctgcctcacccttctcagtagctgggactacgggagtgcaccaccacacctggctagtttttgtagagatggggtttcaccatgttggccaggctggtctcgaactcctgacctcatgacctgcccgcctcggcctcccaaagttctgggattgtaggtgtgagccaccgcgccctaccagcaatttcatcatataatttgttttatttccttattaagtcaggaactttcaccttttctcttaaataccttatgtcctctttttggcatatctgaattgccagcatcactactcttatgctttggggctgttattaaggaaaatgaagggttacttgggcataagcactgtgatttcatgacagtcaacctggtaacagagatggctactcagtgactaacaggcgggtagtgtagacaacatggctacactggacaaagggaggatccgcatcctggccaggacagagtgggacggcgtgcaattttgtcacactgctcagaacgttgtacaatgaaaacttatgaattgtttatttctagaatttttcatttagtagtttcagactatggtaaactgtgaaaagtgaaactggagataagaggggactactgtagtaggttttcaataagcattggtcaaatacgtcactaaattacacttttcctcccaatatactggctatgctagctcatcatccccattttccacataaaacaaggaacttaaatcactcaaccaatgtaacatggataactcagagtggtatttgtttggatgagacacacaaacactggatccactagtggatccagacatgcagcaaactgtatgtctcatccaaacaaatttgctgtatgtctagtgctcttctgatccactctataaattcctgggaacgttctttcagttaacatagttgaaaacatgggtggtaaaacagcatagaaagcaaaactaacactgcaaatagggatcaacctctaagcccggagggccctgctggaaaacctcttctgaggggaaaattgcatctcagggcagttttcaggaattaatcgctgatcaccaacacctcaccccaggcgccatcatatctgaacccttctggtttttcagtgggtagaaaactggtgaggcaaaagggactagagatctctgccagtttgatttcctcaggcctctgtttctaaaaacatgctcactgagaaatgaaatgaaactccttctgaaaaggaggtttgtgatgaagcagacttcggagaaggaagcatttattcaaaaagcaatttccttggccagtcatgttctgtaagcctttttcccccccgccggtgtttcagatattggtgtttaagcaagactgttctcctttaatcctagagtgatgtcaacccacagtactcagaacaaggaatgggaagaggcatagggccaatttctgcctttgttggaatctcctgaacatttcatttcctatttgcttctgctacatatggcttcttttttcaaaggtaccttgcagagtcttcggaagcacagtgtaggcaaggaaactctccaaggagaaagaaaaatctgcactacaagatgctacgcaaacacacaactaagagagggaggcaagcacacagcacgcaaccaataatgcacagccacagaatccttctcaacacaacattgcaggcagcagcaactgggttgtcaagataaaacctatttgaagaagctgatctagctgggacctttgaacaatccagatccccaagcatttaaagcttgtttctctgcagaattcattcaattattcaacaaatatgaacatgtattcagtgtattttatagtgtaatagtaatcaagctggacaaggtagtgcctttgggaggcttacattctaggagagaaggcaggcagttagcaagtaatcatctatcactgccttgggagggaataaaagagggagctacctgagacaatatggtcagaaaagactgctctgaggaaaggacagtcagctgaggagtggcaagtgcaaacaccccaagggaagaaggaggcatctgtatggtctgtgcactggctgaaggcaagtgtctgaaggcgagtgaggaagttctcagatagaaggtagaagatgaggtggagaagtgggaaaatctcccttccctttagcactggaggcgaaagggctagaagacgagagactgaatgattctttcagtcacatcactcttttcaagcacctactttgtgctaggcgcagaagactattaaacaggcaaagctgtaataaatccaaactcagtgagctgaaggtagaaaggccgtcccagaacagctggacccagcactgcctctgaacatgggcaatgacactttggggctcaatgtttgcttactgggtctctcacacaccctaacatcagccctgcctataatgaactttccccagaaaagcaggtgagcagcaagctatttgcacatgtggtgactaccatggagcagcaaggatgcaggctgacctcacagacttctttctgaatgcataccatatgtttggcagagctaaaagagctatcccagcaccatctagccaggtgcttggcactggatctcatatgctggcagatgaaaaatgactaatatgaaaatctatattccaacggtactcaccagtccactggattggtcacgattccttctttctacaataggatcattctgcttctgattacaaaactgcaccctctgaagctgctactcacccgttggaagttacatgccctgtgcagcctacaaatccattaagttctgatggagctattccaacgcccttcaaagaacctggcccatgtgagttgcacaaacaaattggagccaacctttcccaaatgcctctctctatttcatttaaaaaccctctttaatgaagacataaagccttgaatgcatctgaaacgctatgcttaccatgcatgacagcagatcgtcacagaggatttcaaatgcttttttttttctaaccagaatacttgaaagaaactgagatttccttgttatgagttcaactgttcattttatatgccctataattgaccattctccagaagtcagcataggcaacagagatgtaaggcaactgcaaacacacacacacacacacacacacacacacacacacacacacacacacacacacacagctttggcacagtgaaaaattaaaatgcaatgccaggcttgggactattttgaagcctcaggctaggaaagcaataccctcacctttctcagctgcctactatgtacctaaccttccaattatttatggctgagatgcttaagatgtactggagaaacagccatggctgagagatacacaaagctgaaatattatagagagttataacttcatgaatgaaaaacctataaaaatcacttaagggtcctaatctttcagttaatctcacctcagtgccactcaagggtttaaaggagtttcactgattggtttttaaaggacaacgataaaaatgctttgaaataactaattataatttcaggtatctatgtaaaggtccagacacaaatatttgaaaatggactgttcctagaatcagggattgacacagatctttaaaactttctagcccaaacatccatgtgacatttgtatccctttggccatattgctttcaaggcttcaatgctctaggaaagaggatcttactgcagtactgctagatttaggtggagatcaaaattaccaatgtttgaaagtgatatttttacattaacttgatcaagagttagaacttggacttattactcagacagtctgatccttcattgacaagctgtgctgagaaaccattctgtgggctaaagaggatatggactcccaggattgctctggcattgcggttgagaagatatactggaataacctcttttgaaaacagtttagcattacctcctaaagttgacatctacaacaatatgactgccaggtatattaccaagagaaattctcatatgtgtacaagaagacatgcatgagaatgttcaaagaaactctgattaaaatagatagaatctagtaatgaccaacatcccaccagggagtagatgaataaaccctgatatgttcacataattaaataccatggctcaagcaaaacaaatgtttgatagtgacacacagctcatagggagaaatcttaacaatatattagtttaaaaaaattccctaaagacaataaaaatatacacactttaggaatccatagagatgcctaaaactatatgaaaagtcacaaagcaatggtgagcatagattgaggatgctggactgactccatgtgaggagacaaggggatggttttttgtgtgggactatcatactgttagatgtgggatagtagcaaaatcataggttttgttctgggcaatgggtttgcagatactcattaacatcattaaacataactacttacacaactaaagaaaaggaggctatgatggaaaacaaagagaaatgatcatccttgagaggcatgtaagattacaacatcggatgaccgcagttttcctcaagataggaatccagctcccattccaaaatgtccaccaaagttgcaacatagtagcatttgccatataaaagtactggagttattaactggattccagatgtctgaaactgatgtatcccttcactgaatcccgactaggatctattttgggtatagcacttcacacaggttgctgttcttaattaaaacttctctgccttaagagctttatgtctgtgagatagtcatccaaatgttctcctctccataaatgtgctcttatgttttattttcacagcaaaatgcttgcccagattttaataaacatgtccgcagtagtaatatacatttcgcatgctttccacatttcataatctctttagtccttttgtttatgttgattcccacaccaagaaggctgtttggaaggctttgcagctctgtctccatttcttctgcctatcattggggaatgaaacagcacactgattgctatttgggtaggaaacacagacaagacgttgaaagaagtaaactaatttccaagcaattttgctcctttctctctttttgattgattttggcaataactcaccccagttcattgacattagagtaaagcctagtagccaatttattgcttcaaaatctgtgagagttcctaattggttatcagactgtgtctaccagatgccaaaattaaatttcttttaaatcaagaaaaaagtgattttctggcatcccagatgcaaaacaaccccgattaactgttctttcacattgcaaatggctatttgggccttgggtggagagaaaactcatctacttacaacaggagggggtcagattctggactcgatccttcagccaaaatgcagataaaccacaaggaacaaatactactctatgaaaaatggagagctgggccgggcgcggtggctcacgcctgtaatcccagcactttcggaggctgaggcaggtggatcacctgaggtcaggagttcgagaccagcctggccaacatggtgacaccctatctctactaaaaatgcaaaaattagccaggtggggtggtggacacctgtaatcccagttattcgggaggctgaggcaggagaattgcttgaacccgggaggtgaatgttgcagtgagccgagattgtatcattgcactctagcctgggcaacagagtgagacttggtctcaaaaagaaaaatggagtggtgttcctggctgaaggagagatgccctcggtccaatgttggggaaatttttgctcccggaaagtggaaacatcaaaggactggagcccaacattaaggatggaataattatgttgttgttattgttatttttaatggagctctattgagtgcttgctgtctgcctggcaatgtgctcagtgccaagtacaaacatgatctcatttactcttcataagagtacctaccccatccatggtgctgtcatttccatttttagatgaagaagttaaggcttagagatgtgatctcatagctagtaggcagttgggactccagggtcccactccctttctgtctattccccctcctcatataacaatacatagcatttgctaagcaatacagactaaattgaggctctaacttaacttaaagctcttttgcatacagaatgttatttgatgaactctagggtaggtagaggcacaatattattatccccattttatagagaagggaacaaaggcccagggagattcagtgaattgcttgagtcttctgccatgttggactaaaagcctcagtgttgctctactaaaaaggtccctcaactaaatataacaggggtggcctgcatctagtctctgaattggaacatcacaactgacagagcttatatcgtgggttctcttatttaaaaagcagaaattctaggtaatggtccagtgcaatttcgactccatctcctaatcctttgacatcaaatgctctggtcctgacttactggtcctggacatggttttcttggcacagtagcaggcctttaccattttacctgcatctctcaaccctttgtcctgtttccatctcatgtgagtaggagttattctttaaacaactgccttgtatctcactaccagccctttgcacatactgttctccctgcatggatggcatttcttcccctgatccaccagcactggacttaggtggccctccaagatggttccatttcaggacacttattgtacatgccttctaatttatcttccactctataggtttcctgggggcaaaatcatgtcttttcacaatagccaatcttttctttgacttcccagacatcaatgtcatatggttcaatctaataccttaaccatgaccttataaaaccaaagctaggcacataggagaggctcactaaatacttcttgcccagataaacttatcacagtagatattcagaaggatgacatagttgtacccatcctcagtcctcaaataagagtttaattatgttatgtaaaccatatgatatactagtgaggcaggaacagatacacattgtaaaagagatccagaacaaaataagatttctctgtggccttcgccaatcttaaaatgtaactatatttactgaatcaaactcttacagcataataaacttacttacaaagaatcagggtagacagcctaaccttgagtacctcaagtctttgcccctggatcccacataacaatatccttccctcttttaaggaaagctggaaagaaaaccactctgccagcagaagggcaaataaaaggtatgtctgtgcctgcacacagaggttggcatcctaccctgatttgtgacccataattaatgtcaatttcataatttcggaggatagaagatcaacaaggaagctgacctctggctgtctcacagctaatcatcttttgaggcggaaacttgagaggaaacagaaacgacaggctggagcaccaggctgtggctcggagtgtgttttgggtgatctgccaagcagtgagaacccatggtcacgtgccctctctgtgctggccccacagtgacacctgctcaccctccattgggtaaggtgggaacctgcatcccaccctgtagaaggcttggctggacgcctgctagtctctacaaagttccttctcattgtgtgcactcttctacatggcttcttaattatgtatgtgcacaggctgtgtcgaatggagttgcctttgcctctgctcaccacgtattacatttttaatcagtatatataattacttaccgcaagctgccaggccagattttctgagcattagtctaattaacttaaacttgataattatgtttcggataccatagcagtacacacggaacggcagactttgctgccagcttatttgattccaataacgtgttttctcaatactggactagttttgattttttttttttttttgaaaaaaatggccatctgataattactttggtttcaaaatttcccctcagataaacccattctgctatttaggacagcttctcaaatgatttacacggattgaactgttatagtatgtttctgtgtatttttacacacacaaatctgtttttactaatataaattcaaactgaggagaaatgacagtagaaggaattctgatggtcaaatgacagaattgtccatgtttcaactgctctatgcattgccttttccatttcaatttgggttgatgaaaaatgagagacaaggaaaagcaaaacaaaactaaacaaaacacagaaaaatgcccagacttgtaagggagaaaggtcagcttctggttgaacgagggcatgataagttcccacactaataaggctcaattcacctagggcttaccatgtgccaggcactgcaaaaagctcttttttgtggactatctcatcgaatcgtcctaacaaccctatgtggtaattagttattactataggttgaattgcatcctcctgaaatatatgttgaagccctaatccacaatgtctcagaatgtaacttggtttggaaatagggtctttgtagaggtaatcaggttaaaagaagggcattagggtcagccttaatctaatatgactggtgtccttatacaaagggaaaatttggacccagcagctgccatgcacgcaaagagattaagtgaagatgaaggcaaagattggggtgacggatctctaagccatggaatgccaaagatcatcagcaaactcccagcagtgaagtggacacactgaacagattctcccttagagccctcaggaggaacagctctgctgacaccttcacctcgggcttgtagttgccagaactgtaaaacgacaaatttccattgtttaagccacccacccaggttgtggtacttgattacggcagccctagccctctaatacatatactctggttaccactactccccgtttcacagatgccaaggctcagaaaagctatgtgatgtgtccaggtctgcacagctgtcaagtggcagggaaggagtccacaacaggcctttcggactcccatgctcaacccttgacctcacccatgcctgtgccactctgcttctgcccaggaggctgaaagaatcaatacaacaaatcccagaagtggatgaagcactatgaacactgtaatgcttctaaggtaaaagtcaagcttagatggtgcctgttttcacatttgcacatcgcctcttttatttaacacgtaaaatgactgcttgaaatacctgcactctagttttggagggcaacaacatggaatttaaattttcttagggtgagggtagcgggattattttgttctcttctcacataagacaataatggaccaaaaataccacttaccaattacaaaagacaacaaataacagagcacaactcaatgaatcgaattgcagaaggaagaacaggtgggctttcccaagatgtcataatagatggaaggagaacaagagagaatgaacctgctctataaaggccaaagacaggaaatgagaatcattctggggaaaagatacaacctttatccaggaggaaaagcatgggaatatgataataatttttaaaaaagacaattctccaagaatatctcctggaatagatccaacggaaagcttgacaccagataaagaagggaggtcaggttcattgagggcctattacatttggggtatgtttgagggtgaaaccccccatagagtgttgtgaagtagaagctatcgcctcccactttgcagatggggaaataaagttctaagcaattaaataattactaaagggcagctactccttggcccagcaaatcactggaaatgctgacatggaagaacagcaggaagggttgtcctaagaagaattactttccttcttcagactagtagtgtctctatgtctgtggggaacgtgcacaagctcacactcaagacacagacttctcgtcataaaaaaatttcacaaattacctctaagttgctctaaaacgggagtgcttatcatttttaggcatgtcagcactttttagaatctgatcaaagctatgtatgactcctttccctagaaaaatgtgtgcacacacataaatgcatacactttacttgaaatttctagaaggtttgtacaccctcagggatccatgagtcacagctttaaagcccacaaaggatacatctgcctccaaggagcccagcaactttatgacacactaaaacaaacacataacatgcactcgcacaaccttgaccaggacagtccccctccacagtcactggcttgtatctccatgttagcacacccacctccaccactgagggggagctctgctgtgcttcgttgatctgcattcactaatctacattccaggccccacataaagcaagtataaagtgaatgttaagtgaatttgaagttagaagacctggacttgagctctatcactccctctgggtcatgttgtttcatctccttgaatctcacttttatcacccacgctattaggcagaaatcaccccggtttgcctcaccttttctgaaggattgctgggaggaacatatgcagcaatgcaggtggaagccatttagaacagtaacagtgaacactgactgtgtgcaaacactgttttaaacactttacatttattcattaatcttcatgaccatcttatcagggtggcagtgttactatccccatttcagacatgaggaagctgagcacagagaggtcggggaactggcccaggtaggcacagggctgggatgcaaatgcaggcaggctggtgccaaggccagctctcgtaaccactgtgcatagtgcctcttcaggagaggcaatgccacaaaaaatgtctaaaattatcctaacgagaaggcaaaagaaccctgtgagccttctatgaacattagtggagtttggaggtgtggggtttgcagggctttagatttagaccacccagaagagctcgatgttacatataactgcaactagcttgtgcatccacaactccaaattcagccctgtggtggtcagcgaatatcgagggagaaaagcagcagcctcatgtaggaagtgtagggccagggccccctctcaaagctcattcacatgtacttactttgactgccacaacgaacacatttgtaggctttccggcttgtggcttacctgcctgtgaccacaaagctcatatgtaccacaagtcctctttttcctacttcaaacaaacaatgctcatctccctcctctgaatttttttgtttgagagtttccaccttaaggttttcaaggggtccacaattcagttgtatcttgagtggaaatcttattctgtaaggcccctgtcttcattctcacacagtcaaagcacactagctgacaagcaggcttcgagcagagccatgataaagcttcaagccctgcctgcccagagctcacagccccggtgggtgacccggaaaataagcaggcacctgcaaaaggcctgtaaagtgctgtgatgaggaaaatatgggcaactgtgggagtcacagaaagggggtacctaatccagcatggggagagggagacactagagggtccaaaaagctgcgtatcttctctgcctttgtattgtcacaaaaatctaggagtcctcatgagctcaatgttaagtggttgcatgctttgactcacttaatcgaaaatgtttttaaaatcctgcttagacctttttcctcccactgttccctgagttagctccttctcaccctctgggtctcaatttccaatgtaattaattccctcttttcacgaagccttcctggagcaccctacactgcctggcatctcctgtgccatcttcctgcactttcttcctttcttcccagggaggcaggcttcatcttgatgtcccgggtgtggactgcagaccaacatcacctggcggcttgttagaaaagcagaacataaggccccatcccaaatgattcctcaatactttaaagctgcctcgcccaggaccttagccatcagccccatgtgactaccaggcccctgtaaaacggcttgtctgaactgagaggtattgcaggtgtaaagtacataccagatttaggagacactgtgaaaaagactgtaaaatatctcattaataattatttcatgttaattacctactgaaataatatttatgatattttggattaaataaaatattacaattaattttatctgtttttttaatatggctactataaaactgatagtcacatgtgtggttcccattatgtttattttggacagggctgccctacagcgtgagatgcgctggtttggataatgatcaagaacaggcattggcagacgacagccactgggtcaaatctggccaggtgcctgatttggtaaaggggcttttattggaacacagtcacactcactcatttactgtctttggctgcttttgggctacagcagcagagctaaggatttgcgacagaaactgaatagcctgaagagcttaaaatatttaccatctggccctttttagagaaagtatgcagaccccagtcaagaacgttcattccagaactggaccgattgacttaaaatcacgtctctaccactttttggtgtgtgaggttcggcaagttacctcacctgcctgtgcctcagtgtttgtatctgaaaacagaagatgagcatacatacctaacagagttgttatgaagattaaatgagttgatatatgtgaacttccttaaatagtgcctcatccatagtaggttctcaataaatgttagccaccattaatattactgctagcagttatcacaaattgtaatgacacatttttgctttaactttttttcctgtctgtctccccatcaaattaaagacctaggagagtggcatcattttctgtcttgttccagctgtttaagcacagttaaacagcccacacgtgagattcaatacatatttgttgcatgaatcaagtgcagaggagggaagtaattttcctaaggctccacggccagaaagtggccaggacttgaatgtggttctatctgcttgccaaactcaaattcttaacttctcttgatacaccaagtgtagtctatagaccagcgacatcagcatcacttgggagcttgttaaaaatgccggagcttaggcttcatctcagaccgactgaactaaaaactctattttaacaagatcgccaagaaattcataggcacattaaggtttgagaagcactgctctgggctataattcccagtttcgactcatgtgcttatttgttcaacaagcaattaatttagcatcaatcattccacagagccttgtgtttggaccccctaattccagagctgatgatttctattcatcccgatcaggtcctgggggtgtttagggtttgcaatgaacggcaatgtgctgtgtcagaagtgccctttctcctaccaggttcaaaccactgcaatgctggagtgacctctctgcacagaaatctgcttaacattccttacccgcctgtagtgaccaggccacaggctccggcagatgcagaaggtctgaaaatctagttgtaagtaattttcctctaggtgcctacctcagtgaattggttctcctgtgcattttatacatcagtggtcgcaccactcaaacacacaatccattcccgagtttaacagctcaggcaccttcctttttgattttataaatgaatgcaaatcatctcccactcatattataaaccaattaaaattctcctcacacttttaaaaaaacttgttacctggctcaaagatccttagctcttttcttagaaactggcccttatgtggcctgtatgtgaggatgagggtgtttgaaattagcaggaaatcttagaatggtttcccctttgtcacagccagaagtttcagattgtggtcatcagatgaacgctttaaatgagaaaaagactgattagcataattcttaaaggtctgaactctacactcacagatggcctctgagaggatggatggtacagaaaggagattaggataaatctaattagtttgggggtgttctcatttctcaagtggtgagcgatggagaagaagtgatggatggacagatggagataatgaagccccattaaagccttttttgattctcattctccatgatggagcacattatcccattaatgtttctgtgagctaacacagccaaagtttggcgctgtcacctcgaaaatgaattcgaattgcctgcccagctccttacatgtgtccacaggagttaaatgagcctgaaaactgtattcctgctgagaagcccatcctggcagcatgggctggaagccctcccctttgggaatgggccttcctcctggctggtttctaacagcactcaggccagagtcccatagcttttctgctccggggttctacaactagaatttcctctgaaatgggctgtggcttgcacgtatttccagggtactgagacagaccgctgctgttctcttcagtggaggtgacagctacaagtgctcaccatcacactctgattagggacctgagggcagggtccaaaaacaaaaagtggcaagacaggcccatgactcagtcacagagatgtgacataaataataatacaggacattgcacaggctatgtgcaaagtaagggcctgactggctccactagctcagagaacagtgagacagtgatgggccatccaggaaacagcagggaaaggggagagactcctcggggtttgaaaaaagaaccatgtgccccctgatgacagcagcctcctaaatggaccccttgcttctactcttgactccctacagtccagcatcatttaagaacataaaccagatcaaatgattctccccttcaataataatcagagctgacatttattgagcacttacttatgtgtgctcagcgctgatccaagcacattgcatatattatttcatttcacaacagccctttgtggtattaatatcatccttttattacagatgaggaaattaaggcacaaacaggtgacctggcccagtaagtagcagaatttattgacaagctcaggtttcttgacttcagaactccgattcttaacctataactcctgttccatgttcattccatgccctcccaccacacatggaataaaatctaaactcctctctgacctcattttgttccagtgtctcccatgctcactgtgctctcgtcacattcttcaagaactccaagcacggtccatgtctaggccctgtgcacttgtagttgcctttgtctgcttagaaaggatttcccttctcccatatccaccttcgaaatgtcagggtggcccacgcttgattctcagctctcttactttattctactgctcttcccaaccaggtggtctcattcaaggccatggctttaaatactatctcctatgactcccacatttatgtttctagcctggaacgtttaatgagttccaaccatgcgtgtttaatggctcatctaatctttcctctcgcatgtgtagtgggcacctatatttatcacccaaagataaaaaaaaaacccctgacttgtaactctcctaccctacttcagtctgtaaagtaaatagcactatcatccagctggttactcgagccaaaaaccagcaattcttcttagcttctgagcctttgcacccaatccatgaacaaattctacctgcttccaaggcacatcccaaagggcctatttctctccacctccactatatcatctctgatataaaccactgtgataattttgcttgcacttttacctctctttaatccagccagggagtgacccttttaaaagttaaatcagatcatgtcattcccttgcctaataccttctaactctaatgtcatgctaggccctgaagacctctaggccaccgtctgcctctttaaccacaactcctctgcctgctcaccaatgctccgggcacactggcctcccttctgtttcctgaacatgccatgctcatcctggatgtatggcttttgcaatcactattcactctgcttagaaaactctctaccccaggtttccccgggcttacagcttctcatttagttatcagttgaaatgttacctccttggtgaggccttttctaacccctctaaccaaattcatatgcataaatactttctttatcataccaagtttcatttccttctcactctctgagatgtctgtgtgtttaattggttttttctgtctctcctactagagtaatctctttggcggtctgggtctgatctggtttgttcacccctctatcccccagtgcctggaactttatcagggatcaataagtatctactgaatgaagagcaccatttatttagaagctcacaaaatgctaatggaggaggtaagattgaagacagatgataaagctgggacttcaatcctatagtcagtgggaggggaatggataaagagtaaaagtgacgcaaacttgtagggagtgggaggaagtctaaaatcttccatttgttgaatgaccataacccaggaggccctggtaatacacaggtgaacaaaaccaaaatggcccctggcctcatagagcttgtattgtagcatgtagtttaaacttttttccccattttaggatggagcaggggtaagcaaatgttttactgtaaagggccagagagtaactatttctggctcttcaggccatatggtctctgccacaaatactctgccactgtagtgaaaaaggagccacagatcatacacagacttggctgtgttccgataaaactttatttacaaagacaagcagcaggtccaacttggcatgtgggccacaactggacaacccctgggacagagacttctgtcccttctaaagaactggggagtactttaggcttgtcatgtagagaaacaggctttgaatcataagaaccttaagggtcttgtggagaaaaacatagatttattatttaccttaagttttctaaagcgcttagaaaacagtgagtggacctggagctgctgacctggggttcctgctagtcttttgttttactccttcccatgaatcaactagcttttgtaagaaacctcacagttacatggatttgaatatacttaacctgacaaagactaactcaaagtggctaatgcctataccagatggtggacctgcccttattccactgttagaaaggaagagaatgggcactactgattacttgtactgatttaagtttaagctaatagcttggcattaccctgacttcagccagggaagaaaatcacatccaagtttgcagactccatgaaacattggccatatatttgttggctcattagcttggacataaagactttctagaaagagatgccatcattaggtgccactcagactctaggggtgcttttggaaaccactgtgatcagaaacgtatatattgttaagggaagagagagagttgttctggacaggtaccgagaggcaggttccaggaagctgaagccaacagaatcaaaccttaacgtacataagccattcctgggctttgtccatgggttgcctttgtggtggttgtctgcctggtttccagggagccttcaattagaattctgagctgagatgatttatcctgtgtgctacattagctccatttgccattaacataaataaggctttagttacatgaggcaggcataaagggtatgtatgccttccattcatgaaaacatcattttttcaaaacaccagtttcttcttataagctaagttacactacccaaatatgtagtaatcagtaatacagaacaataaaaggccttgatacactgatccgggcatacgaggttatcaggaaatcctcaagtcagtgtctctccccatgggaccaatcctgtacctctttttccttcacctccattttgacttgaaatgcagtagacaacagagccagttcagtgccttgccatgctcccagcacttagcactgttcgataaatacatgagggataaacaaattgtaaggaaactcccatcccatgagaggagaaggattctaaagtgcatgaccacacggacacacaggtaacatccatctctttgggaaaaggagtaaaatggactttcctgaaacaactgctaggcagaaggtgggtgaaagccacaagcatagcctgcctcatagtagttccacgaaagtccattttacccctcttcccatagaaatggacactatctatgggtccctgtgtgtggctgtctcctgccatgtcgctggattttctcaggatccctgacaagtagggatttttggtcaatctttcatagacactcttatctcctcaaatggagacaccatcactggcattgaaatgctaaggtgagaactcaccaagacacactgtaggtaaagttccagctcagcttagggtttgatatgtaacgggcccaataaatgatagtgattggtattaggattgctttgttcttgttacagatgaagaagtagaatgtcagtggattacagtgaacagtccaagctacaaaatgtgttgcaactggaatttgcattccatgtgtctggttccttctctatgtacaggaatgaatcaggagagcacactggctctaccttcttccactctgacttctcagctttaatccctggagttccagggtggtatggactgaatgtgtgtgcccccaccacttccccaaaattcattaacaccacaatccagttaagatatttgttagtagggccttcgcagaggtgattagggttagatgaggtcatgaaggtggagccccaggatggatttgtgcccttataaggacatgaaggaccagagctctttctctccaccatgtgaggatacctcaagaaggtgaaccagaagcagggtcctaaccaacaccccgaccatgttagcgccctgatattggacttccagcctccagagccatgagaaataaatgtttctgtttaacccgtttagtttatattctcttatagcagcttgatctaaaacacagatacctcaagatggctacaaattctcctctaagtgcttcagagaggattagaagataaattatatatctattttgttttctatgctaggcctctatgatataatataaatataatcatttgtattataaactagaatataatacaaataaaattgtattataaactaccttaaagaaagtcctccttacactgaaccaatgctaatgttggttaagccaatttcccttagaaaaaggcatgtaggatcttgaaggcattggtgggctgcattccctgcactgtgagcaaggcctgacctagaatgacctgtaacatcacccctgtcatgggtcccaagcgcacagccaaaggtcttcaaaacatatgggtatccttagcaaataagagcattgctaagtgcatgattaataagccagaaaggctatggcacttgacagacggatgaggcatttcagaaagataagtcaaagtgcactgtgaggtgagtgcctcccttaactttcttagctgtgctactcggttcataaaccagggattaagtccattttcatttcaattttttatttcacctttaagcaactcctaaggcttccaggagaattttgtttgacctttagctaaagttcaacttctaccaagttacgaattttggatggtccctaaatgatcacttaagacagatttcactataattcaaagaaaggataatccctggcccaagagttcacaaaggaaggattcccagtggtcccagagatggcaaaagttatggatttcatcctgctaatgcattttagtgatattttcattgtgcaacattaattaccaatgtcagcctggatgcatttgctgggtattgaaaccacgacatttttttatctctacctggtcccagatgaagattagcttagtgcttccttgtgtcctaggccctagagaaaagatgcagcctacgggatggggtaaccttggcaagttgccatttgcttctaaagttatgatagcagtgttgaagccgtcactgagactctggtgctcaagccaagtaggagccctttgctatcatgacatatgctctagatttgcatttgtctaaaatctagcttttaggagacctctcagagatgtctcagggaggaacactcagaaaatgtgaagaggagcaatggacagagacagagacttccaatttatagtgaagaacagacctttgaagttgacttgttacataacctgacttatctaccagatctgtctgattcctaaagaagtatatgaaaatctctcaatttatatttcaaactcctgaccttcaggtgatccacccgcctcggcctcccaaagtgctaggattacagtcatgagctactgcgcctggccatcaattttgtctaatcagagttttttttcccttgaattttggattttgtagttaactactgggttgttgtgtgcctgtaataaagatagagttatttttgtccacaaaagttgaaaacagagctgccagttgacatgaaagtacaactcatttccatccacagcctctacatccattaaataaagagaaactcagtgctcatctcactcatgaatcagaacaggatatctgcacatgccatttctctaacttcccaaatgcagcaggaacacctcagccccgctctctcagtatctcagtggactggaagcacgttcatttaagaggaagggctcatagctttctgcagacagttcaataccatgatgcatccgattcagtttcgtccattctatttcttattgatcagcatacctcaggctattagttttattaattaaatgataattttggggggtgagtacacaaggagataaatgtctcacaaacagactccaagcttgcaggcaggaggcatgcagtgatttacaaagtatttatctttctggcatttttttttcccccaggaaaaagtaatcatcactaccatcttctaaaaacagagatgcttgttttctgggcaggcttggaaactagccaagacagcaggaagattgctggaatttcaacacacttgctgtggtaccatggtgctagtgacctgcccttgcagatataccttgactccccacagaagtcacctcaaagtctctgctatttagcaaatccctaggtgtctggggagtaggggtccagtctggggctgctgcctcttctgattggctgcctggctctgactctgatcccagaatacccagaggaatttgtttccatcctcctggcccacaactcacacaaacctctaatagtacacaggttattaaaagcaaataatagctgggcacagtggctcatgcctgtaatcccagcactttgggaggccaaggcgggaagatcacgaggtcaagagatcgagaccatcctggccaacatggtgaagccccttctctgctaaaaatacaaaaattagctgggggtggtggcgcatgcctgtagtctcagctactcgggaggctgaggcaggagaatcgcttgaactccggaggtgtaggttgcagtgagaccaaatcatgccactgcactccagcctggtgacagagcgagacttgatctcacaaaaaacaaaacgaaacaaaacaagcaaataatagtgtcccaatagaagcacttgccctaccacagccctctctctctgccatcaccaggcactttctgacatttccatctttctgacagggtttctcaacctcagtctctattgaggttttgggtcagataattcttagttgagagaggtggtcctgtgcattgtagggtgtttggcagcatccttggtctccacccacttgatgtggtgagcacacacctccccatccacaaacatctccacacgttgccaaatatcctctgggggagctgatttgccacaacccccacaccccaccagtgaaaaaccaatgtcttgggacaagtggaaagtgatgggggaaactgaaacctccctgacgctttggttcctgtaaggaaccacaggagactacatcattgtcacctctccctggtttgcagacattatttctgagtcatgtgaatgaactagaaaccttaaataggaagtcagaagggaagctggggaggagagtggggaccgagttgaaagatgatattgactatttgtacttttcaattagcacaggtgcaacgcttcaggattcttggccaaaaaatgatataaaaatgattggaccgacctgctctttctagggtaaaggtctgtgagtcatatcactcagaaaacatttttgagcacctatgatatccctcatccagtcaatcaagagatttaacagattcttcttctctccctccctgcagccattcttctaggtcttgccactattttcttcctcctggattctcccaagagcctattctctaccttctaccagccttgtttctcagtatccattctctcactgaaggtgagtggtctttttgaaatgcaaatcagatggtgctagtcagagggtgctagtcagccatctgctagcttccctggctttccattcttttcggataaaatcccaactccttaacaaggcctagaaagccatacattgcctttgttatttcattacttacaactgtgtggtccaactccactggaccagtcttgcctggttcctcccagagtgtgggacactaaccaccactgtgtaggtaggcacagaaggtggctttacgtagaacgcagtcacgaccttaaaaaatgttgaatcacatagtgattctttaggttcaacatcctttttcttccttgtgctctctcctagagaaagtcagttcggtgctcctttgtccttcctgcaccaaggcttattgatcaaccttcttgtgttagaaaagaacaagcctcaggctccaacatagaatctagttggcatttaataatactattttatttttgattgtacttacttttacagttaccttttgtattagtctgttctggcactactataaagaaatacctgagacagggtagtttataaagaaaagaggtttagttggcccatagttctgcaggctgtacaggaagcatgatgctggcatcatggggaggcctcaggaagcttccaatcatggtggaaggcaaagtggaagcagacaggtcacatggcccgagcaacaagagagagagaggggagttgccgcacacttttaaacaaccagatctcatgagaactcactatcacgaggatggcatcaaggggattcatgagaaatctgcccccatgacccaatcacctcccaccaggccctacccttcaacactaggtattacaattcgacatgagatttggtggggacacatatccgaaccatatcacctatttatggcatattataaatgtttccagtataacattccagaagtgattagtgatgcaatcttgcctttttttttttttttgagatagtatctcactctgtctcccaggctggagtgcagtggcacgatcttggctcactgcaacctctgcctccagggtttaagcaattctcctgcctcaacctcccgagtagctgggtttacaggcgtgcatcatcatacccagctaatttttgtattttttggtagacgtggggttttaccatgtcggccaagctggtaattccaagctgaactcctgacctcaagtgatccgcccaccttggcctcccaaagtgctgggattacaggcgtgagccactacacctggcagcatctttcctttttcagtgcatgtattcaggtagaaaaagaaagtttacttgaagaaacataaatagtagtagcagtagtttctagacatggcaaataccaggattaatgcttggtatttgggaaacaaggagttacttaaatttgcagcatgctctcatatgccagacgtccttcagccaggctaagaaggtggagtgggcaggagtaggagacattggattgttccttgtaatctctcatgcaatctttggagtttgatgcagatgtcaccccgccaaaatttgagtcagtgccccacctatgcgctccgctaataccttcaacaccccgcttagaggatctgtcatggcgcctgtgagctctgagatcatgtctgttgtgttcactgttgtttctgcagtgtctgacatgcagcatggcagaataaacaagacaccaggtaaatatatcttggcttgatgggtgaaatgggggtaaggagggaaacttatcatccttttcagccaggtctgggccacaccaaaagtgaaaggcagaatgagatgcctagataatccgtgccaataaagatgctgacccacctcctcctggacaacagagacaaaagagttaataatgtgaattacttggggtgcagcttccatctccctcaccacttaaagtgtcagaatttgacccccactggctaatgcaaaaaacacacagaagctggcaagacatgggcttgcttgtccctcctctttctttctacctggagctttacctttacaaatttgtagcacttgaaggtatgtttccctagccatttctggatcataacaattcctttttcctactgacaaaatctgaaacttagccggaagcactctcttgccagggaaagaactgtgtcagacgtgcgatgcgtgataaaatactacggtaatgtggaataatgctttcaactgttgccagggtgagcatgcatgcagaatgatggaaattgcctgcaaatacaaatggttgctctgtggctcatctgtaacctcaatgtaggaaagcggagatattcttttccctcctttgcaatttgcacagcctcttgttggaaactatggagattatgccattgaaagtaactgccatgtttactcaacacacaatttttactaatacagtctccccatgtagtcatctgtcttgtgaggttccctcaatactccagctgttcctgtggctgctgctgcgaacacctcattgaagaaatcaaggtgccaaacccaaatgctttatgtgagggtgtggaggtcatttttgcattgctgaaaatgacatccactttctaccttagaaacaaaggctgcataactgaatgggattcagtgcacccctacccccttctcagtggtgaattcaatgggaattatcagagggctggtctgtataactagaaaagccaaaattgttgggtgtttactatgtgttaggtattttgccttcttttaggtgaacctcataacatgctatatcataaatattatcctcctcattttggtgttgaaaaactgagagtcagaaaggttaactaacatgctcaatatctcccagataataagtgaccaagccaggatttagtcccaggtctgtatgactctaaatcttgaattatttccatgacaaataatgttaaactaaagccagcatttttctctttgagttgtggttaaactttcattatctgtggcctttaagcattatttgttggttttcacgtacccataactatcaggatacatgaaccaatgggaagtcacgtcctcatgaagagccagtagcctaaatgtgaaatttctcatgcataccagaagcacaaggggcaaaacacacacacacacacacacacacacacacacacacacacacacacacgtcaaaggcttctccctctttatgaaaagtaaaatgccattttctttttctacaaagggaacaagataattcattcacggatctcttgattagctcaattgttctgagatgataatagttaccatggattaggtacttactacatgccaggaatcaagggaagcactttgcaagaaggataacataatatttataacccaatgatgtaggcactactattagtcccattggacaaatgtgaaaactgaggtttagagattatgtatcctgccaaggtcactcggttcagttgggattcaaacctaggcctctctggctctgcctccatgttcttacctgctatgttatcttgttttctacaaacccttcctagctaccatctatgtgctggataaataagggaatctttttaccgtagagtgaaaatgagaagttctgaggaagtgacatagtgttctaggaagtgccctcctttaagaacaaagtaggctggtttctcactgccaatcaaagtgtgacattggcccttctggggctcacctttctagtctgcaaattgatggtagcaaaggacacaatgtgtaaggacccttcctgccctaacgttctgtcattctattaaccacattttcccctctcccatcatttctcctgggctttgattttcactttttcatggccagtagaagtcacacatacccaaggcgaggctgccctcctctagtgaactgcaatcatttgaacatcctgcctcaattgaatcatcctgacagctatccctatggctggccagtcaactcccaagcacttcctggaaatgcagatgctgtatccagggcagaaagtacttcccctgtcatctcactccctctctgggctccagccccaaggccttttaggtcttcagactggctccgtgccacccttgcaccagtgcacatgctgttcctctgcctggaacacattttcttccctgcctcctgtggttaggggccaggcaggtttccctaaacagggctaaaggcaggctacgatcctcattctagattggccctctcctatacagtacttctctgaattggtccctatttattcagttggatcagtgtcttagtcttccactatactcacccttgtgtccctgcacccagcccagggcctggctcacaggaacctctcaaaacctgttggtagaagaatttgcacattaacctgccacccacatctgtgttctcttattgatgaggtacaagaaaggaagatggtaggccaatttacagtggggttatgaggctaggtctcctctcagcccactaatgtctcagaaccacgttctttgctgagttcatatgttttttttttttaccccatctccaaacagcaagtaatcttgcagatcaatgcctgagaccaaagagacttatgaatgttaagaagattatgcacataaatgtaccactatgacagccccgctaagaagaatagtgatatcgcactgcgtgctagtttatcaacctttgctacttaaaaaattcacagccaatttaattaaaaatataacagctctgaaagctgctaaaatgactatgacaacaatctatcattttgtaatagtgctgaagatccattagggactttgcactggatgccaactttttaaagcccagatagtaggggcatttcattctgcacaattaatgtcactgcatttaaaatattgactatctatgaagaagaaaataccaaacatctttataacccacattttttatggtcaaaacttgcttagaaaggtgctttgaatttatttgttataagctgcacatttcacgttcagaaaattaaaatggtttctactgactaactcatttaatcatttagttgatttaatgaaaaacactatgcatttttctcttctccgttgctaagattaatactttctgttcattagcaatcaaatattgcaggaaggtttacatcttattctcacttaactcattgccttttatttttaaaaaattctaatagaattgaaatggtatcttttaaatcaggaattttcctcttggtaactcgttttgtcttgtggaaaacacatggctagcctgtgacattgaggcatttatgtctgaattgtttttctagtctttttaggggatgcattatagggaggaaagggagtggacactttagaaaaattatgaatctagttttcagggcccctaactcattaatacatcagtgacattctagcatcctttgaaattctgttaagaagggccctttgatttattagtgggattttatgagctacctgggaaagtgaacccattaaaaatgttaactgtaagcatctggcttccattgaataaagaatcgaagccaccacataaaagtgactctgcacaaacatggcactcctctcccatcactcccaaagcttcccattgtaaatgccacttcatcacagcagtgccatttgcagttgtagtctcatctctgttatccactgctattttcaggagtgtataaatgagcagcgaaattcctctcccctggaaatgcctgtaagagcagattctaaaatgggaactttttgtgacaagattgggtacaaaatagtataattactgtaaattgttcaataatagggccagtagtttaaaagcagcatttccagatttcctttgcttccataccaaaaagcattttcttgaaccccaattgcttcataggaggaaataataaaaggcaggtgatagcattttgtacttagcatagatacaatggtttaaggacacggtgcactgagtcaagaccactaagaggtagagggcaaattaaccatttggacagtaggaaaaggaggcattttaaggtggcatgcaatgagccagccagctaattatagtaagagcagcttccctaacttttactttctatttcaaggtgttcattgcttctctctctctctctttctctctctctctctctctctctgtgtgtgtgtgtgtataaatcatctgtcttcatcattgcattattgatattgattgattgtaggaggagaaaacaagaatttttccattttatagttaggaaaactgaaacacaggcatcagtgtgctgtaaccctactataatgctcttctctttttacgcacttaggaaaaggataatttttttttaacatttgtgcaattatttaatatgtgtctccccaacactgtaatatctatgagagccaaatcactacctgtcttgttcatcatcacagtcccagcactaacatagtccctgctatatggttggtaggtgctaagtaaacttttttttaatgaatgaatgaatattattttctgaggtcattcctattggagcattagtaaagcaggacaaaactccaggtcacattcctgtactattgttgaacttctattcacccttcaggactctggtgaaatgtcagcatctttgggaagcctttctgagttctccctgactttgcctgggctccattaatgcttcgtacttaggcctgttgtgtgttgtttcttttgcttccttctcttcacggaactactctttcatgtgggtaattatcctgttcctcaggctttggatggggttgactccatttctaactggccttgggatgggttcataatccagatctggcctctcagggaaccctatccttctggccatggttattggctcagcaatgatcctgtagcttaacttgggccagcatggtctgtgcaaagtttttataggcattactgaagcagcgggggtggggtgggggaaacccacaatctttctaccataagctagtaggatgtgagcctccggctgctggtgttcgcattaccttccctgaggagaggttgcctgagagaagcagagagacacaaagcccctaatgacattgcttgtgcccctggatccagccgcgcctgaatcaacaatactattagacttttcagttacatgagctaataaactcgttctcattctcttaaggctcttaaggcaggttgagttgggtttctataacttgcaaagggtctctaatttctctatgttgcagtctattgagcatgtactccatgaaatgtgggtgattcatttctgtattcccaatgctgagtataggccttgtccttagtaaaggcttgttgaattaaaaaaacggtgcaattctagggcaaggacatttccacaaggccaggtattttggggatgaccctgtcaataagggctatgtatcttttggatcaaactctcatagaagaaggaagacctcataaagacacccagaaagtaggggcgccaaggtcaaccagaagagagaaaatggccttcagccagtcaaggagtagcttacggcagctaagaataagacagtgggagctgtgcagccccagaatggatttcccatgcctggttttaatcatggctatggtagtctatgtcttggttttaatcatggctatggtagtctatgtcttggttttaatcatggctatggtagtctatgtcttggttttaatcatggctatggtattctgtgtcaaatggaatgactaatcctaggtgctttggaaatgttaaattgttcataagtcccttagagctttgtttctcctttgaaccccatggagggttttgggcctcagaacaggtatattaaaccgtctccatttcaactggtaattgagggcctctcaaagtctacctagaagagaatgtcttctactatagaaagaaacagatgatgcaaaattttgattttttaacctaaagtttggtcctgtctggcaaaacaattgaagaaacatgactttccaatctatttggaaggtgagggttccaagtacaccctcactgtgatctgaaaattgtgaaaatctgtactaatgagaagcttaggaatcacctagacctgggtttaaatcctagatttgccacatttctggggtggtggggtggactgacaggccctgaacagacaacgtctatgagccctagtgttttcatgtgtaaaacaggactatactgcctcacaaagatttgatgacaattaaaggaaattacagatgttaaatgcttaacaagaatctagtacatagtaagagctcaatgtatattaactgtcattgtggtgacaacaatcatgataatttcaagcttttatatccaattttgtgttggatgcttcattaggtaggaatgaacatctcaaacatatttgtccatctatcattatttctatatatgttgttcacccaaccatcatatcaaattcctgttcctttagtttggaggtccttattttttgggggggggggtcatgaacctccttgaaaatctgatgaagtatgggtgatgtgctcctctctgaagctccaatagcacctcacaggttccaccttaccccactgtacctccatccgcctgcactgtgactgcttgtttattcctttttccaggctctgggaggtcagggagtgtatctgcccagatcatcattttctttaccttgcttagctctgtgcctggcagagaataggtgtttgatattcactgaatgcataaatgaaaattgcaaagccttccccctgaccccttaaaaattcacctacactcaagtttttgcatctaatttcagaccctgtctgaggactccaggtaagaagctactattaatgactacctattgtaggtcattaaaaatgcagtagggaaattttcaggccaaataatgaagcagcctgtttttcaggccaactaatgaaacagccttaccacaggccagaaagaaagtgtagatcgtcttctcaagagaggaaggacaaagtcagaattgacactgtgttcgtgatgaaggcaacctttgtccaggtcccttgttttaccaaagacgacaagaggagccagccttgcccaaggtcacatggccactggtaaagagacttgagcctcctggcttccagaccagtgctcatcaaactcaaaccttccccctcttcccctctcgcactgcctccccagaagctcagtccttgcgagaattcaatgaaaatttccttccaagcatggtccgaagacaatgtaaggaaatgcaggatttacatgactttggtcaagtgaggggacaggactttaaaccaaagagttgatttaaatcttttaaaacctacagagtgaagggcttgcctcattgcctcatttgaaagatgaaatcattctgtctttatttttcattgatgggagtttggctttggagggaaaaagatctggcacttgagagctggcccagtgaggataggggttgtcattttctcctcactgaggcttagcaatgcctttagctaaggcccggcccatgtatccccaaaagtgacaaaggtacagtatttcacacaggaacacttggggagcatttttccatgggacacggcgtgagaatccattaatctcactgccacatactcaggctatttctcacaagcttagccagacatttgggtttttttaaaccatgaaaaaaagagccttatcctcctcatcataccagattgctccagcggataaacatcagacatggtttttagagaaatatcacacgatctgagaacatctgcaattctctagaacgtaccgttgtcagaacttgacttaaacgaaacaacagacatcagactttctttcagacgttttgcactgaagctttccattatagcacgaatgcctccttctgaaatggcaccaattgaaaacgcaccaggacacgaacattaccacaactcaaattcagatactcgcatgttattaacaatggtgctaattcctgtttcagagatgaaacttacagaggagataccagtgggttttcctccattgctacttttcatttgctatggaggccacaaattcaagagatcactcattcttaaattaacaaaagtagccaccacctggcaaaacatcaggccctgtgcaggcgctttatatgcacctttatatgtatcgcctcttttaagcccctcagtggtcctcggagacagctgctgttatcttccatgtcatacatcagggcactgaggcccagagcccaagtgatattgtaacagcacttcctgtgtgctaagcactctccatgcattttatttatagtatctcattaaatctcaccaaatcctttgaggtcagagccatcataagctccaatctacagctgaagaaactgagacagctctcaaagctaggcctagtttcctccaaagttcagtcacatttgttccatttgacagtatgagggaaggcctttttttggttaagcgtatagactctgcagttaaacctcctggaccctacccttgttagcagtatgatcttagataagcacgagttaactttaccatggctcagtttcctcacctgtaaagtggcataataatggaacttacttacttacctcaaaggatgaagagaatgcaatgcaaagcatgtagcatggggtctagcatacagtaagttctcaggcagtcattagcagtattaaaaataatactggccagtggctcatgcctgtaatcccagcaccgtgggaggctgaggcatgcggattacttgaggtcaggagttcgagaccagcctggccaacatggtgaaaccccgtctctattaaaaatataaaaattagctggccattggtgggtgcctgtagtcccagctactagggaggctgaggcaggagaactgcttgaaccctggaggcagaggctgcagtgagccgagattgtgccattgcactccagcctgggtgacagagcaagaccctgtctcgaaaaaaaaaaaataccataacattttttcttcttatttttatataaaataaggctgtattcataaaggatacagggattaaagcaaaccaaaagagaagagtgagggtaagtttaattgtgtgataaggatttaggtaagacagcctaggcaacatggcaaaacctcatctctaccaaaaaatacaaaaatgagctgggcacggtggtgggtgcctatagtcccagctactcaggagactgaggtgagaggatcatcacttgagcccaggagtttgaggctgcggtgagctatgattgcaccactgtactccagcctgggcaacagagcaaaacccggtctcaaaaaacaaaaaatacaattaataaataaaaagtaaaaaattcaggattaaggtaagaggtgccccgctgtgcagcacagagctccatcggattggaaaaagtggctgccaggggatgcctccccttattagttcagacaggcttatgtaccggtctccttgcgggaagtcctgtgctgctcagcgttgatggaacacacaatgaacttttccttgcttttgtctctaccagaactcgactgagtgcgccctgctgtgtggttttatccctggtcttgggataggtttccatggctataggaaagaggtggagacagggaatgccaccttctgagttcatcagaatagaagtgtgcacctgcagcaagacatgattctccctaatttgctttcaagacaaaactgtgtctactgattgggtagatattgttgaggcaagatgcggtatgtctagcctgtgtccaacacatatggcgttaggtcattcctttcatctcctctaatggtgcccagtacaatgagaatgaaatgcaaatcccttaccctggctctgggccacccagacccatttgcgggtctctagcaacacccccagaccctctatctctcccttggtcacaagggcttcctttcctctttaaggtccttacaccagctcctcctttgcctgtgacactctgtttccaggtttttcatgtacgttcttcttctgttgggtctctcctcgaatgtcagtcttcaaagaggccttccttgtgactccataaaccactgcagctctctgattcacttccttactctgtcttgtttttctgtctgctaaaatagaactgataatcctcgtcctccttctctcacagcatttctttgatgagcaaatgagattcatgtgtatgtgtctatgaagatgcttttataactgtgagtaatcaccagggatgcaaaggagggttcaatttctatgtcagttcacactgggtgggtttttctgggtttttctgaagcacagccctgagatgaattccaagactgcagtattctcagtgacaaagggtgcagcaatcccttaatgatgtctgacttgggagagggaattagaggcgtgggtgtcacatatttgctatctgtgccaaaaataaagtcatatattaatagaagcccaaaatcaataatttacaaatagcttcctcaaactttcaatggtacttctggaaaagtgagatttgaaattttactctccttcctttgcactctaaaaatttattcccctgatattacttttatattaaaaactaattagaaaacttcataggtttcatcatatatttaacatcattgctaaagttctaacactatttttggaaatcatcaaaagagaaaagtgtaagacagacaaggaaaacagagaagttttccatgtttaatattataagtcaccacaaagtattattttgatattacaatttttttttttttttgagacagagtcttgctctgtagcccaagctggagtgcagtggcacaatctctactcactgtaacctccgcctcctgggttcaagcaattctcatgcctcagcttcccaaatagctcagattacgagtgcccaccaccatgcctggctaatttttgtatttttagtagagatggggttttactatgttggccaggctggtctcaaactcctgacttcatgtgatccgaccaccttggcctcccaaaatgttgggattacaggtttgagccactgtgcctggtcttaacaaattttaaaaatagtgataggcaaatacatctaatgaaactagagtattatttgtcatttctttggatgaaccaatgcatgtaaggaggatgtagttctgggtttctcctgtttcatcacacagtaacccaccgtggctctctcctccatgccgatattatataattgtcaaggcattgagacagattttaattcatttaataattaggtcaataaaaaccattattgctgacagtgccattaaaagtccataatgtcaccttcatgggggaaaaactaatatagttccgttggattttttccgtgaaattaatatgatagcatttcagtgggtgtcttaaatagcttaaatagacatttttattaacagaactaatcatagaattaaaacaaatgaaaatcgttacatttgctgtgatgaggtatccatgttcacaggattttatcagcctcattcctgtgaagaacctgaacatttactaccacaagaacagtatattcaacttgcctggagcactgcttagggtcccaaagaggctgcccatttgtgttttggtgatttcctcttcaacaccatggctccatttctcagagccaccctactgggaaacatgccagaaccataacctcctaaaccaaaaaccttcttcatgtcccctttttggctggtagtatttcatctagaatatctaagacagtatttcagctcagaaaaatactaaagcagaaggggttgcacctacgccgcccagcaatgttttatcacctctccttcctcagcttaatcactaacggtagatagatcttaacatgaactaaggtaaactctagtatagtgctatacgatttaggtaaattctcactagaagagcaagatagcaggaggaaagaagattataccaagagtttcctctcagacacatgaatgctatggttctgtgagttattcaaatgtgcaagtcactgtgtatggctgcatcattgctgcttgggtacctacaactcttcataatcagatataccaggattcacaagaattcaggggtggtcaatattgatcaaaggccaaggccacagatgtagctagcacattatacactgacagaacgcttgctaatgtacacaaagaagtagcggctggagcctgtgaggctgtgcaaacagtataggctttgggtttgggaagacccgcattagatcttagtaacttggttcccaacaggatgaccatgggcaggttagctcccttcagttttcagtttcagcatctggaaaatggattgatgaagtccacagttgtttgactctgtggtttttaggatggttcgaaagagatttcagatgaaacatatctaacaaacactgtggctggcagagagtaagggctattcttcagaggaaagagtcatctcagttggcattggacgtatttaaaatatgattgggagggtagcctctgctaacctccagccacgttggtgaactctcagaaagccttgtgcatgcccagacatgctgaatctaaacaaaccaaagggaagctgcacttctccactgattactccctttcctgccctttggaagattctagaaacactaggaaatctacttaaatattttttaactcagttttaaacaacatctctcagaaaataccattcttagtagaataaaccttctttgaaggcgtacatagacttacatatgtgatatttgcaaccaatcagcattttgggtgactgggcaggtcttgggaagtgggaggcacagtaaaaatgaaagactttgtttgacctccctgagttctaagcaagatgtggtgcctgagaaagcttatgcaggtcctactgggcaagactataaagccaagcgcaacagagaaaaaaataccttagggcacggacgtttggtttctcaaggcctgtgatggggaaggccctgaaactcccctaacagggatggaagaaatctgtggatattttgttcatgagaagtagaggaaaaggggaggggagaaagtggaaacagcaacgtgtctggaaaccagctggcacctgtgccttgaagtaaataaattgggtaaagaaatatgatagctagatagtcctagaaatgaacatcctgaaatcatcccataaactttattttggagggggatagggaagagaagagaccctttcttccatttatttcatttagttggtgatattattgggcattaacttgggattcactattcctgtggcaagtacttacctttgctgaaattaccaaatattctctgaaacagactcttatcagaaaattgatctataatacataacggtgtcttgcaagaaaaaagtcccttgtgggggcgattttttaaaatggttcactgcaggcctttcacaatcacatggaaatttggagattgctcagatattgtgggaagaggagaaagggaacaaagagagacataatacttgagactttacaggctcctaccattttctagtctattcgacaagagcagcagaggttcatatcaaggaagtgaaaaccattcaggaatacaaaaattgtttacaaaaaacagcctgtgctttgcattcttttctgttacttcgacaattgccaagaagtgtaactgtgcttgctcggtattatttaaattaaattatcaaatgcaaatgctaaatatgaacctctcagcaaagcactgggttataatgccatgtcctctattcagactaaaagctgattactggttctggagttacaaacatgtcagacaataatttaattgctttgcaggtagaggaatatgcagcgttcttgttctcattctggaactcaacacgactctttaatacaacataatgatcataaacacacacaaagtcttcgcctcacacctgctttatggtaaaaagaagctattgcaaatttctgcaaagctcaaagaatgaggcagtgccagattttttaatcactaagcaaaacaggtttctcaccaagtggcccgggcttttactcctggttcagagagttacaagacacattttcaaaatgagtttaaagctataatgaatttcaggtgcaaaggaccaccgtctaacagctaatttgcttcctgtcttcaactgagctgttaaccataggcagccagcatgtgcacccctttcttgggccactggtgaagacagatgtcacaatcaatactcattaactctgggatcagtgtgtatcttcctcaggaagagaaagggggtcttaaatgtaactaggaggactttgtaagcattttctgagcattgcagtggctgagtgttaaaccacaacaggacaggagtgcaggagggggagagaagaaaggggagggtgagagagggaagggaagaagaaaagaggccacatttcgtgatctcctctgtctctggagctcttttttatcagctcgtgaaattcccaaggatcctgatcatctcccccttcccagctcatcgcaaagagttgttgtacatttctttgcaattgggtagggaaagatcttgaaaggtggatccaacttgaacattagacttttgtgaaacatgatacagaaattgtagtgttgcagagctgtacctgctcatttgctgactatgatgacccaacatttattgagcactgtatgccaggcctgtgctacctcaatgcttcacctggagtaccttatttaatccttatggcaatcccataaccctataggaagcagtcatccttttatatatgatgcacataaaactgtctgaaatgatttgcacctaatgtaatgatggtaggcttaaatgctttcatttttgtactttgctgtgttttaacaagtttttgtgatggatttgttcttgtttttgcaaaatcaagaataacttaaaaataaaagactggatgccaatacaaatctcccaagatgttaaccttggttaattctgggtgatgagaacgtagatgattgttatttccttctttgtacatttctgaatgtttagtttccctatataagtgaaaatatagactttaaaaaagaaaaacaaaagaagaagcccttcactagtgccacagtgtgaggagaatgaagcctaagcctaaattttattaaacagcagggtgacccaatgctctgtatcaatgctagatacaccaccaagcattcgctacgcataatcccaccagctccttccaacaactctgggaggtaggtgtcaccaccctcactgtacagacaagcagagtgaggtttcgagtgggtaaaggaccagcacttgaggtcactcgggtatctggcctccacttacccttctggcctgaggctccatggcatgccctctgacctttgctcataccctggtctccagccgcctgagtccttgtctttttctgaccacaacctcaaagtccctaggtccatacctaatgttcacactctctcatttacttggaaagccattttccagactacacccattcttccaaacgtgtatcaaatactcccccttccacaaagattctctgagtcacctcagccttagtgtattcaccttggtgtagtatatgccacaggctgccacatggcaggtgccaggccagctcaggcacactgaatgctctgtatggcttatgcagtgtttaaaagatttaaaaaataattagacttgtattaaaaaaaaaaaatgtgtacctagtggctcaggttcccctaccctgcttggcaataattaactgtagccaaagcgtctgccctattcagacagaagcctgtgtgtgctctagttcccaacagtttccttttaatactccttcttatccttggcccatttctcttaattcattgttgtcaggcctctgagcccaagctaatccatcatatcccctgtgacctgcacgtatacatccagatggcctgaagtaactgaagaatcacaaaagaagtgaaaatggcctgttcctgccttaactgatgacattaccttgtgaaattccttctcctgactcagaagctcccccactgagcaccttgtgacccccgcccctgcccaccagagaacaaccccctttgactgtgattttccattacccacccaaatcctgtaaaacggccccaccccatctgccttccttgactctctttttggactcagcccgcctgcacccaggtgattaaaaagctttattgctcacataaagcctattggtttggtggtctcttcacatggacacgcgtgacaattgttttatgtgcccagcacatcacaggtgttcattgagggccagaaactagtcacttcactactgctataatcctagggagagagaatggtggtctgaattacaagcagtgagaatagagaaaagatattccaaagaatctgtcctctgaaattaggggctttatttatttattggaacactttctatcttgaactgtagtgatacgggtatacatcttacctattctacttgactgactgcatccccctgaagacacgtgtcaggtgccatgcctgccctgtgatatccccagcgctgcctagctgaatggtgcatacataccaggcacgggatgaatgttggttgactgatcattcattttaatcctgaaacctggcgtttatgtttccgctacatttaaaagctggcaaaacacatctccttccctcccactcactcaattaaaagctcagtacattaattatctgaattaaagtcaagagtctgagatatccctcccaatttataaagacagggacgaggtaaatttttttcccaagttgtagggacagaaagaagactaaagaatgaggaccttacaggcgagcacggggccagcgaaggattctgttttaagatcatctcctggtgctcattagtgctgttgctcttcacctgggtgagcgggcttgcttccatggagaagagacctccgccagctcctgctgcattaacggtctccgaatgtgatttggcggcagcacgggtctcattagagtgggggatgtgcaaaggcagaaggcctcactttgagaaaacactttgcgtatgaacaaaggtggaaagatgtcaggcttttaaagggaacctgcatctcgctcctcacttagcaaagtcatcaggagattctgctaagtaaagaagttctggaccttttcaagctattaaaggtgacccaacaaagcaaaatggctttgttccccaaatttctttttgtcagttgccttgaacaaccaagcctgaacgaaacagcctaagggagattgccaggtaataataaatccctatttgcttcagtaaaggacatctcaaagaagggataaaataaaaaatatcagaattaaagaggcacaaaaaaccctgaacatccggggcatgtagatgctcggtagcaatgaatgtattaggttggtgcaaaagtaatagcgattttcgccattactttcaatggcaaaaactgcaattacttctgcgccaacataatacttggggcctggttctcaggggtagggcttccagcattttaagtagcagtctgccatcaggcaagatgtgcatattcatcattgatgtggcttgatcatgacatattctgttttcttgagcaaggaaagaactcagcaacatctcgcagagcgaccatcaggttatgtccttgtctctggttcatttgaggagagtaggaaattatgaaacccacaagaagagtttatggctcctcctcacactcctacacttaaatccaggaagagactgccaggcgtcggtcaagtttgaagatatttaatggactatgcattatctacactgccccatttcaaggtcaatagctgtctgtctctttatcccataaggctaggttttcccttgaagaagaaggtactgctgttactggtagagggtgcctatgttcttggcatcttgaagaactggacaaaatgcgcaaacaaagcaaggaaagaatgaagcaacaaaagcagagatttattgaaaatgaaagtacactccacagggtgggagtgggcccgagcataggggctcaagggccccgttacagaatttttgggggtctaaatagcctctagaggtttccattggttactgggtgtatgccctatgtaaatgaagaggatgaagtaaagttatgaagtcatttacttggcgtatgccctatggagaggatagcccctgtcatagctcaagtgtgaatcagccttatgttccctgcctgcagaccctattttcctgtctcactgccacttgggtctcctgagaaggccctttgctgactctgccttctgggaactggcaagtcaggtgatctctggagctgccccacggtagaaagtgcagagcgaacagccgaggactgtcatgcactaagcatttggggaaaccaccctttctcccaggttggtgggctctctcgagacaggtacctgtacttacttggtattggagtgctctaatcttagagtctagtgtaggcttcaggggagagggagctaaggcggccattctgtttgctttgtttccaggccttgggtttgtctctagagggagaaagagtcctcctctgtctagcttgaagcagtgggaggctgtatggggcacggaataagaaactcaaagtgtccctttccggcgtgtcctgctctgtgggcacttactccttcagagcttgtgaagacagagataaaggtcagtcaagcccaggaccaggtgttgggattgttcttatccccaagttttctaatttcactaggaatattaaaggcaatttaatgcaatctgcattttaaagataaaagtgatggagttcaggacatgcttccccaaaatatggcaccttggcatagtgaatattttcagctaaaggaatgtgagaaggtaacagaagtaggaaggtctttctgactgttcgctccctgtttgtccttgcggcaggttagaagaccctcattggagaggtgccctgaagaaaggaatgttcttatctctgaagacaaagggtcacagagaagaatctgaacaaaactctgtgctaagtgtccccagtttattgccattagactacatcctttttgacctagaagctccaccttcaaagtttttaggtagccatgaccagtctaactgtagaaatggaatggaacattggaaagactgtaaacttggagctctaagaactaggttcagtttcctccacttatcagctttgtggccagagtcaaattttgcctctctgtgcctcagttaccttactacaaaattaggactattctgaggcttcaatgagggttaaccatgtactgagcatgatgctgggtatgctactctgtagacactacttctctcccctctcctctttggtgacttttaaagatcatggggaagctgggcgcggtggctcatgcctgtaatcacagcactttgagaggccgaggcgggcagatcacgaggtcaggagatcgagaccgtcctggctaacacggtgaaaccccgtctctgctaaaaatacaaaaatttagccgggtgtggtggcgggcgcctgtagtcccagctactccggaggctgaggcaggagaatggcgtgaacccaggaggcggagcttgcagtgagccgagatcacaccgctgcactccagcctgggagacagcgagaatctgtctcaaaaaaaaaaaaaagatcatggggaataatctacatgaaaatggatgttgtaaagcctaggacattacatgtgttatgtggcaagaggggtaaatggtagagttaatttttaggcctctcttaagcctcacaatggttctaattttgtaataaggtaactgaggcacagggagacaaacacttgactatggccacaaagctgataaatggaagaaactgaacctagttcttagagctctaaatttatactctttccaatgcttcgttccacttctacagttagactggtcatggctacctcaaaaccttgaatgtggagcttctagatccccagcggcaattcccatcaaggagaattttgcctgcttgactctctcctaccatccacagtcattgttactgcaagtgagttaaagcagttgagcaaatcatatatatatatatgggtacagggtttatatatatatatacatatatatgtatacatatatatgtgtatatatatgtatatacatatgtatatatgtgtatatacatatgtatatacatatatatgtgtatctccccagtgtatggggttagaatgcagctgtggaacatgggggtgtcctcttagtgactcaaaccaaattatcactggagaaacaatgagaacaacaaaatcaaatgcaaaccaccaaaatacaagtgtagtcctcatatcaagaaaaagataagggaaagatcttcagaaagcccctctattaattatttagtctcagctcagacagttccagaaacagaacagtgataaacaggaccattgccatacttctggagatgaggaaaacaccagaatagaaatcttcagtgggctagtatgggactctggctgtgatccctctcttatccaaaattctgctaagggacttgcctgagaacacacacagatttctctatgagagcaaaataagagatatatacataggttagataatgcaatgaagatcaaaaattacattttggaatgttgtattccatcttatggggcagcatttaatcaggatcctagtgcaatcttccatctggagccccaaatccaatgtcacacattgcgggttggggtgcggaagatctagcttaaccctagtgaggaagatgtcctgcctggttaacttccagctcagtgggtattagtagcatagcagggatgccaaacaggaacacactatggggtgtcatcagcaagaataaggtccagagctatgtggtgggttagaagtctgaaagtcagaaaaggctttggaagccctcttgtcttccattttacaggtgaagaaactgaggctgaatgatttgtttaccattcaggttacacagagagttaaagtcaggacccagaccttccaagtcccaggccaaagcaggtgattattctgtagcatgtgctgtccatattcctcggcagcagtatatcccagcagcagcataatttcagaaaaggaatgagaaaaggggatatatccattggagggtacccaggatcaggggtttcaaagatgcacaattctgggacacagggtgagtagtcatgagaagtggagatatggggtgggggtgcgtgatggtttccgcaaacacaggagaaagaaacattaacaacgtgggccgtggaaaaggaattaaacttgtttggtttcatggagcaggtagataactagtgggtggatcggaagaaagcaatttatatgtctgtggtgaaacatacacacataacgtaaaatccaccatttagccattttaaagtatatcgttcagtggcatttagtgcattcaacagtgttgtgcaaacatcaccgctacctagtttcagaacattttcattatcccgaagggaaaccctgcacccattaagtggtaactcccctttcccctacccccccagtccctggcaaccacttatctgctttctgtctctatcaatttgcctattatggatatttcatagaaatggaatcatacaatatgtggcctttagtgtctggggaagcagatgcttttttaacataatgaaaattgcaggatgaagagtgtggtttgaaagggggcttggtaatgacttaggatgcttgaattcaggccaaggctagaagtccacatggtagggatattgcggaggggcctctgaacaagaagtgggcttgaaaggctggctcttcagggcttttctgacctggagatggaggccctctctgacaagcccctgggactatctccctttttccccacaaccccacctctgccagtgatgaccagtctctaccctacggtaaaactcaggtccaaccacgtccactccttttgctaatttcccctcttttcattctcctcccacctccgggtctgttgacacttgcttgccaatttgcctgacacactgcagacaatcttctcactcaagcatgtttgacctgaacatacagctttctgctgagctgatctggagtttcagttggccgtttgggcagccagacatgaattaagaacagggataaacaaggatggcttgagctttaactacaccgatttggcccaataggctcggggataatctataagacctaacagctgagggcaataaaattagctacaaagggactgcggggtagaaacaatgtcttctgatacttcacacaacacacactcacacacaaaagacaccaaaaactctccgacagaagccttacaacagcttagaggagaggcattgtgcttgaaaaactatattttaaaaagcagagaggaaacccacggtgactgaagtatcattttcccggtggtgatcatggatttcatcccaagacctggaaatcatgttagaactacagtatcagcccagctttgtgtctagggcttaaacttgaaatgttgtttacataaatagttaaggaacacatactgggttgaagagtgtgctctccaaaaatgcatgtccacctagagcctcagaatgtgaccttatttggaaagaggtcttgggagatgttattagtcaagatgaggtcatactggattagaatgggccctaaattccgtgactggtgtccttataaggacatcaacggagggcagaaggccatgtgaagacaaagcggacactagagtgaatctgctgtaagccaaagaaggccaaagattgcggaaaggaaggattcttccccagaactttcagagagagcatgattctgctgacactttagttttggacatccagcatcttgaactgggagggaatgcattttggttgttttatgccactcatgttgtgccaatttgttacagcagtcctaggaagctaacataatacactcccaattccctcttcttttatacaattgtacaaccctatttgaaacatggaaaaggctcttagttctcacaaaaaaatctcattatatttggagttcaacttctgaacacgggtttagaaacaaatagggtctgatttcactgattttcaaagggctttctttgtaatgactggggtttgttttatttgtttgcttgtttccaggagaagagaagattggcctcagacacttccgtcttcagacctgtgcctctcctttgaggatcccttccccgaagctgccaaggagaaccttccctcacattgttcctcctttgttccccgctctccttttccaggctgagagacctggggccttggaagcaagcacacgctggctgagctgtgattcctccatgttgattataatttttatcacattatatgggatccctctggtggttactaggggatacgtcagttttgagagattggaacctaaccaaagaagcttcaaatctagaggataaggggactcagagtttacaagtcacagcaagcagatgctggtctgctttaggtgcctcttacggggattgtgagagggctcctggggcctgaggagggtcttctgaggtgtgaaaggctgtactggtggtccctgaaagccatcgtcatttgtgtgaggaggagtactggaggagctgtcttaccacatgaaaaacagcatggagcatcccagccacatcaaaggcacggtttgagccttgggctgtagaggctcagagagagtgacaaataagaccctggtgagagaccaatggggacagtatttccagactttggcatgaaacagatttctgagcacctcatgaaatgtctgcaagggcagctcctcagagtgaccctcccaaatcaatcaaagctggccccctatcttaattatgacttacaaatagaagcatgcacctggctggatgcagtttgccacatggtttacaatagcggtagaataagaaataacttaccaaacgagtacattttcttggctggctggggcactcagagttgacactggtaaggctccattaaaatgcctttatgttctgatatacacagatgtgttaatttatagcatattcatcagaagacataaattaattgctctctgatgaattttataacacctcctttatgcctctccaccctccccctccaaagtacactgaaaaggtcaacagcactatcgaatgcagcacacttcaacttccttccaagcttataattaaagctaattagtagctttggtaattagcgcatgtaagctttctgctttctgaattaataagactgagtcaggttttgagccaagtagacttttcactcactggttctgattcttgaactgtgtttggctggttaatttaaaacatgtctgttgaaagtggaatactagaaagaaaacatacttgtgatggtctgctctcaagccagtgtgatttatgaacaggccaaagtggaactgttgtcacaagagaaaatcagaatgctctgggtttccaataactgaccagtctcaacctctcagtgtgaaatgagttgtgcccagttactatgtcacatggacacaacacaacgtcaaggatgcccttgcacacttatgtcaccctctcataacacatctgtactaagcacatcaaatcctctttattttaggagaatgcagaggcaatggcagtggggtgccaagatataactaactgctcattttgattcaaataaaaatcaaagaggagaaaaatcattagtcaaatcagcttctgcttttgtgtagacaaagtgattctccaaatagcttcgtgtttctttttttagccagcatgtgggcatcctgcatgcccagacagaattaaaagtgcatgttttaaaatcaagaaatcaaatctatattctattaaaagaaaaaatgtgatttgttttcagactttagaaacagttgggataaaaatttccacgggtgagctcatttgctttttcttttcccatactaatctcagaaaatttatttttgttttttaaagaaagaaaggaaggaagaaaaagaaaatcacttagtgatttactggactccttataagtccaggacaatggtgggggttgctcacagcgctagtaattttgatacataaagaaaaggaaacagtcactgctgcagagagaggaatatataagacagctctgggtcactagagtaaatggttttcattttaatggcgcacttactgccactgtgatagccacatttggatctgtaaggggcagttaatactattcaagagcaaggcacatttggtcttgtggatggctgtgattgtgaaggtgacaaggggttatggattcccacagcctcacaggcccagctgaataggaagccttgtgcccccttggcagctcatcctaccccgtggcagctcatcctacctaggtggatacactccagtaagatctatacacagtggttctcaactgggggagattctgcccccaggggatacttggcaatgtttggcacagttttgattgtcataactggtgggagagggtagatgctactggcatctagtgagcagagactaggaatgttgccaaacgatcagccatgcacacgacagtcactcctcaacaaagatgatctggccccacaggatactagtgccaatgtcatggaaccctgatacagaaggtctaaacagggtctgaggccctccttgtctttgaggaagagttaaatgttagctttccagattgactctggactgatcttggccttatacaagtcagaaagaagtgagtgatagctcacccacaggggctagatctgagtcagactggaagaagtcggcacactcagggtaacggcagctgcctaaaagccaagcgctgggcatttttatgttgcagctaaggccagcatgctgcattatggatgagctcatgtgccatggcaaacagtttaagaacgatgcttatatttaatgaatcctaaatggtttattacagagggtcaagtttctgcttcctgtgggaatttgacatttatgaaaatgcacgcacattaattattcagtggagacgtccttcctatggaaattcactttcctgtacactcgacaggactacattccctgtctgcatgggctactttgttgttaatcctctaagcattaattaaataaaatttgcaaccgagccaggatgcatctaccctcaaatgttatgcaaaagacagttaaatgctgtttgatttttcctgctagtagccaatcattacccatagctatttatgttcttccttttgttctttaaagcataaacctggtatctcttcccactgagaagaaaactacgctcagtaattaaattacaccacattaaacttacttaagttcaccagcagggaaaattccgtgcccctgggtttaacagtaagtcctaatcacgcttgcaagccatatcttttctgtgagttgttatagttttcattcctggaattccattaaaaatggtaatgtcattactcctgttactgctcaaaaccaacagcataatcctgaattttaattagtaattacaattaatcattatttcattaatgaaatgtttagttggtaattgtctttgagcaccttactccctaggcttataagcatttcataacatctaatttgttgcctgtttctgatgaagtggcactgtcaaccttattttatgttaacactttgatggggctctgcatcccaggcctgcaccaccggctgcatatttacaccttggaaatgtgtggcttctggctctcgataaggttcgcctgaggacgtaccctcgcattctttcctgccagcttaagaaggcgactgtttgtgctcccagagagcacagcatgtgaagagagaaataataattcctggaacgcttacttaataataaatctgggatccaaattcatggatttttgagaggggatagagcaaggatttggaggtagtctttggaacaggaaggttgattttaaaagagcttaaagaattaagaataagctgggagggttgtcaagaatttaacacgaggcaagatttttgttgatccttttgcaatagcaaagatattcttatttattaggatggttttttaggggtgaggggaagcttgtcttccccaccaaaaggtcagggacccaagtatgccttgcacacagttgtattcctagctcctggtgcggggttgggcatacacgtgactcaataaacagctagataagtcattgttcctgcatggcctatggttaggctatgaagggggtaactgaggtacaagagttaatggtggtttggtgatggtagcagggtgtgggatgctaggagatgccaaatcagtgggctggtgtgctcacaaatgacctgatgtcatagttgtctgtcactgacaattctaaaaggacggattcatccgactgccctctatgtaaaaaaatttacacatacacacacacacacacacacacacacacacccgacggtgaattattcagggaggagaaagcctgctatccttggcaaattaaacaaggaggatttgagcaaagaaaagatgtgctgctgttatttcaaggaagtattcacagcttcagaattaaaactgagatggaacaacatcagacttgttggaaaatgctccgcgtctgtggtgtatttcagacaagttagtcagaaaattcaaaatatctggaagaaataaatgacggccaacagtttggtgttggccaccaggtgccagagcacgtatggtcttggcctaaggtgagtgaaagacaggtttctgggtcaagacaggtgtttccaaatggcaatttttgaggctgctgacattttacaaaataaaagaatgtgataaagcttaagtttttggttgtattttataaatgtctatatttaagaagttcatgctttagcacacataagacattcaacaagtcatttggaaataacatcaaatgtcgaaatttgagaccctttataattaggagtggaggaccaagtggactccatcccttgtccccacataggtcctatttctttcctaggccacacagcttttaaacataatatttctcccctattatccttcagtatttatagagcatccggcctgtgctaggagcttgaaaagacagtccctctctcatggagctcccaatatagaggccctttccctttggactttcttctactggaaattgccttttcttgtgtagttccctttgctgactctgcttgtcctcctgttctcacaaaggctaccatgcagtgggggaataaatatgaaaaaaaatataagatcattgcactgcagagtgaaggagcaaatcccttaacagtcatgagtacacattccagctcatgagcataaagccacactattcatagaaatgggtgatactgattgtacacttaccatgtgtgaatattgtgcttagtatatcacatggattacatcacttcacctgcttcggagaacctggattgagcataatggaaattaagagttggcccatccctagatccacatctgttacctgctttgctggctgcctgggaatgaggtcttgtctgtctgttttttgtttttttaacttcagctttggcctggagctgcagcccaggccactatggaaggaaagggaatgtagcctttataaaatcatctatagcctggtgggaatgtcaactagtacaaccactatggaaaacagtgtggagattccttaaataactaaaaggggaattaccatttgatccagcaatcccactgctgggtatctacctagaggaaaagatgtcattatatgaaaaaaaatacttgcacacacatgtttatagcagaataattcgcaattgcaaaaatgtggaatcaacccaaatgtctatcagtcaataagtggataaagaaattgtggtatatatatatacaatggactactactcagccataaaaaggaatgaatgaattaatggcattcgcagcaacctggatgagattggagactattgttctaagtgaagtaactcaggaatgaaaaaccgaacactgtatgtcctcacttataagtgggagctaagctatgaagacacaaaggcataaaaatgacacagtggactctggggactcaagggaaaagagtgggaggggggtgagggatgaaagactacacatcgggtacagtgtacactacttgggtggtgtgtgcaccaaaatctcacaaatcaccactaaagaacttattcatgtaaccaaatactgcctgttccccaataacctatagaaataaaaaaaaaatttaaatcagctagagccaagcagaaataataaggaaagtgaattccaagaaaaagtatggaattctcttcaaagcataacagaaaatgttttgccatttctggttgttgtcatgaagcaaaaaaacccacttgcccacttggcatgtcttacctgacaaaaactacaaagaaaggcctgcccagggtttctgcaagtcctggatctgggaggctgtgtctcacagagagtgacagccaagactgaataactgtgagactgtgggcaagctggtgagttcttctgtgcctcaagttcctctatgtaaatggggacagtgatccttgctcttgggcttgttgggaggattccatggaatgatatgtgacacctggcacacagtgtacactcagttatcatcacatatgtcatcttcaatatgatttttgccaattagatgtggactttttgcgttcattaaaaatttaaacaaacaataataacaacaatcacagtgagtttgggtttataatactgtggatttcttccttggcatgattggagataaaagaaggaacattccatgtgatgctgtgaggtcccaggaaaggtgtgacagagaatcctgagtcatgcttacctgtcattactagtgggaatgagagccatctgggatgacctaagtgcatattgtttgcagacagtgataggtgctcagggagcaggaaagtggagcatgaactcacaatagaaggtaggagcagagacaatcaagtcctatcctaccagatcaactgagagatttctattccctaaagttccacagtctttgtacccctctcaccatgtcaactttgctctccttgaacgatcttatcccctctcttgaaccatactccctgtttttctcacatttacgtccccttcaggatatggcaaattgtcttatgctcaggaaacatttgctgaatgaatcctctggagatcttcagaaaatcagcatattccaaatgaagtgactgagacttaagcaagagacccagggtgggatggacagactcttgaatagcatcttgatctagaccagtataaactcgtgggacctaaacaaaagtggacctttgttcagtgaagaagattcccagggagcaggtagaagcagatggagctaactccagatacaggctgtgctctccgcagaccccagcgtcttcgtagataggaggtttagcagatggtgtttttgcattaagtttctaaattaccatctataagatcctctgttttctaaaaactagttgccttaaggctttaagattttaatgtaattttaatgtttgtgtgtgttgttagtgtacctgtttctcaggtttgctatcccagataggttatttgctaagatcagaagaaaatcaattggcaaaagaacatgctcacatgttacatgttattaccagttggaacaagagccatctgggatgtaagactatccaccaaacgggtgtgtggaactgtcccttggcattgcacaggaggaccacttttagtatgatttcctgtgctgtggctatgacatcagggaggctgaggcaggatcacttgaggccgggaggtcggggctgcataatgagttctgatcgtgccactgtactccaccctgggagacagagcaacacccgtcactaaaaaaaaaaaaaaaaaagaaagaaagaaagaaaagaaaaaagaaaaagaagaacaaattcagaagctacaataggaatagttcagaaaccatcctccagccttttaaaggcacagaagagctttgtttcacattcgtttcggcttccaaagcaactagtcaagtcagtttcacctgttttattcacaacagttatctctccaatccagattccttctttaaaaaaagggaagaaaaaacattctcatatttcttgttttgctagcaagaaatgagctgcagaacactttcagagatccactagctgttttccttaagctgaggctgagagcttcaggggcactccaaagaaagaaagaaaggaaagataaaacaaaggacgagaggctggggggaagaaagagaggaagggagggagaaactatagagaccactgtgtggacacccacaacttctggttctgaggctggtgggaaaggaatttgcaatagaagaggaggggaactgagaggagagcactgtattaagagcttataggaattctaaaaagaaaaaaaaaggaggcctttgatccattccaaagagggaggcagaaaacttcaaagcagaataacagtcccctgcactctgccctactctaagtacccggagcattcattatgaatcagcccacctcccctcggcccacgtggggctgtgcaagccagacacgcaattcagacccacagcttgttcagcctccccgagaacacagcgtgtgcaaggtttgggaatggaaatatagcagggtgcccactcctaagtggggttaattcacggatgtggaaggaatctctacctttcgcagagactgctagaaacaccagcttcccttctttctcttcaaaggaagatggtgtttttttctccttaatcctgagtcatttacagtaagatacacgtaaataatagtccaggaggtaaaatgtgatctacacagtctctacctcaaaaataagttttttgggggacttgtttaccattccgaatgtgacccggcagccctttacaaaaagtaacatttgcttttattagatacagcagatctatttctgtgagcaccgcagatgtaactgggattcatttttactggatgtctcagaagaccgggccgactgccagctctcctggacacaggaagttacagggtgcggtcacttctgctcacccatttctccttcaacagcgcagatcacatgcacagagttcttaggagacaggtcttccccaaggcaaaggcacacagaaatgctttccttcccagctgccccttgatgaaagaaactaaacacctcttcagcatggatatgacactagccctcggcttcttattttttgcaatgactactctgtgtcagagtcagtaaaaatcgcaatgcagagaagagagataaaaagaaacatcctggagaattctcctggttatttttaaaatattgtctctgttgacttgaagtggtgtagaaacagttccatatgctgtgtttcttttttcctgttgcatcttatagtttaaacatagatcttttatcggatacaacttctgttaacaatatggcctactgggttagcaaagaaaccgttcttttcttacagttctggatttggggaggttgctcacatttaactgtggaaagcattatgctcttatggtctttgccaattcttttctgtaacacaaacctaaattacataccaatttctcgaggttcttgcctagtttggaccaaattaggtcccacaaattcctgatcttagcaactgtgtctctcagttattttccgtgagacaatatgtttgtctgtacttcatattgctttgtggagacaattaccagtgctatatccctatttttctttttcttgaaaaaaaatttaatttttagaaattatttgtataggaaaaatgttaaaatagaaataagaatataacctctttgaccaccctgctccagtcctggtcccctccctggaggtagccgtattagcagacaggctcgtgttcttccagacatttttctgtatatttgcacacatctaaatacatagtcatatgtcttgtttttgttgttaccatcattatacaaatggaatcataccatagaacagatgcctcataatttatttacctattcctctattaatggatgctacggtctgaatgtatctcttcaaaattcatgttggaacttaagacccaatgtgacagtattaagaggagcctttggggaagtgattaagacatgggggctctaccctcatgaatggacttagtgcctatataaaagacactgaagcaagcactctggtcccttctcccttccaccatgtgaggacacagtgtttgtctctttcttcctgtgaggacacaacaagaagactccatgccagaagcagagggcaagccctcaccagaaacccaatccgctggcaccttgatcttggacttcccaggctccagaactatgactaataaacttcttttttaaattacccaggctaaggtattttattgtagaaacaggaatggactaagacaatgaatatataccttgcctgttaatttgctgagaaccaaggtttcattttcaacatttactagctaatctagcctagagaagtacaaagaacccaggacttggattttagtccaacaatactactaatgtccaggtaatcttcggcaaatgatcatcctctttgggccaacatatcctcagctgtcagaccagtgggcatgtacagtgaacaacttagtaccaggtactacaacaacttacacatgcctaggccccagggcaccatggtgattctgattcaaagctagggctaagattggctacccttagcaaagaagagttactgatgtgtaggtgagaaaaatgtctcacgatttagaacaggatgggacaaactacatcccatgaaccaaatcagacctgccacctattattataaataaagttttattggaacacagcaatgctcgtttgtttatatattgtctttggctgctttagtgctaaagtggcagagctgagtagtttcaacagagatctcatgactcacaaagcctaacatatttgtcactgggtaccttgcaaatgtttgcagacctctgctttggaaagatccctatggtcacacagagggtggggaaggaagacaatttagagtggtggtggtgatgggggtctgagtcagggcaagagaaaagaacaatgtgcgagacacaacacaggcagaagcacagaagttgtgactgactgaatggataaaagtatgagaaacagaagttaccagtttcatatttccaacttggaggcttgggtgattgtcattaaccaagatgagtgtcatgaaaggaaagaagatgtttatgggaaggtgagtaagattcgaattagggactttctgaattcaaagtgcagataaaggtgtccaggaagcagttggaaatatgagtctaatattcaggagagaggtggggctggaggtcaagcttgagcgccaccatcttggagatgagagcaggtttcaggtgagcagaccagaccaaagagggaaaaacatagaggcaagatatttgaggaagaaattctgagaaaccccaacagttaaaggactggcaaaggaataaacctgagaaggagcaatcagaagagtagaagaaaacaaacatgataatatttgtgaaagcagaagcaactgatgttggcttttataagaggtctttgttgggctcatgtcggggtaaagagtgctctgaggatttggtgcctcttgtcagtgtcctgtggtggcttccatagaaaacactccacacccattatctgcaaggagacagctgcagttttgcctcttcatgtggtttcctcaaacccaccccctgggaaatgcaatatgattctctcacagagcagatgggatgctaactggaatcacctctgccttgcagagttctccctcagttgctccaacagtgcctggtagtgtaaacaagactggcttaccagtgcagcattcaataccagtgcttacccagcagccattcaaccagtcctgctgatgccccaccatgtgccagccaccaaagcatctagtgccaagattacaactgtttccttctgctcctggttcttagagtttttttttaaaaaaaatatataaatgatctgcatttagtgatatatttatttttaatttttttatttccataggtttttgggggaacaagtggtattcggttacatgagcaagttcttcagtggtgatttgtgagattttggtgcacccaacacctgaacagtatacactgaacccaatttgagtcttttatccctcacccccaccaatgctttcccccgagtctccaaagtccattgtattattcttatgcctttgcatcctcatagcttagctcccacatatgactgagaacatacaatgtttggttttctattcctgagttacttcacttagaataatagtccccagttccatccaggttgctgtgaatgccattaatttgttcctttttatagccaagcagtattccattgtatacatataccacaatttctttatccacttgttgactgatgggcatttgggctgtccatatttttgcaattgtgaattgtgctgctatgaacatgtgtgtgcaagtaccttttttgtataatgacttcttttcctctgggtagatacccagcagtgggactgctggatcaaatggtagttccatttttagttctttaaggaatttccacactgttttccatagtggttatactagtttccattcccatcagcagtgtagaggtgttcccttttcacagcatccacgccaacatctattactttctgatttttttttatcatggccattcttgcaggagtaaggtagtatcatattgtggttttgatttgcatttccctgatcattagtgatatcgagcattttttcatatattttttgaccatttgtacattgtctgttgagaattgtctatttacatccttagcccactttttgatgggattgtttgtttttttcttgctaatttatttgagttccttatagattctggatgttcgtcttttgtcagatatatagattgtcaagattttctcacactctgtgggttgtctatttagtctgctgactgttccttttgctgtgtagaagctctttagtttaattaagtcccacctatttatctttgtttttgttgcatttgcttttgggttcttggtcataaagtctgcctaagccaatgtctagaagggttttttctgatattatcttccagaacttttattctttcaggtcgtagatttaagtccttgattcatgttctgttgatttttgtataaggtgagagatgaggatccagttttattctcctacgtgtgacttgccaattatcccagcaccatttgttgaataggatgtcttttccccatttctgtttttgtttgctttgttgaagatcaattgactgtaagtatttgggtttatttcttggttcactattctgttccattggtctatgtgcctatttttaaccatgctgttttggtgactatggccttatagtatagttcaaagtcaagtaatgtgatgcctccagatttgttctttttgcttagtcttgctttggctatgtgggctctttttggttccatatgaattttagaattgttttctctaattctgtgaagaatgatggtggtatttttatgggaattgcattgaatttgtagactgctttaggcagtatggtcattttcacaatattgattctactcaatatccctgaagaacacagatgcaaaatccttaagaaaatacttgctaactgaatccaacagcacatcaaaaagataatccaccatgatcaagtgggtttcataccagggatacagggatggtttcacatacacaagtcaataaatgtgatacaccacaaaaacagaattaaaaaaaaaatcacatgatcatctcaaaagatgcagacaaagcatttgacaaaatccagcattgctttatgattaaaaccctcagcaaaatcggcatataaggggcatacctcaatgtcataacagccatctatgacaaacccacagccaacataatactgcacagggaaaagttgaaagcattccctctgagaaacggaacaagacaaggatgccctctgtcaccacttctattcaacacagtactggaagtcctagccagagtaatcagacaagagagagaaataaagggcatccaaatcggtaaagaggaagtcaaactgtcgctgtttgctgatgatatgatcatatacctaggaaaccctaaagactcatccaaaaagcttcagaactgataagtgaattcaacaaagtttcaagatagaaattaacgtacacaaatcagtagctctgctatacactgacagcaacctagttgagaatcaaatcaagagctcaaccccttttacaattcctgcaaaaaataaaatacttcagaatatacctaaccaagaggtgaaagagtgtacaaggaaaactacaaaacactgctgaaagaactcttagactttctctatccctatatttggaaagaaggttggaggaggggtacagaaggacggagggaggtagagagagtgttaaagaagaaggaaaggggtaaaaaagaatgggaatagaggcatggactagaaactaattagatggtgaggcagagaccttgcattgcgtatcttacatgcactggcttggcagccttgagaactgatgtgtatattgaaagcaacagcacatgctaggtgtccagcataatacctgacatatattaagaactcaatacatgtctgttataataatatttttgagtatccagaggaactaggccagcctttgaattgataggccctttggtaattttcatacagccatgtagcaaaacttatattaaataaattgggggaatttcatattatactacattccttttgcattctcactggcaggagtatttagcctggatgaaacttgatacttcaaaaagaatcacttgctaaagggagaagtgagccccaccttctgttaggaagatgtggtgagtacatcaatattacaaagattcagtgtgttaaatcaatatgttcaaagtagtttaaatgtccaatactggtttccaacttctaacttttctctatcctctctctcggcctcttttcaaccattccttccttaatccttccacccatccctctcctaacccccaccattgtagactaatttcttttggttatctttctaagcctttgcacacttttccctattgacgagctttgctgttaggattctccagctacttctgcaaagaggttttcaaaggacttttgaaaatgcagcactgtgtatgttttggtaaaataaagcaaacattttgtgtggttgggtttgttgtttgaagtgttgcagtctccctctggggcctcctactgtcttctgactagcacctcaacagcatcccttcctgctgatttgcagagggtttgattctttttcaatagtgcataatgctgctgtcttattgcctgtttgctttagttcatatttcttctccagatggattttctatgaagatcatccctatttgtttgatctttaatttcagaccttgtcattttcttttcgagtatgcttttttatggatgtttcttttggcagaaccacttcctatgagcctcagtgtgtgttaatggcactttcatttattatcatagacaatttcaatttctagagggatagttgagttctgttgtggttcaaaggagaaataaatcctcttgcaactttggctattttatttcacttcacttttggcctcagaggacgagagagaagctgagaacattagccacatctgtccatgaagatttctccaatatcaatttgctcccacacctgatgtactgaatactcagaaaaatgctcaggctataaaaccatgtctaaggcacagacagtttaagatcaggctttgaatgaaggcctcagtttatcttacacattactgaagcccattctatagaagactaatagtttccacaggtgtcttgggtggagaagggaaaaaagtcaatggactgagatactattggtctcaggaatcatttgcccaatctaccctaggccaagctttgaaggacaggccatctgaattcactgagtgactgaatcccagcacaggaaatgttgatattcttattgattctttaatggccattttatatccaaccatccagccatccatctatgcatttatccatcatttatagtaatgtccctaaggctgctttcttgctaaaaataaggaatattgacagctgaaactcactttattattctgccacagttttaagcatccctgcaaacacgacttctttaacgatctccagtttaattccacagtatggttccctatctgcattattctctcctactctgatcatcttatttatttatttagacccagggtctcactctgacacccaggccggagtgcagtggtgcagtcttggctcactgcagccttggcctctggggctcaggtgattctcccacctcagcctcctgagtagctgggactacagttgcgcaccaccacgcccagctaatttttttgtagagatggggtttcaccatgttggatcaccctactttaaaattgtaatatagttcccttttccagcaacttccatttggtttaacctgttctttattttttctttgcacttttcacctcctagcctaatatatattgtacttatttactatgtttacagtttgtttattggctgcttcaagaacataagctcctctcaccatctactcactgtattctaagtgtgaggcatatggtgggtatttggtaagtatgtgtaaggcttcttggggaaatgacccttcagtgcctttattcaatactcaagagtgtttctcagcccctaacctggcattgtaggagacacaatgtgcgcgagtgcgcgcgagtctcatacacgggagtctcagcgtgtgtctcatacatgctgctggatgtgtggcatgcctggcccctgcccaccaattgccagtagtgaccttatcatcaatgtaacaattaaaaacaccccaggacatttccaaattcctcatatggctccagtaaggctttgcttgataattactgcaagtcttagaataaaaccatttttttacactgtgtttccacttggcaaataattagtccaccttatggcatcctaagggcactctcagagataatacactttcttttttatatgcctccctcaacagatttcaaaatcctctcacacaattaaagacagtgatatttaatggtaaaactcagctgtcaatgatgccttctatgtcagtcattaacaagccagtaaaccaatatttactaagagcttttgagcctgacttcatgccatgcagtgtccattttatagcacaaatggtaccccacccactaaggctgtgcctgtgttacctgcggtcagcatctcatctaatccttcctcacattttagcaaaaaccaggccctgcagtcaaagaacaagtttgactgatttcttttcactggactggtcagttattcaaccatgatggacaaactgctgagttaaattggaataacacaggccaagagaatcacatttaaagtcagagatggcaaaaataacagacatttctatgacagaacatcaacaaataattactgattgtctactggatacaaagtactgtggtatagggcaccagaaggtgtggttaacatgacatcaattgtcattctgctgggtgacaatgaaatatgtataggaatgtatactaatattcagataaatgcagatactgcgagcagctatgctaagtgctttacaggcacatatcacttaatcattaacatgaataccataggtatccctattttatagaagaggaagctgaagcacagggcagtaaagggacaaggtcactcagtcgggaattagtggggcaacagtttaaattcaggtttctctcatgccaaagggtcttaaccactgtgtgataaatcaaatagttttcagttgtctgaaattttcagttttcatttactttggttgtgtaggcacaaacacaagaagatctacagataatgtatattttttaacttcctttaaattaatgcatgttggattgctctctaccatttgccccatctaagtctttgtagttggaatccatcgttctctgcaaatttgacatttgatcataaattgctcatctcgagatgaattacaacacctcacattaaagaggcacttagggagacatttctattccatttcaagagacttatataagaaccctttttgatctttcctaaaattaaaatgaaaagccacattttggcaacattatggaataatacaaatgttcaattctgtggaaaaaggtagagacatgactgatcatttgatatttaaggcaaagaaatagtggttttatttgatttttcattttgaactctgtcagactgtgatccttttttctatcttcatagtttttaaaaaataatcatcagaaacaagaaacaaagagaaagcagtaaaacacattttctttgcctccaggattgaagacattttccccttggcatgtacctactaagtaggaaaacctagaatgaaagttactgtgttgcttcagtaacttctaagaaatcaatataattttggttttctgctataactctcaaagcatatttgatgtatctcttagtcattgacaactttctttatactctgaagcaaagttatcccagccaagtgtatgtggctgcggatgataaagtatggctatttgaagtttgcttcttcttaaagagaaatgcaaagttcccagaaagacgctagatacaacggttcacatacacttcacaaggcacttgcctaacttcttggaccaaattacattaaatctttgagccaagaaaattaactcaccactcattgaaaaacagtatttcagccatgtcatatctttggttaaggcagacttaacgggaaaatctctttccaatatgatatgtgattcctttacaagtacacagtttgttaagttttatacttttttaagaagtagaggttttttgtttttgtttttttaaccaatggtactctctctgtgtgtgtgtgtgtgtgtgtgtgtgtatcctaccaaattccttagttaataagcaagacaaatttattcacagaactcattttgtattatgtaaattttccaagaaaaaaaagaaaatcttaatttgtgtttcaaagcctctctagtttaagcacaatgactttgaagaaacaaccaaaaaaaagataaaatgtggatgcagaatgatgtttattttacatgtatatggtacacattgggtaccaaaagaaagtcatggttaattacaataatcactctagtttggccaaataacatggaactaacgacatgaatttcaactatggatagtaatattaagtgggttgaagtaatctctacacaattaattttttctagtgccttggcctctgaaaacttatctttggtctatatggatctatgtgcatctaattaaaggttcatatttgcaatgcagggttttagttaagggaggttaaacatgagatttccttagagcgcctcagtgttcatgggcctctatattctcatatctctgcaccagcagtaggaggatgtgagagcccagggagccctcgaacttcaaaattagatctgtgggagaaaacatgtaaatctcagccagaagaatctatgcctcctttttctcccatgctgccttactcatagcactgatagcatgcatgatctgttagccttcactatccttgcagaggaactggattcggtggtatggaaaagacatatactattccatgaatatccatgtgctctgctccatttcctgttcccttgcagataagtgagcatactctgaccagttctggccaagggactctgaatgaaaatgctaccttaaaggccaaagtatttaagagccagcacatgactctccagctctctcttattctgtctcagtgatacagaggctgcaggcccaggtgtcagaattatacaatacagaaaatagatctcttataagggagtttgtaagaaaattggccctagagagccaccagtcccttaaaagagtttatatgacagcctgggcaacatagggagaccccatatctacaaaaataaaaaaaaaattagctcgtgcctatagtcccagttacttgggaggctgaggttggagggtggcttgagctcaggaggttgaggctgtagtgagccatgatcacaccactgcactccagcctgggtgacagagaccctgtctcaaaaacaaagcaaaacaaaacaacccccccctcaaaagtttacattagtggcaaataaactttgttatgctgggaagatattaccaagaatagcttagtttactgtgacaatttaaatcaactgctaagataaccaaagtaatcagaagctataacaggacataaatgctgagtacaaatatttatttttgtacctcctctattggagaaaatctagaaaataaattcaatatatattccaaaggaaaaaggaggaaagtctaggaagtttttcatttgggataaaagccaggaataaatatatgactttcattggaacattttcaggcactcagagattcagagatatccttaatgctaagtagatgtataattagctccctgtttagggactccaaaatgtgccatgtcaaaactgtctcctgaaaatgttgctttgcgattccaaaagcaatcagaggttgttgaaaaatctttgggattttgcagtgtgcagttttccccaacaggcctaacattaatcattataggaaaaacattcaaactcccccattctttcatagtctagtctaaacattcaatgcaatatcataattctgcagacataaattccctcattatctgtgggccaggtcaaccacagcacagccagccacctagcagacccatgagcagggccttttgcaaaggtgtagcactggccctcaaaaagacttacagttaagcactccaggaggctgcaattgtgcacagcagccaacctgtctaattgggtcattttttcactgggtgatttatatagaatgtggactcaaggctgactgctcttcgaacagtatgactgcttttgtctgactgtaccaatgaagcaggatggggttgctggtatttaagaccaggcattctggtcccaaagaaacattgctttgggctgtagttctgtgttattgcaagaagcatagtatccgatgttaccagtgtgggctcagttacttcatctgtaaaatgggaggctataaccccacctacctcttagggttctcgtgaagatgtgcttgagaagagctgaaacagtgtgcctgacacagagaaagcattcaatgaatgtgaaccatttatgctatacagcattattactgatatgaagtattagtgatacattattgatataattatcatcaacattatctgtgatgctggtgatatgatgatgatgatgatgatgatgacagtaataatcattttctgagtgcttgccatgtgcttgccagtctactaagtgcctaatgtggattacttagtgaatcctcagggcaactattgagactattatctccttttgatgaatgaagacactgagtcttagaaaggttaagaagcttgatcaaagaagtaataaagctgaaatagaagccaagcagtttgacttccgagcctgtgcccttagttactaccctctaccccagcattgacacaaacacaaccacagcttttattagttgtccttataatgacttagcctcatgcgataagactgtctgtcccagatagagccacaagttacttaacatatctcagtgtcagcagccacaacctgctaggtaactacaactccaaagtgccctgcctcctgaatgagatggaaaatcagtggaatagggaatgggggttctgcttggaaataacctgtaaccagaccagttaaggtggaaaggggtggctgtgaaaaatgaaaacaataaaacaaaacaaaatgccaaaaagcagggtgatatagagagggtttaaagggtattgctcccctttcactcctagcctgggattcaatttgtggccaaaagctgatggtaagtgtgtgtgtattgcagccatagtcagcagagcaaatggggactctcaactactggtcctacttcccctaaggagctgggtagttaacatgttatccctgcacctgagtaaattaacccattactccttacccagtgatccacttgcccccccatgatgtgcactgtagggagttcatgctgtttagctcagaaattctaagttcacatggagtccagttttcctggattgtaccttaagtggttgattgttggagccacttcatatctatatttaagttagactattgagtactgtccctcagtttcaggagccatgggagcaaatcgaggggcaaaagttacttctggatcttcccaatcatttctcaaccattgagtcacagcctgtgacaccagacgtctttaacttaactccaacctcattgtgctaggttctgttttctcctcaattatttttttttcttgctctaagaaaaggataatacacccctaccttatctgtaacatccagccacattgtctggcttggttatgtgactttctttgcccaaaggactataagcagataagaaatatccatgtctacatagaatctttaaatgaggttgcaaggcttaactttctgcatttttgtcctctgcattgtgaatagcatggccccgatgagggcttctctgcttcagcctaggtcttggaataagagatgcacagaatagagccaagaagaagtgctgccaaccacagactcataaatgagaaataaatatttgtttatttgggggttgtttgttactgcagccgaggctaatacacaaatttttcaataagaactcagcctcagcttacatcatgtgcgcaagtgaatctggggatgctaggggctatcttccctatcattgagtgaaagactatttatgtattaagccaacaggcaaggacagaatcaagaaatgttgtaaaagtaagagctccgagtcctttgagcccctgaatccagctgtgcctgaagacttaatgctacatgttatgattatgtgagccaagacatttcttttactttagctagtttggattaggtttctaatctggtttaaatgaatactgacttatatcaggtctcctcactcttttgcaatgatatctgagcacaagcatatatgacatattaagtaatagtaatcacatgggggtaagttacactggggtataaatcattgtaattgaataagcctgtcatgggttgaactgggttccttctccacccccagcttcaaatggatatgttgaagtcctaatcactactacctcaatatgtgacattatttggaaatggcattgaggatgcaattagttcagatgaggccatactgaaatagggtgggctcctaaacttatataattgatgtgcttataagaagacagccacatgaagtttgagatacacataatgtcttgtgaccatgaagacagagattggagtgatgcagctacaagccaaggaacatcaaagatcgctggcaaactaccagaagctataaaccaaaggcaaggaaggattcctctacaggctacagagagagcatgaccctaccaacaccacaacttcagacttctagtctccagaactatgaaacaataaatttctaattttttaagacacctagtttgtaatattttgttatggtggccctaggaaactaatacaaagcccatcaggtgaatttttaccaacagatcccatggaaaacttctgatggaaatcactattatactcatgaaggtcattgacagggtttggctctgtgtccccacccaatctcatctcgaattgtaatctccacatgttgagggagagacctggtgggaggtgattggatcagggggacagtttcctccatgctgttcttgtgatagtgagttctcaagagatctgatggcttaagtgtatggcacttcccactttgtgctctctctcctgccaccttgtgaagaaggtgcctgcatctcctttgccttccaccatgactataagtttcctgaggcctccccagccatgaggaatggtgagtccactaaacctctttacttataaactattccagtctcacataattctttatagcagtgtgaaaatgaactaatacagctatattgccatatctatgtccacacaatatccagagacacagaaaggaaaaaggaggcagcacaatgcaatggtcatgcacattggctgaaagatcaggaagacctgaattcaagtcctagtttgttcatttactttaggtgatttctgactccagtgttctcctgtacatcacagaaaaatccattgtttcattcatgatgttttatgagagttaaacgaggtagtggatgggaggtgctttacactgtgcctggcagagtatatttgttaaacaatagatagatagattagctaaatagacagacagacagataggtaacttagacatatagatagatgatagagagagagagacagagagacagacagacactttgggcgactatcaaaatattataaactggttggcttataaaaaacaaacatttacttctcacacttctggaggctagaaatccaagatcagagtgctagtatggtcagttcctggtgagaaccctcttccaggttgtagattgtcaactttttactgtatcctcacgtggtggaaaaagaggaagttagctctctgacatcttcttataagggcactaatcccattcctgaggggccctatcctcatggcttaatcacttatcaaaggtcccaccttcaaacaccatcacaatggagattatatttcaacatatgaattttgaaggacacaaacattcagtctataacagatagacagatatacacacataaaaatatatcaatgcataagtctatagatatgaaggtctgtatctttcctgcctatataaaatttaatcaaatcattagcagttaaatagtgaattttcaacacattcccaaatagttttaacttacttaatatgttgtgttggtggtaattttcttgttgttgttttttaaactgaacttgattgacctgattttatgtagatatgcaaagataccacttactcatgcagaccttgttgtgtaaataacccaatcttctgtctttgcaaagacaatctttccctaagagttataatctcctctcaacacatcgattatatggatcaaaggccctctgacttatatcagcctgggccaaaatagtcattaccaaagattttccactttccctctttaatagactaagctttagaatttgggtaatggtttggatgtcaaacaaaacctgagaacttgtttaggttcagaagaaagtgagagtgataatattcctttcttcatcaatggagctttctaccctttcccgcctattatgtctaatgttattgtgcaccaaaaatgaagctctcctaatcttcatttaccttcataataaagagagtctttgtgcgaaccatttctactatactgcaaagacacaaagaagaaggcctttatgctgaagctacaatttgttgacatttttatggatatgaacctgaattgtcatgagtgagcttgttctaggagtagatgtgtccgagttttcacacatgaaagactgggtcctgacctaccaagaggcagtaaatggaatactctgaggattaaagacattactctcaatatgtcttccccataagcctaagattccaatttagtgctacgagaatcacccctctgtattacaatatgcattgagaagactctctttgaggtgtgttagaaagaaataccaacacacttgaagaccactagctcattaagttgattagttccttgccagcctataatgaaattctaagatctggagggaattgaatactggatgattaagttttggccaagcggtacattactaaagaaatagggaggagaaaagggggagccctagtcgcttaagagtaaatcaaggggacacaaataatctaggaggggatggttcccaaatggccccaggaagtcctgttgggatgggcacccagatttttaaccattttccctcactccccatagtaccttaaatcaagaatatccatgaatgttactaaatgcagcatgcccaagatggagtcctccccatgagtttacaaagaagactcaagtcaagaagacttgatggactaggaggtactacttaaatgggaaggaaaaagtttcttgctagatgctgcaggagactagaagatgagtagatattctgtgatcctctcaaaatttcacaggttgagctcctttgcacgattccatactgttaggctgggcattcttatcctttgtgactgctgcacaaggaagaaaatgagccacactatcccttcaaacgctgagagctggtttgacacatttgtgctggtttggataactaagtaggagacccaggacataagtggcagctggctggcaaggatgtcagatgcagaagtacccagaaaacctactcagggtgttttcttcctttcctggtcccctcctgttacaggaaggctgacctctgcacatgccatatgagcttggccctgcggtttgccttctgccaaagaagtccctgatataaaatggaacttcagaaccttgcctttttaggagtgtcattagaaatcaaatcagtatgggctgaacaggctcaaggactgctgctttagtgtggcagctgaagtccaaatttttgagagtaattgggcccaggctgttaacaggtgcagccacttcctactagggagaaagaatgcctgccatgtgtgttacacatggcctcagaaggaagccacctgtcaagagaaatgcagacactgggctggaggggcccgaacagtgatgcaagtctgagtgatgactaaatgaggcccctgcaaaggcagaatggcccaggattgtaattaagacactttcttaccttcgcatggtaagatttgacttgttatagtgctatttctagtcctaaactcactatacgtctatgctatcatttctaaattatattccattcaacactagtatttggagaaacacagttaattttctgtgagaaaaaaaagagttcagttttttggatttgcttaggagacacttctttgtacaggctccatctggcaattctcagaacacattattctattatctaaaaatggctgagtagtcctggagtatagaagcctgattaattttaagtcacctttccctgaaccaatacagtcatcccttggtatctatgggaaattggttccaggacctccctcagatgccaaaatgcacggatgttcaggtcgctgatataaaatgtcatagtatttgcatataacctatgcacatcttcacatatcgttcaaatcatttctagattatgtataatacctaatacaatataaatgctacgtaaatagttatactttattgtttagggaataatgacaaggaaagaaaagcctgcacttgttcagtacaaacacaattccccccaccccccaaatatttccaatcctccattgattgaacccatggatatggagggccaactgtaaacattttcattagatcttttataaaaatgtcccatggaatcctatttgagaaattcaggattacacaagtaaacaaaagttgagagaactggttttctctatcaaattgggcaaaggtcttctctgcccttgtcattatgtggatacgtttttctatgaggagcactatagcacagtggtgaagggaatgggtttggacttggactgcttgggttggaatactgcctccagcatccattacctataggactctgggcaagttacaaaacctctctgcactgttttctgcaatgtaaaatggtggtggtgtgggggggtggtgtgggaataatagtaatatctgccccagaaggttgtggacagatgaagtcagacagcctttgtaaagagcctagaacagtgcctagtaccctgtaagcctggggcaaatgttagctgcagtcattgccaccatcaccatcatcttgccatcatctcccatcctctctctcagaatcagattccagaagtcattttgtctccattttcctcactgctctccacagtcattcactctcgctgtcccactcctgcttttgaaaagcctccacccctctagccttcataactagcacaggccttcctcgctccaggctgaaatattacagctttcccctagctaggttccctgaccccagtcccactctctacccaaacaacctgccctcaatgcccagacaaacctgcctgaaaccctgctgtgttcttggccccattctgctacaatgtttctgccttcattgtctagatggcagagttcaaggttaccttgggttgcaaccctctcacaaactaattcaaacctgttttccaaaccacatttattccctcacccccagctactgttcctgctgttcttcccacttggaatgtcgttcctagcctctgcatagactcaaattccaagtagattccagaacccatctcagcttgtgtcttcttcccaaggccttcctgatccctccatctcttactctggcatgggacactagcatctgctctactgtggagtggcaggtttagagggcttaggtttagagacctgggctcatatgccagctccaaaatgagcaagcggtgagagttttgatccagttgtgtaacccctctgtgtctcaggttccttatctgagactggagattgataatgctctctctccaaagggatagcatgaaactcaagcaaaagtacttgtacacattcagatttttttccagtcttcctgtgtgttttttgaggagccctagatttggcaaaggtgcctttgaaggcggaagtaggaaactgaagcgggctaggttgtcagacctccagcccctgcctctacacttcaaccagagctgcgctaccttgatcaattatatttatatatttgggatctgggtgacctttacttaggaaaaaaaagagatctattccacaaaagaaagaataagaaaaccatctcatctcccagctgggcgcggtagctcatgtccccaatcccagcattttgggaggccgaggcaggtggatcacttgaggtcaggaatttgagaccagcctggccaacatggtgaaaccccatctctactaaaaatgcaaaaaaatagcagggcgtggtggtacatgcctgtaatcccacctactcaggaggctgagacaggaaaatcgcttgaacccgggatgcagaggttgcagtgagctgagatcatgccattgcactccaacatgggcaacagagcgagacttcattttcaaaaaaaaaaaaacaaaaagaaaagaaaaaagaaaaccacctcttatcattagtaccatacaggctttccataattatttcactatttcacaacagtacagctggtctccccagatacattgtaacctccttgggagaaaggactgagtcatctttaagtatgtattttccctagttaaatatgttgtacccggtaagtacttaaatacttgttgatgaagcagctctgccttactgcccaccggttcctccagagatcacacttttataaggttaagcccatcaagaagttccttttccacttccctgagcaggcagccatggcttctttatctcctttcactctcttctgggaagatctacttcaatcccagtgccattatctctctctaccaaacactgctcagagaatagcctctgagacctgtttccttaccaggattcagaggatcacagatactagagatgaaggagaaaaaaaataaatctatcagggcatcatgtcctctccttgtgcaaaacggttaagtcctgaacattttctaaatatttgtcaggcctggtattaaaggcttgaagtgacaaggtccctcaagggagaagttggcattaaacctcactcttaaagatgacttcttttactgacttttcagtttcatgtttcaccactgaatctcacttctcacttttagttaaatcccttctaagtagccaggctacagtgagtgggggctacagaaaagccacaggaggagtcagaagagggtagagctgtcactctgtgggctatgtttccctctgactacaggtaatcaaaaaggatgggcaaggtgaaatcttgacatctcacttgaacagaagtactcccccattcttgcagattccccatcattcccattcagagagccaaaatgcaactgtgtaattataagataatgtcttatttttgtggccccactgaggttaccaactcagacacctataggggccctttgataaggatggcaaacccacttccttcagcatattgccagctcacaggaaggtgcatcatgtcaccagattatccccctttaaaaaaaaaaaaaaaagaaagaaaccatctatcaaaatttcaatgaggaatctcttcatttttgaatgttggcaatgaattcaaattatctttaacccattgtaaaggcacagctgacaccagtcccttctgtaggagatttcttctccttctgaaatccatcgccaattcataagcaagcacgcaggaatggacaatgctgtatgtttattacatttataattttgtgtgtagaagccttgcctcaatcctcaaaatgcagacacctatgctgcagtcttttgcgtggttacatcactcaacgtccccagtacatatgttcagaaaaatggtcaggtcctcagggaatagttaaaactgtgcaggactagactacttaggtttatatccctgcctcagtgcttgacagctctgggaccttgggcacctcagttttctcatctatataatggtgatgataataacagccctgggctcatagggttgttgtgaggtttaaatgacatagcagggtgtacatcatttagcaaatacactaggagcttaataaatgtcatttggaagctgcttcacatttccacattctattaaaacacccaggaaccaatggtgccctcacttcatctctagattttgctaaagagttggtttaattttcgccatgtcttcgggtttcatttttacctctgaaggtcaagttggcttgctacattcttggcagagtccatagcccctttgatggtagaaaatgatataaatgaaaaggtcagatgatcttgcctgggttacctgtcattctggaagatcacagctgtatgctaaactagatctaggtatgtgtgtggggtggggctgaagtctacacccatattgtggtaggcacagatatgtaccacccaggttgcccttcaaggagggacttggcctcccaactgtaaggtggatagtgattagcaagcactgttcagccattagctacttgagaatgggcctcagctccagtgagctgcttccctaaagaccatacatttcttgggcagctttcatttcctacagagtgaggcaggtgtgacaagatgctgctgtttccattcatcacggaacaatccagataggcaataatgaacccagggctccccactggcttgggtgaagctttggagggcctacctcaaagtccagcttctaccttgcccactcctgtttctgccccttcctttcacaggtgttgatgcctaataaacatcttgtactccagagtccatctcagcactgcagcccaagaacccaacccatgacacacgggtgtactgatgcacacacacactcctgaaacccagacaatcctttaaaactatctttttaataaacagaaaccagccaagtttgattataaagaaaaccaatcgtgcattgagacctatgggattagcagggtcaggggtatctatagagttgggaaggattaccactgatattttcttccaatttcttttattgtggtagaatacacataatctaaaatttactatcttggctatttttaggtgtacagtccagtgacaataagtacatttacattgtgggctacaattgccaccaaccatgtgcagaactctttttcgtcttgtaaaactgaaattctatacccattaaataacaactccccattctccctccccccagcttctggcaactaccattctactttctgtccatgagggttgacaaatctagataactcatgtaagtggaatcatacagtatttgtcttttagtgactggcttattgcacttagcacaatgtcctccagattcatccatatcatagcacttatcaggatttcccctttttcaaggttgaataatattttattgcatgtatataacacatttgatttattcaatcatgtttcaatggatactgagttgcttctacttcttggctattatgaataatggtgctatgaatgtgggtgaacatgggcgtacaaacatctgttccagttcctgctttcaattatttcaggtgtatgcccagaagtgggattgctggatcatatggtaatcctgtttttaattttgtgagaaactgccacactgttttccacagcagctgtaccattttacactcccaccaacagtgcacatgagttccaatttctccatatctttgccaacacttcactcttttttgatagcagccaacttaatgggtatgcagtgatatctcattgtaatttcatttgcatttctctagtgattagtgatgctgagcatcttttcaactgtttattggacacttgtacatcttctctggagaagtgtctattctagtcctttgcgcatttttgaatcagtgatttttgttgttgttgctgagttttaggaattatctatatattatgaatattaatctattatcagatatatgatttgcaaatattttttctcactctgtgggttgcctttttactatactgatggtgtcttttgatgtacaaaaatgtttttcatttaagtccaattcatctatttttccttttgatgcccgtgtctctggtgtcatatccgataaataattgccaaataaaatatcatgaggcttttgctctaaattttattctaagagttttatagttttagttcttaaagttaggtcggagactcattttaaatttttatatggtgtaaggtaaggaatgtacctaacattaattgtattcttttgcacttggatacagagttttcctagcggcatttattggaaagactgtcttttcctccatttaatcatcttggcactcttgtcaaaaatcatttgaccacatatgtgaaggtttacttttggactcctctatcctctattctattccattgatgtataaatctatctttatgccaataccacattgctttgactcctacagtttacagtaagttttgtaatcataaagtatgagtcctccaggtttgttcttttccaggatttctttggccatctagggtcctttcaattacatatgaatttcaggatggctttttgtatgtcagcaaaaaaagcatcgttggaattgtcacagggattgtgttaagtctatagatcgctttgtatagtattgaaaacaatattaaatcttctaatccataaacataagatgtgttttcattgattgataccttctttcagaaatgttttacagttttcactgtacaagtttttcacttctttggttaagctaattcctaagtattttattctttttaattctcaattttcttttcagattgttgttagtggataaaaatgcaatgtatttttgtttgttgactttgtgtcttattgctttgttgaattcatttattactccttacagatttttttttttggtggaatctttagggttttctacatgtaagttcatatcatctgtaatacagtttgtatgttgtccccttcaaatctgatgttgaaatgcaatccccaatgttggagatgagtcctagtgggaggtgactgggtcatggaagcagaactctaatggcttggtgctgtcctcatgataatgagtgtgttctcatgagatctgtttgtttaaaagtgtgtggaacctcccacaccctccttctcttttgcttccgctctggccatgtgacatgcctgctcatgcttcactgtctgccatgagtaaaagctctctgacacctccccagaagccaaacagatattggcaccatgcttgtgtgactttcagaactgtgaaccaattaaacctcatttctttataaattactctgtctcaggtattcttttatagcaatggaagaatagcctaatacaatctgcaaacagatataatttaatttcttcattttcaatttggatgcctttatttttctggttgaatttttctggctaggactttaagtactatgttgaatacaagtggtgaaaatgggcatactttccttgttcttgatcatagaggcaaatctttcagtctttcgtcactgaacatgatgttcaatgtgggttttttatatgtggctcttatcatgttggggtagtttcttacttttcctagtttgttgagtgtgtgtgtctgtgtgtgtctgtgtgtgtgtgtttaaaccacaaagggcttgaaatgtggcagatgctctttctgcatcaactgagatgataatgtgtttcttcctcttcttgctctgctgtgatgtattgtattggttgatttttgtgtatagaaccatccatacactccaagaataaatctcgcttggtcatgatgtataattcttttaatataccggtgagtttggtttgctagtatttcgttgaagatttttgtagcaatgtttataagggatattggtctgtagtttttttgcaatgtctttgtatcaaggtaatgctggcttcatagaatgaggaagtgttcccttttatttaatttttttgaaaagtttgaaaaagatcggtttagttgtttaaatttttggtactattcaccagcaaagtcataaggtctggggcttccctttgctaggagattactgatcactgatttaatctccttactagttttaggtctattcagtgttcatgacttagtctcataggttttgtgtttctaggaatttgtccatttcacctgaactatccaatgtgctggcatgcaattgtttatattacttgcttataatccattttatttctgtagacttgatagcaatgtcctcactttcatttctgattttattaattttagacttctggttttttttcttagtctagctaaaattttgtcaattttgttgataatttcaaaaatcactttttcccctgattttctagtttttccttgatttctattatttttctgttctccatctcatttatctttgctctaatctttattctttccttctgttagctttggggttagtgcgttatttttctagtttctaagttgtaagcttagacatttgtcttatttttaaatataagtatttgtagctataaaatttccccttagtactgttttcattacttccatatgtttggatatgttgtgtttttgttttcatttgtcttttaagtattatctaattccccttgtgttttcttatttaatccagttgttgcttaagattgtgttattcaattttcacaaatttttgaatttttcagttttccttctgttactgatttctaatgccatcctattgtgatcagagaagacactctgtacaatgtctgtcttttaaaatttactgagacttcatttgtggccttgcatatggtctatcctggaaaatgtctcacgtgtacttgagaagaatgtgtatgctgttgttaggtagagtgtttggcatgtatctgttagatccagctggtttactgttttgttcaagtcctctgttttcttacttaacttctgtcttttgtctctttgctagcattttttatttaaagtctattttttctgatattagtatagccaactctgctctgttttggtttactatttacatggaatatccttttctgtccttttacttttaacctatttgcatcactggttctaaagtaagtctgtgaagacagtatatagttggattatgattttttaaaaccattttgtcaacctctgtctattgactaggctgtttaatccatttacatttaaagtaattactgttaaggagaggtttgattctgtcattttgtgacttgttttctatatgccttataggtttattttgtccctcatttcctgtattcctgtcttcttttgtgtttggttgatttcttgttttgataatgaaatgattaaattccttttcgattttttctgtatattctttagctgttgtctttgtggttaccatggaaattatatttaacatcctgaagttattacactgtaatttgaatttatgccagcttaacttctataacatataaaaactgtgctactttaacaacattataccctcccctttctgttgttgatgtcataaaattacatctatatatcttgacttcctcaaaacatcaactaataatttttatccattagtctcttaaattatatagaaaacaaaacatggagttataaaccaaagttataataatattgatttttagaccaatatattttaaaaatccgttattctcttaattcatatagaaacaaaaagtggaattacataccatgttaaaataacactagcttttctacttacaaatatatttaccaatacaaagacctttatttctttatatagcttcaagttactgtctagcatcacctcattttaaccttctggactccctttagcatttcttgaagggcagatctagttctaataaattttctcaggttttatctgggaatgccttaatttcttcttcactcctttacttcttttgcagtacagttttgttggatacgtgattattggctgacagttttttttcttttaccactttgaatatctgagccttctggcctgtaaagcttctaatgaaaaaatctgctgataatcttagtgaggatccctagtgcatgacaaatctcttctcttctgctgctttcaaaattctctctttgtctctgactttcaatagtagtatttataatgtgttttggtgtgagtctttcaggctcaccctatttgtattttggtgagctttttgatgttcatattcatgtcattcaacaaatttgggaagtttttattcattatttcttcaaataatctctctgcccctttctgtctccctcttttccttctggggctctcacaatgcatacgttggttcacttgatggtgtaccacaggtcccttaggctctgttcatctttcttcaactttttttttctctctgttcctcagacttaattttcattgacctatctttaaattcattaattctttcttctgcctgtcaaaatctgcctttgagttctagtgaatttctcatgtcagtcattatatttttcagctttacaatttatttttggtttctttgcatcactctctctttattgatgttgcccttttgatcagacattattttcttgactttccccaattattcctttagtttttttgatcatctctatgataggtagtttaagtatctggctaatggatccatcattaggtcttttcagctcagtgtccattggtttatttatttattttccctttaatgcttaatacgttcctgttgctctatatgccttgtaattttatttttgttgaaaactggacatatgaatcgaataatatgataattcttgaaatcagattctccccctttgctagggttgctggtatttgttttcatgtttttgattgttgtaggccaactctatagcaaggatcactctgaggtataaacttaaagtcttttctgagccagtgccttgcctggaacatgcacagtagctatctaaagtctcccacatatgtagttgcttttgaatgtcctagttttcaatatctgggtcccaaaaagggaaagaagaaaaattaagggaagcgaaaaaaggcatcagccctttaaattccctaggagtcacttcagctagagaggaaggtacaacaataatggctaccacctcttttttgtacctctgtgattgaaaacggcaatcagtaatcagaatacagatcccaatatttgcaggatagagtcctttttgcccaccgtggctcccacaagccatgtgcaaaccaggagtacatgcacagctgcctgccatggggctgaaagatggggaatgggtagttattactgtgctaagaactgaaattgattgaaattaatcacaatttgtgcccctttccctggaatattcaggccttcagtggactccagagttccaaaatagctacaacagacagattctgccaatgcaattgttatctatgtggaaatacagatttctcaagcttcatactctataatcttcccatcaattatattttaatatacctatgtttatagggaaagaatgccaaaaagatttaaaaaaatcacagacctttaatagctctttggggatttttgagcaatttcagtaatcttctaaaataatatttagaatatcttctaaaataatagagatcttagaaattataaagacaaaaaagattatttgtgttgacattcaatactttttcttctgaaattcccaaagtacttacatttaggatatattagataaattaggtaacgcaatgggaaggtaagctattctaagttttccagccttgttattatccagtaataatgccattcaacttgctggcacttagattgtctgaggaacctttccaaatatggtgtcatataaatgccattgtaaagctctaccagaatagcattatcagattcttccttcaatgcccagtaacaataaaacacttggggaaaaagatctcatttcagagtccctgtctctcatccttcactcttgagtattcagctgcatctgtcattctttgtttttatatttctgtttattcaaatatcacatgatcctaaaacagaataaatcctgtcatcatgcaaattccatttaggacagtactctcatatatgaggtcaggttcatatccctttataggcaatcaagctaatgtatatagttgtttgttaagaaataagattctcggccaggctcagtggctcatgcctgtaatctcagcactttgggaggccaaggcaggcagatcacttgaggccaggagtttgagaccagcctggccaacatggtgaaagcccatggctccattaaaaatacaaaaattagacaggtgttgtggtgcacgtctgtaatcccagctactcaggaggctgaggcatgagaatcacttgagcctggcaggtggaggttgcagtgagctgagatcatgctactgcgctccagcctgggtgacagaatgagactctgtcacagaaaaaaaaaagatgagattctcccattattaaatgcatatgaaaaagatcaaataatgcatgcgatatgagttgtgtccaaaccacaatctcatggaggcaaaattatcaagacttcaatccgattggtggcttgcaaactaccctaggcctccaacccacaaatatatacagcctccaacccacaaatataaacagacacagatgaaatctggatgctaggaattcgtttcctaaactttccaacagcacgtacctgagggactgtatggaagagatgaaacaagagacatgtttaggaggaaggagctagttgtttaccaattaatgacgaactatctaaaacttctttgctctctaaaagtaagacttgtaatgttttcagaaataaatatgggttattcttaatcaggtatattataagagtagcttatagaaggagatatgcattgtttctgcagtgaaggaaaaagcataatttaatttttgacaaaatcagaaatattataaggtatatgttcagctgcagaagctataatacctttgactttagttctttaaaataaattatagatacacaactatatgcactaacagcctaaaagtaagtcatgctgggtttttttccatacaattttaattaggtatattttttccaatgtgttttgaaatgatctgctaggaccaaatgctaacatgaaattccctgcatgctggtagttaatttaataaaaattagaaaggtgaagccctgttccctagagggagaaggtcttaacacaaaacattcattatttccacataaattgcaaaaagtaaagatgctggatttaaaatctaagcaggaagaaactgtcaactttcattatcagtggacaaatgttttaatttgcaatattccctagcaactttttgaacagacaactttacctctttaccaacatctactttaattcctaatttgcagctgcataagtactatgttgggcccaaagctttgggtatatctcttagaggtaatggaatccttgttgttttctggcactgcctcattaaaatgaaactcagactcagggtaaccctgaaaaacctaagccctccaataaaaaatgtggtatatccctgcacttaaattacgcaggagaagtgaaggctggtacatcacacacagaagagaagctaaaggtcaagctattagagttaatgagccgatacaagctcaggctctctaaccagagaggttagggacagaatacatggccaccccaaggaactttatttaagatatcaattaaaaatgagtcacctctcttctcagctcctgcactcaacactgacactgggaacaatgactgaaggactcacacatgtctgagaaaaggcaccttgtgggtgtgacttgccacaaaagcaagagtctttctgcatttgtaaatgtgttggtaaggcaacaaaaagaatactactgtgcaaggggaggtagaggtggtgatcctggcaacctaaaagcctgattgtatgttctaatccattctgatgtcaccaaagctccccttcgagggaataacctggattatggccaatactttctacttctaatagtcttccagtttcattgttcacaaggggttggtaaacaaaaatcaatgaaaagagcagggtcttctctattttggatttggacactgatgatgaagctgtgatattctgatccaggactcaatggctcctcctggatcttctaacaaggtcaatctggctgagttccagacagtcagctgatggtctcatatgaggaatctaaagttgatgaagatggtggtagtagagtggtgtaatcctcatagctcaaaaacgatcagagctcattaattattaactaactagaacttttatggctcattagctactggttaaatgtcaggtaaaatgtaatatttaatagaaaatgttaagattagaaatatgcagagcatttcttatgtgccagacctatgctaagtatttcatatccattattgtacttgatccttacaactcccatgcaagggacctatgtttatctcaatttaacagagaagaaggcaaagtgtgaaaaactaagtaacttgtcttaagttaaacagctaatggagtggtagacttgagcttcaaacccaggtttagccaactccaagcccattcaattatcacttgatacacacccaacctatgtaatacttagctttgttcttagtcattgttgcaaagctcatttcacccctcagtcaggcttattacattcattcgtgttctcaagagacaagagggtcttgcccaaaactacagaatatcactatcacaagttgccattcccactagaatttaccttgatccccagtgatgctacatgcattattatgttagtttcttcttggaggtgttatttttaaactgcaagattaaagctcctacaagcttctgacaacatgaaaatcagacacgactttgcagtctttttaaaacaaactagtaagaaggtcccaattaagagaaaaagagtagtcacacatacctgtagaactgattgtaatttaccctttcatcttgctctaaaacacattccttgagtctcagtttagtagagataagattcacccagtcgggggatattagttcttcctggatattttaattaaactgttacattgagtagttctgaaaatcacatataatcattcaaggtatggtggagttctgttctccagcatatggctctccacccagccacattccatctccttaggtaaactagctggaggccttcagtgtaagctctttaatttttaaactcttgggtggtgctttgttcttcgggtagagagtagagcaagagaacgaattaccaaacagtaatattacccccatcgacaagcgggtggtgtttatatcacacatactatataccaagaaatgcgccacaccttttacatgaatactcattttaaaacagtaaagactttatatttagagaagttttaggtttacagcaaaactgatagtaaggtacggagatagcccacatatcccctgccccacatatgttgcctcccatattaacttccccccaccagactggtacatttgttacaatttgtgaacctacaaggacatatcacccaaagtccatagtttacaagaggattcagtcttggtgttgtacattctatgggtttgggtaaatgtataatggcatgtatccaccattacagtatcatatagagtagtttcattgtcctaaaagatcctctgtgatccgcctattcatccctccctccctcctaatccttggcaaccactgatctttttattatctccataattttgccttttccagaattccatatagtcagaatcatggagcatgcagcctctttaggtaggcttctttcacttagtaatatacatttaagtttccgccatgtctcttcatggattgatagctaatttgtttttggcactgaatcagaaacccttgttgggatgtaccacagtgtatttatccattcacccactgaagaatttcttggtggcttccatgttttggcaattaaggataagactgctatgaacattcatgtgtagatttttgtgtggctatgttttcaactcctttgagtaaatatcaaggaatacaactgctggatcatgttgtaagagcatgtagttttgtaagaaatcgccaaactgtattccaaagaggctgtaatatgttgcattcccaacagaaatgaatgagagttcctgttgcttcacatcctctctagcatttggcattgtcagtgttctgatttgggctcttctaataagtgtgtggtggtatctcactgtttgaacactcatttttgaaatatccacataggctattatgatcttcattttacagttcaagaagctgaaactcaaagaatgtagatatttcaaactggccattgtaagctagagccaagattcaaactcaagtttggtgaatttcatagcctatactttctatcattgaggtacatcttgttttctcagttgtattatgtgatttgcaagtcctatgaataatatatttaaattataccaacatgaaaactaagtgtaatcttcagtcaataaaatatccactaaatacttcaaaatatgaaactggaagcttatctaaatgaactaattctttaatatcaccatgaaaggatgatgttttaaattaagaagtgaagaatttatagtttccagattgagaataatttccacaaatttttattttcatcatattctattgtgggtgtgcatgtgtgtgtgtgacagacacatatgcagacacagagatatggggacacacacatagacactttccatctcatgccatgttggaacttcccagagacagttaaaattagctagctaatttccataaactatcaaaataaaattatacttattgagagtctagagttcctgtcatgaagacttagcagttaaaaagcatggaagtcatggaatctcagtgctccttcgttgcaatccacactcctgctacaattagaatcccaccaatagataaagtcatcaggagctaattagtccacgtgtaaaaaataaaaataagacaaagaacagacttctaaaaaaaacaaaaacaaacaaaaaacaacaacaaatcatttgaaccattgggtacttcgagtacatgaaaattgtgaagtaaattaattagctttgcattgattggtatcaaaagtcgttagccctgcactgcaaggaaatccccagaagcctaaggtgcatgaaagaaaaaggctgggaaggaaatcaatctctgctcttcaacgctgatgctttaaagggtccctgctgtataactcgcccggaagcattccagggggaagaacccacagatttatatctgccacacgtgtcactgaacacaaatacgtctgataaataattgaagctcggtattgtgcttacgtcgcatgtgcaaaaaaacagggacaggaaggcaaagaggtcaagtttcccatctgactttccaatgagcatcccaatcatcacttaggtcattattctacctcgtgaagtgtcagaactcattgtcttagggaatccaggtgctggcatcacatatttagcaaatctcatttccctctctctcacaccgcagagcactctctagtccaagcacagtgcagggcagaatccagagcttattttatttaatcctcacaattttgtgatttttacagatgaaaaaactgaggtctggggaatagaattgtttttcacaggcacaaagctggtaattggtagatctgggatttgaaccgaggtccaggaaactctagagcccatattattgccatactaggctccctctctaaataactttctcattaagtgagcagagagagaggagccagactgccctgaggcctttggtattaataggaggctaagaagctcatgcagctaagtctctttatccaacggcacatccctggaaggagaaaatgggctctgttggaatccttccactgacaggaagctctctacctcacataactacagacctgattactaaaaagactttggtttgcctttccaaaactcatatccagtgatcacaattgtggcctctgaagcagtttgattcaatactaattgcactcagtacttggatctatcataactgtaacattaaacaatgttttcccctcgcagggttcttttgaggatacagtgagtattaaaatgggctggtacatagtaagaatttgcccaatgttaattataaaaattttcctgatattacttggtaagttattctgttaaatggaataaacacccatgaatgccacatataaaccaacagctttgaccctcataatgacccccatctatccatgttgtcctcccccatttatcttcttgtctccaaggtcattatgttcctgagtgccaggttcatctttcttcttacagggttttattgcatgtataattggtcctaacatgctttataatctaagctgttttaaattttataaaaaggattccatccttatttaatcttatgctatcctcacaaacttattttcccccacttgatattttactatgaagaaattaaaagttacctacaactgaataataatgaaatgctacatattaaaatctgtacttataatagaagatagcctcaatgttaataaggtgtcaatcttaagtatacaaaaactgaacaaaataagttcatatttagcaaaagaaaaaccacaataaatatgagcacaaattgatgaaatagaaaaatattttctagaaaagatcaaaaaagtcaaaagtagattctttgataaaataattaatagataaacctttttttgttttttttttttgagacggagtcttgccctgtcgctcagtctggagtgcagtggcactaacttggctcactgcaagctctgcctcccgggttcatgccattttcctgcctcagcctcccaagtagctgggactacaggcgcccgccaccacgcccggctaatttttttgtatttttagtagagacgtggtttcactgtgttagccaagatggtcttgatctcctgacttcgtgatccacccgcctcggcctcccaaagtgctgggattacaggtgtgagccaccacgcccagccaatagataaacctttgacaatatcgattaaaagaggaagatgttttgaatgaaaaagtgaatatttattacaactaaaataataaatggctattgtcaacaactatctgtcaaaatttttaaaaatttagatgaaatgtataaatgcctaaaaatttataactaaccataatggacccaagaaataacaaaaagtttatatagccctatggctattaaataaattaaggtaattgttaaaattttttttgcaaagaaaacatcacaccaggtgattttacacgcaaatttttcccaatgttcaaggaagacatcattccaattttatgcaaactcttccatatgatagaaaaaaagagattattccccatagattctgtaaatcagtataaccctgttactaggaccaggcataaaaatcacaagggaggaaaattacagccttctctcacaaaggaatatagatgcagaccattcttcttagtagtatactcaattgtaaggcataacaaattttatttccaatatacaagtagcagtgtaacattacagaaagatttcattagctttggaatgtaccatttttctagctgtataatgtagcaatgttatctaatttctctaagactcagtttccttctttgcaaaatggctttttataatatctatctaattctgtgggaattaaggaagtaaacaatataaagcccttagctcagagtctggaagtaacagtaagcaataataagttacagcttctatttatcaagtacttagctccccggctgagtattttttttttttttaactctcctttaatccccacaaccaccctgaatggtggagattatgctcaattagtgaataaagaaactgagtcaagtggaatttcaacaactcacccaaagtcacataagttgcaaaaagtcacgctaatgtaacaatcgcagtctctgaatactgatgcctggggtcctttcaaatgtggagctgatattaccagctgctatcggggacacagcacttcctctgaggggcactggagttccttccacaaggcatggaatgtgttcaccttttcaggggaagcagttttcaagttggggtttgatttgtgacatgtgagattaaattgcagcatttctaatggaaaggcttcagagggcaggaatgagcgatacactgtcatttctccatctctgcgtgaggaaccttaagcactaatgagatcagatatgtcaccgcaactctctccactctgccacagattccaggtcagaatatttttttttttaaacattctggccacttcactgcctacctgcaactctctaccacgttcctgacatataagatttatgataatttaccttaggcagggcttggagttttattccaccaggttatcaaaaatgttgccaataatctctttcatattttcataggacaagattatacaaataatattccaccctattctttccctagagaaacttacatatcgattagacagggaggcctaacaaagattcaagagtcagtttgtcctatgagcgtggaaaacaccactcctgttaaagattacagagtgacgtcacttatgactatgctgtgcaaagtgctgggtttttttttttttttttgtatcctaaggggctttatgcttgtctttgtactattggtgccttgggaaggaaaacaagaatgcatttctcaacatttatgtctgcagcgatactgggaactgtgaatgctaacatatttttaaagagctctgatagagagaaaccaggtggtgaaagaaggtagtgaacaagcctggatacagaaaggtttagagtagaacttacgggcgccacctgctggtcccctgacaccactgcccagagcttccagttcccctaattggagtctcagctttatggccagttggctcagctgaatattattaaatgatttctgtcttcaactatgcttagacacagccttggagacaagtaagtaatgcagagagagtaaaagggagtgagtagatgtcaaagaatggtttgcccattcaacatatgtgtgactgctgtgaaaggtgtatgggagtttcccacatcatctatcagcaaaaagacataaatggtgatcttccttccttttcccaccttctttttttttttttttttttttttttgagatggagtgctggagtgcagtggagcgatctcggctcactccaacctccacctcctgggttccagtgattctcttgcctcagcctcccaagtagctgggattacaggcgcccgccactacgcctggctaattttttgtatttttagtatagacggggtttcaccatgttggccacgatggtctcaaactcctgaccttgtgattcacctgcctcggcctcccaaagtgctgggattacaggtgtgagccatcgtgcccagccttttccctttctttcttggagagaaatgatagcatctgaggaggcaggagcgaggggtgtcttgtggaggtgggtagtgatggcagcctgctctgtaactgaacatgcagggcaacgtggggagaggggtgctgcatggatgggggcagtggtgtttctagtgtgtgaggaagcagagcagaggatgagatgtacgcaggtggtgggcagtgaaggctaatattgaacaaatgagtatatatattaaggataatgggaaccaagtttctgtcagagaaggtatttataaatgtggaagggggaaaagacttagatttgaattgaagatactgatatgaattcatgtggcttatgtgtaaacatatacacatacccagatatggaaataataataagtgtgtgtttgtgtggacttatatgtacatatttcctagctctgtgttgactgggtctcaaagcattgacatcacaggaacaataagcatgctaagcacccagatcttgatttctaaaatcattctacacggacaggaaccagagctgcttggagaagtggctgattccaaggctggacagggacagtataagatgatcctggagcatcttttttgtaccagaatataaagaaatgctcaaagaatgatggggagatctggcaagtaccaactggaccaggtgatcaagtggggatacggtcagtgtggttgccttctgatgtgatatgctgagaagagctcagcagcgtttttgtggaattcctgccaagatggcatggaagaatacatgacttgagtctaataatgaagaaacagtggaagctccagagaaagagtcatcctacaggaaaaaaagacctatactctttaaggcaggaaaacacgagacagggaaagaataaaaatccattccaggctgggtgctgtggctcacgcctgtaatcccagcactttgggaggctgaggcgggtggatcacctgaggttaggagttcaagcccagcctggccaacatggtgaaactccgtctctactaaaaatacaaaaaattagccaggcatggaggtgtgtgcctgtaatcccagctactccagaggctgaggcaggagaattgcttagaagctgggaggcggaggttgcagtgagctgaagatcgcgtcactgcactccagcctgggcgacagagggagactctgactctcaacaaacaaacaaacaaacaaaaccattccagattggaggaaactgatgaaaaataataattaaatgcagtgtatgtttctgtatagcatcctggaccaaaaaagaaaatgtcatcactgagacagttggcaaaatgtgaatggggcctgtggactgaatggtagtgctgtatcagtgttgattcctgattggaagtgtttttataatagtaatgagaagagtgctcttgttttgggaaggtaatcaaacacctgaagagtgatggagcatcatatctgaaagggaatatctatatattgatctctctgaatgaaagagaattaaaatgttgcaaggtggataatcagggtgaaaggataccgcagttcttgctacccttctgtcggtttgaaacagcttcagaattaaaaaaaatactaaaagtgctgagctctgagaagaagaaaatagcataagtttaatgggaaaattatgttatacatgattagaatccttctttgttttctgagaagaccctttgttgggaagaattgatgatcaggaatgcaaatgagaatggccaaaggacagctagctgacttacaaaaagaaaaagaagattcggtataaagaaggagagaagggtgaccaggtatgcaaggagaaaaactgattgctagatattgagagagagtacttgcaaacaagcaaacagttgccatagggaatggaacttgtagggaaaagaaggatgttggagaaaagttgaataaattttgaagtgttaggtgtaatataattcttctgttattccaaatcaccacccataacatccacacccttcatcaacacccttaagacacaggtatttatttgtttaccttgtttgtttgatttaatgaaaagtatgagactgactggagaacaggtgcttggtgagcacagggcagtcagtgtgtatcagtatgtttgtgtttattatgaaaagtgagataaaacatctacataaatagttctaatacagggtagaacagaataaaaaggagccaccagagagtgtcagataaggtgtgaggaaacttcagaaaatagaaggaaaaagaatatttacattccccaagctccttctctgaaccagaaggtgggaattatacattgaaatagcacggtatgaaaatccagtaatgatccatgatcccccagctagtaaatggcagagcccaggtccatagaacccgaaagatctctttttttcctactatagtgggctgccttgtgcctgggtctgaagagaagaggaagaaagaggggagtctgatggacaaagctctgtggaggacgtggcactgagcagaaacttgaaacagagcttgactggctggcaggatgagaagaatggactcttggctgaaggggaagcaagcacaagcacatagagatgaggaagcatgggtggtggtatatagggtaagtgcaatctatttcaaagacagctaaaacacaagatgacccattccatggcaaacatggacaccaacaccatgtacaaagatgatgagggtgaggaagattgagacgtcagttatactgattgggaggctgtggaataggcagcactggcaatacttctgtgccctaatgtcattctctgaagctcaaggccaaacccactggggccaaactcacacagaaacatttattttcagacatcatttaaggaaggcaacacctgaaagatggaagggctcagtgcaaacttccagggtgctatttttgaaaatgcagaaactcccagtttggaaatattttcttaaaaatttccccatcattattagcacttctgccaaataatcactaactaaaaatattccctccttgataatgcacagataaggtctctgcactgaggaggaacaataaaggaaggtgatgaattgcaaatcaatcataatttatgcagatactctactgaaaatcacattcatcaccttttccaaatagcgccacatgaatttcctgaagtacaagaagtctattttcataaattagaccttaatttctttctctcatcaatatatttttatgccaaaaagttaaatagtaaacaatacagctgaggaagaaattatgaactagaagaacatgaaacatggtattcagaaggaaaaaaaaatagtcaaatatattttctatggcctttgctttgtgttaaagtgtgtgttttttccccaaaggattatgtgatgtaattggtactagttggatgatgaatataaacaaaaaatgccaaattatcacaagatgcctttgggaaaaaaaaaaacctgtaactgatgctacagtgtaccctgccagtatttttgaaagcaaaactgtactagttcatttttacactgctatgaagaaatacccatagctgggtaatttataaagaaaaagaggtttaatggactcacagccccacatggtgggggagacctcacaatcatggtgaaaggcaaaggagaagcaaaggcacatcttacatggtggcaggcaagaggccatgcgcaggggagctgccctttataaaaccatcagatcttgtgagacttactcactatcacaagaacagcacgggaaaaacccgctcccatgattcccaccaggtccctcccacgacacatggggattatgggagctacaatttgagatgagatttgggtgggaacacagccaaaccatatcaacaatcataacagcaatcagccagctaagaccaatgaccatccagcaagactcacttgctatttctctgtgttatctatgtcaaatggcaccttttttcttagcatcccgtttgtagaagagcagacacagagaatgtttcacaggtccccattctggggattattggctgggtatttaaatatacttttcttaggctgggttcctctaaagcaaaccctgaagacaagactttgaaggcaagtagttgatttagaaggtaattgcagaaatcaccactagtggagtgaggaagtaagatcgggagggaagaaaatgtgtgttattaaacatgtgattgctgtgggcaagagggactccgtttcactgggaaacactatagatacgtttcccagttattcctccacaagagcaaaggagcctgggtacttactcaccaacttccatgagtcattctgataactgctaccaaggggtgacggggtaggatgtgggctgggagattaaattcctagcactttcaggctagtttgcactgcacaaacacgaagtagacaccagtgactagaaaaagacaacagccagaatgtaatagtatttaaagatggaagccaggggacaatgtgtagaggaatagtcctatccgaggaatagtcctatccaaggaatacgggcagtacactgcaacagggcccttttaaggtgagatatttagaaacctgggtcaatgcttgtctccatgccaatgcagttacccactccctctcagccccagccactctacgataaagtcttaatgaacatcagagggacgtttcagggcctgctttgtgacgcacatcaccccttagactactccagtgctcactgatgtcccaaataacaagtcctctaaattattggtggtttggtctaattatctgctgaaagcattcaaaaccattgggtatccctgaaggagaaagtcacaatgctgcataagaagaaacaacgcctgcaacggataacttatttgctgtcatatgatcctatagcatcctacagatctccttccattagcatccatcacatctgtaattatttccttttcattatctgtcttccctgagtgaccataaacccaatgaagccagagaccatgcatgattattcattcacagctctactccctgtgtctagctcatagtagggagtcactcaatacttctgaatatgaaaacaagtgaatgaattaagattattaccgtcatccagcaggcaaaatggattacatagctaagggtctgttcttctgaagtaccttcttataaaggataaaaaaaggtgctccttcttccaggcagatgaagctctgagccagagctcattgcttaaccaaagcattgcagctcaaattcagctcctgctcacccattggcaaggtgcctgcggtagttttaagagccatcaacaaatatttctagcttgtcttcttcctgctgaatgaaaagtttgcccttccctgctcccttgaaattagatgtggccatgtggcttgccatggccaatgaaggaaaacagatatgatcccattctaggtggaagcctttatgagttcgtgcacaatttaccatatttgtttctttctgccatgacaaccagcaagatcgcagatggcagacagtgatcggcctatattcttaaaaggaagagacatatacacagtacctagctaacccacaaaaggcatatgatatgttttggctgtgtccccacccaaatctcaacttgaattgtatctaccagaattcccacatgctgtgggagagacccagtgggaggtaattgaatcatgggggctggtctggcccacgctattctttcgatagtgaagaagtctcacaaaatctcatgggtttatcaggggcttctgcttttggttcttcctgattttctcttgctgccaccatgtaagaagtgccttttgccttccaccatgattctgaggactccccagccatgtggaactgtaagtccaattaaacctctttttcttcccagtcttgggtatgtttttatcagcagcatgaaaacagattaatatagcatgttagaaatatacttgtattgtttaaatattggcgctcttcattcctgcagcatatctagcccactctggctgatctagtatacaacccgcagccctatatcctgtggccctgggcaggttaacacgacttgcagtttctttgttctcatgaactggtgttcatgtcataccctcatgcatgcattaccctctctctgcacacaacgtgggcctctaagaagcaatgcttttctgtggaagaaggaagagggggcattcagacttaaccctttctgcctaaaaggcccttctgaaattatatgaaagagagagagaaaaaaaaaaaaacattttgcatgctgttcatttagaagggaggcctaattctttcaccttcctataatctccagagcagttcctataccatcaaggctgcctctcctgagggggccagagcttcaggctcataattagttgtattactactactgtcactgctaattaatgatccacattcagcctaaattgaaactgcccatttctgactcctccactctaggtcaaatagatggttccttattttcaaattatgtacttcatcttaattgtataatttcaatttcatttaaaaaaagaaaaaaattaaaccaaggaagaaatgacattttctaaactggtgagttgggttatcaaacttaaaagcataaaaaattaatactgtgggattagcattattatagaaatacattaaatcttatatttaaataccagtcttttaaaccatggctgtcacagtgaaaatgttaatagtatttaaacataaatccttctccccatgaagaatcattcatcgtgcaagcacgttagctattctattcactttagagatgctgcctagcagagcattttaacgtaagccttgtcagtgttaatcctaatgtctgatgctgagatgtgtgttatattactttatgtagctgaaaaatgggaagcctttatgtcagattacaggctgaaataacgacctccccttggagccagggcctgggatataacgaggtgccaaatgggattctaggtcagagcctctgcaggacataaaagggaacagatcttttgttaagacccattcactcactaacagaatgcttttaccctttgcaatctactttatggctcctctgcaaagaagagtaaccaagagagaaagtcttgattcacagtggggcttaccagccaagctttggattcaggcaggcgatggtggaaatgtacccagccactccttcacctccacaaccaacagtctagggctacggtgttcaaattgcattcatcaaattcagagtggggagtgagagcctgaggttcggcagaggcaggaacggggagagagagcatcaaagtggatccagtgccttctccatcctcactgcatccagagcagttccctctacatctgttttatataccacagttttatgaaagatggcacatgaaatatggttctcctgttaaagtaactcattaattcaacaaatatttaccagccacagacaataaacccctgaataaatgagcacatttcagagagtgatagacgatacagagaccagcaagcatgatgatgagatagagagtacctggagtaagggccacttgcagagaggacagggaaagcctggctggggtttggtggggaatctgagctgagtcatgaataagcagaaacagcaagccatgtgagatccaggaagaaccattccacgcagaggaagtggccagtacagacagcctaaggcagaaacaagcttaacgtgtccaagaatagaaaaagggcaatgtaactgctattgggtgaataaagagaggcatggaaaagatgaggaaggcagatcattcggggcattccagactcaaacaaggagtttgggtgtcattgtgtagtggttggaagccaatggaaggttgacaacgggggcatgacaaaatctgttttgcggagttcttccacacagagagtagattccaggcacaagaacataggctggaggatcaacaagaagactgttaccttccaggacctggaagagagttgcagtgaagatggtgcaaattatctggatctgggatatgtctaaaagtaaatctgatgggactaaaggattacttgaaatcactaaccagaatttgagaaggggagggtggaacacgtggtatgtggggagggaggagatagtgcttagaaagaatagaataattgccacttctgtagatagcttctggccaactgacttagcaaagagcagcacaatatccttgggctgagaccagcgggtttgccactgtctctcaccggcaatcgcattcttgcttccaaatccggctgataatttaggaaggttttatgtcaccgctgctcggcttctttttgtgctttgattacctattctcatacaacacttaaaggtggtcacagaataatctctaatgttttgctttctatgataaataaggggttcgtgaagttcattaacagggattgcatcaccctccaccctcttttacaaccacaccataaaagtagcctctaattagttaaaagactacaaattataccatcaacgtgaggtatggcaaaatctgatggctctaattatcttaataatcagcagaaccactctcaacctaataagagaatgagtcattagtggtagtttatgaagatcaccgacattctctttgttatggagtttgtccttcctgtgttaaaatttggacacactttctacttgaatctaaaaaggatgatttctaagaagttactgaagcaatgcaagatcaaaacataataaccacattcattcttaatcagcattacagtgaaagtaatttaccaaagaacacataattaagtcataaatgaaatctcaagacagaaattgctccccttttaagatttctcattgtccatacactcagaaatgagaagagggattttctcattctgatcctaaatctatcactgaaatgatgacttcacttgcatttatgcattttgctttattttgtgattactttatctcactatcctcccctttttctgcttgtgtgattgccttaatccttttatctagaaccagggggagttccattagcttcagctttttggtatgccttagccacagaaaactattttgtgattcaaaactgctctaaaattcaggaccaaatatcacatattatgtactccctagacttttgagagtttcactctagattatagaggacaaaatcatctccccacctccaccttagggtatgtactccccatctcaagtcataagataaacctattgtggtcagaaggcagagtactctaataaccttgttatagttgaagagactgagtccatgaaaaagttacggaccaaggttatacacagagctggtgacagtcttgaggctaaaacccaacgttttactcttagctaatgttcttttgggcttaatgaatgaactactgctgtggaaatgtttttttttttttaaaaaaaaaaaaaaaaaaacctttcattgtgttttgccagaataaagactgaacatggccctagcggaagagctaaattcattatctttaaaaaatgaaattttctcaaatcataaatgcagtcaccaagtgtaccttctttctctgcattgcagtacaccaaaatgccagtcctctctacaaacacattttatggatcccaaagcagagagattgacgttgttccatttcctgttcacagtataatcaggacaaaggaataagattagtattgtgccatttccacgcggaaaaaaaaaattgttttctccatgtgactgtcagtgtatgtcaaaatgataatggggaatgtgtaatacaagatattgctacttatcaatggactctgaaaagaaaattagctcaagcatcccttgatataaaaagcaaatatgaggtcttgaatcacaccatcctgctatcaacatgttttgttacaagtcagtttatgttccttgagtaccacgtggtttacagtgcatttctctgacagcaatacagaacctcaaacaaatattacccttgcctccaataccaaccaacattaaatacaagttctattcctgaactcagtggcattcagaaattcaaaatgcttagatgccctctccatcgatttgcttctctgggtattgggctgacttcctgttcatcagggggtggtggtggtggctggaggaggaagtagatggttttaaccatttgtaggtctaattactcaagctcagtgagcccacattgaagaaggagaaggagaagaagaaaaattctctttcctattgttcatatataaaatcccagggaaagattctaatcaactctgtttggatcacatgcttactccttgggccaatcgctgtggccaagggacagtgtagcttaattaggcaagcctggttacattcccatcctgttggcttggaaagggggatactatgaccagtaaaccaccccaaatcatatgaaatgtaggagaacggttatttagtgaaaatgaagcactattatcagaaagagttggaagttatactagcagacagaaacaacaacactccactgcctttcaaataagtttattatgaaatgaaactacggctcctcttttctaacagaccgattttgtgattagaagtaataggtttttctcaaccaacaagctcaactagtttagctctttctaccagatgagccaagaataaaggacacataagggtctcaaagattatgctttctatcctgcccaaattctgtaaccattaccttttcagtaggtgatacatttcccaatttagacttcacattatagaaaaaaaccatccttcactgagttgtatttgataccgaatgcctgcattttcatgtactagtcattattccatctttccttaaagaacatccttttttttttttttttagacagagtctcgctctgtcgcccaggctggagtgcagtggagcgatctcggcatactgtaagctctgcctcccgggttcacgccattctcctgcctcagcctccctagtagctgggactacaggtgcccgccaccacgcccagctaattttttttttttttgtatttttagtagagacagggtttcatcatgttagccaggatgggctcctcctgacctcatgatctgcccacctcggcctcccaaagtgctgggattacaggtgtgagccaccacaaccggcgaaggatacccatttttaaaataccatttaatttaaagttaccagatgaaagctgcccactgtaattccagggaaattttactcttagttttcttctttatggtcacccaaatctagattatttgaattcttcttctgcagtaaaattaattataatcatagcttccaatttttagctgctacttattgagtgctgactattcttggcatcagctatattatcattaatcctcataccagcaattattatcatctccattgtatagctggggaaactgagatagagttcaaagaatttactcaaggtcatacagctgagaagtgacacatcttggaatcaaacccacctctatttcactaccaaatgccttctcctaactatatactctacccctgcatcgcgagcatcaggcaccgagtctctccaaggctctgtgataaatactactcttgtgtgacctcatgtcaccctcacttttcactcggaatataaggattcccattcccatgtcacaggtgaggaaactgaagcttaaagaaattcatcaacagacctagtttgccctgtatatagaaaagctcaggtagtctcatattttaatctctttttagcctccttttgttttgtttcactcagttcagtcttaacgagtcttaatagtcaagaaaataaaatcatagtaaagaaaacaacaaaggtatctcataaggacaagaactaatccatcccactcctactgggctggctccttttggcagtggtgattgctttctcagatgtcttaatagaagagagaatttgtgaaagcagagagccccattaataaggaaggaagaacctgcaaggtgcaaataactaatctcttgttgctttcctgttaaggtaccatgcatgtgtcaaaaatcaaaaccagggagcccagcctctaatatgagaagattccagatttcaaaagcactaggtactatttgataaaccaaacattttccctgttattgctagaagcagacacacataggcacatttgcatcctctatattgatacttctcaaatcatccatagtaaagggcgtgtgtgtgtgtgtgtgcgtgtgtgtgtgtgtgtgtatttaacctctatttacggcagtctgattcatgaccctactgtaaatgactactacatagttcataccacatgtgacttgccacacaagtctgatcacattggaactggtcttctccttgttcaataggataaggccaccaattatatacttggatgtcatggtgacttcaaattgctataaagtttcttatccaagactgacaacttgcatttcttcaggactggcactgatcctccagcgacattttgaatggcctactccataattttttgatacagggtagcaaatactatgcctatagtggcaaggaagtgtgtactctgctgaggaagtcacctctgcagccaccagaatgacatttctgaagccagtgagagcaatatcagagagcatcaatattgtaaatacgttttgatcttatagataacctgaattttgctgtgtgcgctattaataactaatatttgtaagaatctcaacaattttcaaaatgctctcttatatgttaacaaatgtagccctactacaatcctgtaacatagtatccttacccacccccccacacacgcacacatacaaagaccaccacctccaccccatttttcagatgaggataatggggcttagagtatttgggtgacaaggctaagctcacataataagttttacaggctagcaggaataacaccaaagtttcattttatttgcccactccaaagaactgataatgacagccagccaggaagctacttggaggctgtgtctgggttcagtgggtaaagagtctttgagagattagcaatgtctgccgggtaagaccagatacactggatacccttggatagattccaatccaggtagcctaatttccttttccacatcctttagcactccacatagagttgtttctcacaagtatccacatttaaaagaggtaacctcccagaacagaaactagctgacattttggaggcaaagtctgtttctcttgcgcactgaagacaagaagagtcaatttgtgatacgtgttacagagataatacacatctaaacagcggtgataaatgcatgggaattacaggcaaaaccaaggtgatacaaagtttccaaagattagatgtatctcagattaaactctccagattatactaatcaattacagaaatggggctgagtgggagtagtcactgaagccaccgttgatgtactttccctaaccattttatgcaggcattccttcatgggggtctcctcaagtcactggagtcctcagcaggggaaaggaaaacagcaatagagaaggaggttaggatcttgggcttcattttgggagtcacagtactaaaacatcacctcatgattagcagataaaaggtgctgccctgggctcaggcaattacaggaagaaacaaccctaaagcagaattcacaacatactgagttcatgaggagggcgatgaggctgatgtggggactggcttttcttcttggtgactcaaagacaaagccagcagtacttatttaaaacatgccacgtgctcatgtttatgtgaggagtagaagacaacggctttggtaaaggagaaaattcactgcataattgaatctttgaaattccagagggaatggccttttctgagaacaatgtctgttattaacagaagaatttcgaggccaaatgcagagttttccaccaggttgcatagtgagagtcatattttgaatggatatatagttttttaaaaaaagaactctgaagagttatggatgtttctcaatatctttctcaagaaggcaacagattttggactcagcagataaccctttatcctatagctgtagtgatgatgacatgataagctgtgtagcctgagcttagatgcagaagtgaattctgggcaagggtcccactaacctgtcttccctgggctccagacccacatccctagctccttgttgggggctccaacttgtacagccagcacatcaggctcagtaggtacaaagttgacatatcaattttcccatgaaaagagatcttgttttgacaacactagtctttcagttacctagactcaaaatctagaagcagccctgctcaccttcatctccttcacagcctgaactgagtcaagggtcaaatcacatagctgggttagagatatttttgacacaattccttccttcctttccacccactttgagttggcacttgcttaaacactccctgttttacctctggatagttacagtgcccctcacttgtttcctcatctccagtaattatccattccaacccatcctttaaacccatgccaaaatcactttcataaagcttacctccacattcaaatctcagtactctaccaggcacatggtggctattcaggtaatattttctggatggatggatgggtagatggacaatgtatttactcatcatttactatatgcctgacattgtgctgggtattaaagacagcaggaaacaaaccaacttctaacaaaacacttccctgctcatgagccttgaatggccaattaacataaatggttcattccagcattcaagcccttctgcagcacagccccattctaattgtttcactggtcacctactctcccatctgtcctctagccaagggtttctgaccttagcactattgacattttgagccagacaattctttattgcagctgctgtcttctgtattacagcatgttgagcagcatccctggcctctacctacttgatgctagtggcacacagccccactcaagttgggacaagcacacatgcctccagacaatgccaaatgtgccccgggggagaagagtcgaaaagaacccaactgagaaccactggtctagggtggcgcccaatttacacccactgtcctagggaaattattaatagtactcccctttcactttcacatgtgttccagtttagaagacaaactagattggttccctgcttaaatctcccgagacagcaaccttgctctgttctcatgcagattgaagaggaaagcaacaaattagtatgaagccttcagcttccaagcaacacttttttttttctggtgaaccggtctcctctttaaagattcaacttctctcttcttctttcagcacatgcagtactgggaagtaaaactggcccaaatgctctgcagggaaatgtgaggatcataagctatcctcgcctctcaaaaaagaatcacaaaaatatttacagcttttctcaaaaagtttcatgttccaaagatccccttctacgtcattctaaccccaaatgcctcaaaaagaagttcaaagctctcaagtccatcgatccaacttcttctctggccaaaaaacaatttcgtgccatgtgttaatgcaaagggctcatgctgtattcacgaaatgccaagacacctggttaaaaagttcaaaaaagttaaaaattgatccataatttcgactagcatggtagttctcaagctttactgtttcagaattccctggagtgcttgctgaattggaggttactgagccccagtcagcagagttgcagatttagtaggtctagggtgaggcacaataatttgcatttccaagttcccaggtgatgctgatgctgctggtccagggatctagaagatgcccgctgctccctgcttattccctcacagactgaaacgtacgatattacggggttaggacagtgggcttgggaaagaagggagggaggtcaggagacttcatccggctgcttgcttaggttttgtgtttttcattttttttttttgccagttagtcagaagaaaacgattttaccctggcctgtgctgggcaccatgctaggcactagggatgcagcaagaaccagacagaccttgcctcctgctgttttcccctttagagccacaagctcttctatgggctccaattccattccttctagcactccctttcagttcatcagctgctaatcagcaccttcaatcactctccaaatccccacaagacagcttccatttttcaaaagcaaagccaaagggaaaatcaagagtttttagaagcatctcctatttcggcaagtgcttccctttttgactctgatccatttcatcaaaaacccttattagagtggtccttcccaggtgtatctttttagttacctctggagataggaggtgcatccagtttattctttctgctttgtttcctgtccagaggagaagagtgctttgatccaacactgacaaccacgtctgcaggggcctcagacttgcttccagggaacaatcactcagcctatgattttgaatgcttcttttgtcactgtcaccaaagcctgagggaaagcaatctacacgctggttgacctctgaggcgactgccagaggtgccagctgtttcccctaaactactactcactgttgaatgtctaggtttccatctcccagggaagacattgccccagcttacctcttcatcatcatttgggaaggccagagaagtgtgggcgaagccatcctgcctggcgtcctcaagactcttgtctgataccagggctctctctgggtctataatctttgttcagggaatagggaaaatgtcctgtgatttgttaatccctcctgtgcagtgagggggaagttttagagtaactatttatatttttgtgatatcaggagcatctagatatctttgcttacaagtttttttttataattttagcaaaggaaaattttatagtttttagcaaaggaaattttacctttcatcataataaaaaatgtattctagaggccattattcatgggttaatattatcagggagctaacgatggcttaacaagagatgggaagccattttggaagtgttctattatggaaagagggagggcctgtgacatggattcatatatcatattcatatggattcatatgccagccatgcgtcagccatgagtaacatcatttcttaagatgtcagagtttttcccaagcacatatgccctcaggatgagaaacaactcgtctgtttgataaaaaaagaaaaaaaaaagaaaaaaaaaagattttagttcaagaattttatagattacaaatttcagagattctttattccagtatagagacacagaaatcaaaaagaatcatcactcaaatatacataggtctattaggtggggacacctggtagatgtaattatagtttcatatgcctgtatttaatgccactgaactgtactcttgaaaatggttaaaatagtaaattttatgttatgtgtatcttaccacaaatatatatatgtatatatgcagaaaaaacatatataaatatatattcattaattaggtatctgaatagggagctatgatcttaaaaaagattattttttcctaaatggcaatgtgaatttcatgtggcttaaaatcttctagtatggatttttggtgtttgataagctacattatttaaactagaataatctggaattatagagaagtatttggcttctggggccactgggacaggggcagggagggagtgtgggagcagcacccctccccagcccctgctgctgtgggagttgggatggggatggcacttccctcaaaggagaccaatgttccattgtcagtcaacttagggcacaaaacagtcttcaagagagaagaggtggaggggactcatacctttggtgggagataagcccctgctacagggtaacacaggtgaaggtcaaaatgactagtagagaacacctcctgccactaaggggtaagagtagtaacatgtaaaatccagctttaagctttactttcctgtgttagtatcagacactgctggttgtctacctactttctgttcccccttcttacctcactaacgtaactccaattttgagaggaagctaccctttttcatttgttcaacttcttcttgggaagctaatcttacccttgacccaactggcctaagccactgataggaataggaagatgatacaattccggtcattcacatgctcagctagctgaggagacatctgtgaaacagttccttgtccatcaaaagagacacataagaagaaatgagaatcattcttttccaactgttaatgggtctagataggatggctatactactgtagttattgtgtgaccatgaagtgtgctaaccttgagccagaagccaatgcagggaaattgaagagtagaaagaagggaagatgttatattcttgagtatgacatttatgcaactgatgtaaccattcattatctcaaaggtggaactatcctacccttaaactccttactattggaactttttgaatcatgatttctataatgtgctgccaaaatcattctacttaactggttcagaattgtaattctttcaggtttttcctaaagccattgaaaaatggtttgtcataaatgactgtgtagagttgacagggcctttggaaaactgagtgggtgctgatgaccatacagggataaagtggtcatggaacaacctctgcgacatgaagatatggctgcaagcagcaagagataacaagcaggaaggcccagagcagtgatccatagcataaagtgacaagtgacaggagggacaggcttgtgggacatgtaaacaagccctatggttcttcagaaatacgagtggagaggaggtcatttaagacattgaccatgttcagacatgcagagtagaggcttgggctatgatcatcagataccaaaagaaaaagtaaaaagatgaagattttagagggattcagataatactggctataaggaatatcacaggatctcctgccaagaaaatgagattcctatatgatttcttatatctctccatatgtttcctataagaatactagccatcaaaatgacaaattcaaattggtatattcagacaaatagaaagaaagtatttccctatccctcaaatgagttggataaccatgaatggtgagtcagatgagaaagaaaatgcaacagctctcactcagacctggacaaaatgttaaaagatttagtaggatggtcaaaaacatagttttcaccttaactgcttactttcaactcttcattggaataaatgcatataggccaaattaataaggaataagtagttatattttaggttaatagttgtaccattattagaaaaaatctgcctcatataaatgcagccatgagcacttcctcccctttaaaaactagtataataaaaggaatgactgattgtacttggcatatttcccctctctgtggttgcatttcactgcagttatgaaaacataatataatttttcccaaggccatggttacctgacagaagcatttaaaaaccaactacactttggacttccaggcacgtgtgtgtgtgagtcataagacagttcagaagagaaattcatatttgacatccagagctccatcttcccgcctcaagtgtctgtgtggatgtacttactccagtcttacctgagtttcaataatatgggtttgtcacaggttgttatgggctctaactaacagctgtccactgcactgagaactattattttcagaggcaggtcagaagcccatttctgactctcacgcattgtaaagaaatgctgaccccaaagtgggattctttctcaaatacactcaccctgtaagcaccaggtagagccaggagctttcaaaagtgctctgagtttaaacatttcacagcatgaggaacacagccgaagagaaagtgcaagaaaaacaatataaagacattattaactgtgtgatcacacaagagtgaggcctccagatgggccacctcatagttattgacgagcgtttagagaagaacattcattactcgatattgacgctaacgagaaagggtttgagagcaagtttaaaatgtagaaggaggaaacacccaaaccccatccccatggcagctaattcactgttcccaacaattctgcatgctattttttttactccccttgttcatatcttatactgtgattaaacccaagcattctgactgtaaaccctttttttctgtctatttcgcataggcttggtgtgttaatcaaactgtcagcaaaggaaaaaaaaaagaagaagaagaaagggcacattctatccaaatgaagaaaaatctgagctttctacaacaaacacattttccagtggatgagcttctcacacagtaattatttcacttctcccagagattactgattacatcacacagaaaaactaaatgagggctgttttatctttctcatctctctgtggttcttgtgcaaacttatacttgttatcatgaaaaatgacaaatttgccatctgatcaaaatgttaacaaggtaactgtcagtgagatggatctctgactgtcactgcaagccagaacatgaggatacattgatatttctcaatacagcccctgcttccccaacgttcactaactacatttccacagtaaggtaataaatcactcagaaataacgagctatataggatctctggggtatgatagatgtgtcctaacagcactatctgcaagatagaaaacaattgataatgatctaaagaaaaccctaatcaactgccattttccataatggggtagatgaagcaaagatatgaaatcttaactatgtgatgcatgttatgacaaaaccggactgctccaaaaaaaacccacacagccccaaacaaaacacaaatgacctaacattacgtagggtcgaataaatgaaaaataaagttaataacacagtctggatacaaacattatattggacactggcaatgatgggataatcacagcaattgctgggtccacaaacagctaaatagtggagggttcctcatataacatgaatgaagactctggctcagttattggtttaatgaactctcctccaatacttttatgttctttaagactctttgggccacattatttctgagcctttaattcaatggtttaaccaatcatttcccccacccccccccccccgccccttagcaacgtggccaagtgccacatccaaaggaaccaagagagaagaggagaagtccatatggaaataggaggtaatcaaagacagaacacaagatagaaaacttctgcaagaagatcatggcttcagatcacagggacaaagaagcatggcatcaaactgccaagaagctgcctcataacgacatccctttaggttttaaggttaagaagtctcacatagccacagttggtctcctgcctgtcccctctgctcgtttgtctttggccattcctgcttctgctgtttgtagaatactccaagcgccttccctccccaagaccttgtgcctgctcttctctctctctcagggatctctctcctccctggctccttcccttcatccagcttaaatcttccccaaggaacctgccttgcccttcggtttcaaagtagcctctactaccacccctttggtctctatcagcttcatcgatagcagaaagaaccatgtctgtctggaccactgtaatttccaggcttctagcactttctcttctctagtagggattaagcacagtcccaatcctgggctctgggatacaggactgactagccttgaatctagtgccacaactaagtacctgtgtcccactgtgcaagcactcaatttctatgtgcctcaggtccctcatttgtaaaacagagagaatagcaatgcctataaatgacagcgttttgaagactaaatcactttatcaatgtaaagagcctgagatagtatcaggcatacaggaatccatcaatcagctgctgtttttataagagcaagaacagaggtaattcagacataaagtgaattaattcatgattatagacgttagatcaatgagtcaccttcatcattccaggtttttattttaccattagccaaaacagtattgtgctccttctaattccatattctcagactacatggaatgaatgggtattggtctttaagcctctttgagcaatgccaataaatacagtcacttccaatttgagggcacttggaatagcagtgctattgttcctttgacatctcaacagcacttgaaagtgaaagaaaaaaaaatagattaatggatgtattccctaaagcaacaaacatgtttgatgtataaacatatgttatgggcaatgacgctgtacctttggtgccacgtctcaacaattctcttttcatctatcccctaatcatgcaactgaatgcttccagtaggccacacagtagggacaaaatgatagtaagaccacctggctatagatacctgcttctagagaggccaggttccaacccattacaagctgataaccatatgtatgatttttgctacactggccaagtatttggatcttttttaaacatatttgattatttaccctttgattagaatttgtgaataaaaatgtcttttaagagacacaaaggaagggggtacgggcaatagctcattactaaaaatcattttagtgtggaaagtgggcttcactattcctataaggcagtcattttcaaacttcagagcatcacaagccccctgttagattctaatagaaccctgaggaaaatgcacatacacataaatgttcacatataatttctacaggttgaaggacctcccaaaacaaaacaaatctatcaaccacaaactccagtgtaaaaaactggctctatgaagacttcaaatcaccctcacttcctttgcatataaccatttttttcttcagacaaataaaaaatacaattaagtttaatacaagaagaggctaaaaacattaggatagaatattagagtttaaagatctttgcctggttatggtctaaagatatttgctttgattaatatatggtgtaactcattaattaaatgcaaattgaaataagataaacctgtccccatatcatttctggtagacaataatgtgccagttttctctccaataaattagatgaggcaagctttctgttactaaataatagcaatatgggacaggagaaaaaaatttaccatgaggtgctttggaattattcacatgaagaactttttatttcttactttctttttcactaaaatagtactttttctcattttcaaccaatttttaaatatgaggtgtttacattgcttactgttcaaattagcattgcatactttcaggcacagacatgctcaaaataggagtcttttgaaatgcctgcattcagtataaaacacactgctggtaggaaatgcaaaatgtaaaagtcttaaaatacatttagatatggaaaacaaaacatttaaaacatattcacactttaacatgtttggaagtataaagttaatatcgtttatgaaacaaatttcaggaatcatactattgaaacaccctcacatcttcaattagctggattaaggaaaaaaaatattaacaatatttaaatgcagaaaacagattatcaggaagagagatcgttatagcaccttgttttcactaacaagcagagcagactgtaattgagttttagaaatccctgaggtggtaactcggtagagaaatccagacttggcaaggaaatcaagtttccctttaattacattatctcaatcaaagagataactttcacatccctacaaagcaaatgttttaaggagaagtctggcaaggaaagtaggtggaggtacagaggggttaagagtttcaaataacttcatattggtaggaggaacatgtagaaaactgaagtacactgtgaggaagaagacagatgccctggcaaatggtgctgctcccaaaaacatatgacacctaacaccttggtccattggtcctgctttcctatatcagccttggttttgcctttgtcactgaagaaacatggcatgttccttagtgttgaacacataagcctaaagctgatctacagtttcttaagctgataaaaggcaaagctaaaatgactttggccatgactatgctgttcggaggaggaaaatgagaatgttcagtggaaattattttcttggcagtgtccttactaggtcagcaaacctccattctttccaaattttccgggtctcctgcttatttcaggacccatataaggaggatataagcagtgatgtgtgagagctggtttgtaccagatcacaagagctgtttgtataattttcagaaattttgtaagctggtagcttaaaaagccattaaaaattaaattgtgtaatttgaaagtaataaatattaaaaacaaagggaagaaaatattaaaaactctgtaattcctcataatgtcactacattttactattgtctatgctcttaggttatatacatctgtattagtctgttttcatgctgctgataaagacacacctgagactgggtactttaaaaagaaaaagagatttaatggacttacagttccatgtggctgtggaggcctcacaatcatggtagaaggtgaaaggcatgttttatgtggtggcaggcaagagagaatgagaacgaagtgcaagggttttccccttataaaaccatcagatttcaggagacttattcactacgacgagaatggtatgggggaaactgcccccatgattcaattatctcttacagggtccgtctcacaacacatgagaatcatgggagctactattcaacatgagatttgggtggggacacagccaaaccatatcaacgtctattgtatcttgtggtggaaatactctcagtagtgtgctaccgcacgtctctttccaagtctgtgcagtgacatcaggtttgtagcttcaattcagccatatgaactggaaactggaaacactacagattaactgttttcttggctatctagatttaagaaagtgatgggggaaaataatgattatggagacaaagcttaaaagcatattgtgtcaatagctgttacatggtgaatagtacaaaaaattaagaaaataccctttagtgttctatatctattatctgatttggcaaaaatgtcactcatatgattgacaaatgagtaaagttttgacatatattcttaggcttcacttttgtcttgtttatgtaaacaaaaatgtcaaccaatattcatgtctgaagcacacctgttttgtcagtgacatgagcaactttgcttaattgggtagtaaccaagcatttattccttatctgaattttcaaatcatggctgaatcacaatcataagttgactgtgattacaggaattcaacaaacattaacaaaagcattctgtgagaatcaaattggctatatagaatctatgataaagattggtgtatattttatgattactcacaaattgtgtggtgcacattttatatcagtaaaatttataataagcagtcagatgtatgagggtatgtggatatatgtttttatatatacacacatacatacacacacatgcatacacaaaaaccagttgttaatatttaccagcacaccactggatatcaacacaataaagatatactttattgtgtatctcagcaaaaactgaccactcaacttttctagggacaactttattatggttggaaactagaggctaagacatttattgtgtcattgttgaagttccgtaaaaccatttcctatctctaaagttatttatttggctataatgccaagctacaccagctacttccccaaaagcaaggctaccagatggtgacagatttgaaagctctttctcatattttgagggtaggtaggggagtcacgctatgggacagtaggaaaatccacttttagcaggcaggatagaatgggagaagtcaacaccttgtcagttgccaatgagctgctgagaagtagttacagggtatatagcaggatagtattaaactgaaaggtcattaatgtgagatccttgggacaatatgcactctgtatgtctcaataatgttaaaagattctgtacaatatttgattgtatccaaatagtttataactgtaacatttaatttcaaggacaaaaatgaacttaagtcaactattcctgtggttttacatttcagagagcagtaagaaaaattcaccaaaacaaaataaagcaaaacaaaaatggagtgccaaaacagatttgctaatttttaaaaatgtgttcaaataaagatattttcaaatccttccttttattatcacccttatggcgcaaaagaaagctcatcagtttgctattaggatcatttggtagcacacaaagtccattttctatatatgttcagaagaggaaacaggatgagcattgggctcagccactggagatcacagcttcatcatggttcaacctcatcttcagacactgaaaatattgctgaagaaacaggaagcagcattgagcacggggggctgccatgtgtcctctccactgaagatagtctgaaggatacagtgaccgcaggaacaaaaatgccctcagaaacagccctaaagggcttctagaaagtacatgctacctgatgctttttttttttttttttaacgattgatgtctctgatttgatttggtccaagctattctgagaattcatgatggaatgagaacatcagcaactgcagcctattggatttcggtttagtagagtacagtgctctgtttgatcatccacttttcaagagccagcttcacatcctaactgcatcatccttgcaaagctctgctactttgaatgctgctttttttcagtccctgaaatacatgtgcctggggtgtcaccaacaggtgggttttttcctctgacttctttccatgtaagcctcaaggcatgtataaaggacatgagcgctgctttcattttccaaaagaaatcagctttatactgggaattgcaagcacgtgccaggtttcccatagtgacttatatgaactcgcacatactcagggtgagtaaaactagcaggcaggcaggcctcaaccaagagcacatttgctagtttttcttgaaatgttcagaactctggccctaagagaagctaatgccaggcaatcccttgcaaggataggagggttatgggatcaaggcaaaagacacatttggggaacaccattccattgggcaagctctgatatgcagaatctaaggcagctttctggacctctgaatatcatagcatcgcagtggcttcctgtggctctgtggttacagaacaatttctaccaaatgaagagaatgacagaagcaaggacctccacattcctatcatatgtgacagtctggaaaaaggcagtgttcattcttacctctcctaacttcactcgctcattcccaggtgagcctgaggccacatttcacctgagcatcccagctcctacagtcagaggaaagaacaaacttcactcccactgaattaggaccaactatttactagacactgtgcaggtattatgttactgtctcagtctgtttagttgtcaccataaagaaatacctgaggctgggtaattcaagaagagaagaaggtttatctggcttatagttctgcaggctgtacgagaagcctggtattggccttggcttctggtgagggcctctggctgcttccactcatggcaagggtgaaggggggctgtgtgtgcagagatcacatggggagcgaggaagcaagagagaagggaagaggcaccacactctttttaacaaccagctttcatgggaactaacagagtagggagtaactcaccaacagagaggtcattaatctattcatgatggatctaccctcatcacccaaacacttcccatgaggccccacttccaatattggggatgaaatttcaacatgaggttaggagggcacaaacatccaaaccacagcaattactagtcaattatttccgcagtccagtgagacagttttctgatacttgtttacaggacaagaaattaagtcttttttgtctattagacattcatttattgagaaccaactatttgtcagaaatggtgctgcagggctaccagagaaccagacaaatgtggcccctgacctcatggaatttgcattcctgtggcactcaaagaagtgagtacctaagcagtcagtaaataactttggctggctggttggctaagtgtgtatggagcagggaggcttggaagggggaaagtaacaacatggaaagaaaagcaattgtgcagggattcctagataataagccaaagacccagaatttgaacttcagcctaattcacttttgactttatcaagtgacatagcctcgcagatcccccatctcttcctatctcatattaaaaacgaaccagagcaagaacagtagcagtggaatctttcccatggcccatctctgttcgctggagtctgagcaccatctttgggccaaaagcctggggaagaacaggatctaaattccacatttgtggtgaggactagaaagtttcagaacattgcccttttaaactcatctttattaatattctttaagcgcacaggtaatgagaaagtgcaaatacagccccctctggctgcagcagtcagagagccaagaaaaaactgcatgtcatgccatcctattataataacagattaaaagggcacaaacagggtactaattagcagtcataaaaacttgaagctccagattgctcatcttcatatctgggcagtaaaagtaccacgtgtgcagataacatagaagtaaaataccagggtgcaattgcccagagctcagccagcatcagctgagagaagcagttgcatccagcagcacatcctacactttctcaagaatccaaaggcattcaggtgactgcccaagaattaaaaatcagccagcccagagagaggcaagtgcctcctaactcagcaagggacagcgggagaccttgccaacttctgattgatcgtcttcaattccctttctccaagatgtattcctgtccatggtctctccctggattttatgcagaaagctacttctgagaaatgagagggttttattagcatgcaggggccaaagtttagcctgaaggagagataccttcatcaataaaatcttttttgattaaattcagtcttttttcttgggtctgctcagagcttggaaaataagacgggtgtactttctaacttttatccccaatttgttccctgaggatttcaaggattctgttgccatcggggcactctgaaagaagaaaggaaggagtatgctttctttaacaagttgtctcttaacaaattcatacccaataattcaggcttggacattcactgtactcacctagcttggccaagtggctctgtattctatgttaactgtgatctataattttaaaagtagtcatgcatagcttatatagagaaccatcttttaaaaaatactctaaattttgttctaataaggagaaaagtgtatctacattgcatgtgatactgaaactagacaaattccttgtagccttttatctgacaacagctaaaaggcccaaattgaaggcaaagcaatgatgcaagtgaactatacaataagcacaattgtattcattttatttccaacattataataaggaccatatattattcactggtatatattctcttcactgtacagtgaaatatatgggaaaaaatcaagacccttctcttttaaacattagctctatatcagaaaggaaatggtctatatttattgattttctttgagggatctaggtaaatatcacagggctatgactgggtcctagtctccataccaccagtgatatggcttgtccaacatgacctttagaaagactcagagtttggctttgtgtttctcatctgtcttagtctgcttttgctgctttaacagaatacctgagactggaagatttataataaacagaaatttatttggctcatggttctggaggctgggaagtcccagatcaaggggcaagctgcatccagtgagggccttcttgctatgtcataacatggtgaaaggcatcacatagccagaagagagggtgagaagggctgagctagtgtttacaagaaacctactcccatgataacaacatcaattcattcatgacagcagggccctcataacctaatcacctcttcaagttcccatctgtcaatactgttgttctggggattacgtttctaacacataaactttggaaacacattcaaaccagagcaccatcctattctcagtaataccctttgtcttaatttttccctactaacctgggatgatattcaaagatattcaacaatgcttgggcactgaccaataaaaatgggactagacaccaggcatcaagaggcagtccagcctttctaattcatactgtctgacatccatccagtcccaattgtttcaaaggttctggtgataataggggccacctctcccaaatttgccttcttaactggattcctaaaaggacaagtcatgaatctctaatcataattctagcacacgtaccacaggccattaggaaaactatcctcagataaatgaagcctccccataccctcaaattacatcatgaaggtgagacccttagcatggtctctgactcactaggcaaccatggccaagtgatttgcattcttgagaaaaacttaccctccttataacagagaggaggatccctcaaagagatcctgaaagctcaagtaggagaagacactacaacgtggttggaatgcttcaaaagataatactttctaatcctaagacataattgctaataaatggtttcttttttacgtaaggtcaaagaatttttaataaatacagtctttggtgctcattaagaagacactaattcttcatgggttcataagcacacacataagaaaaatctgcagcaacagtacagtaataaatgtaaaatcctaatgagagaacatacattggctggaaaagggtattgttcttttcttccttcttttcttttgcgaatgatattgtaatgaattttcttcagaggacttattagtgtctgtttaatattatctctctctttcatgtgaaaactttccttagaatcttaggcaaagctttaggccttcaatgaagacgtcattaaaaaataatatctaagcagtgctcaaaatatcacattacaacaagttaacagcactgtcataggatatagagatgggatgatattaactatcagagattccagcctgatctatcagtaatttcattatttccaagtacgaaattaacttctttgagaggataaagcctgcagggctctggaggcctcttttgatctaagcagattattgccctgtggggactccatggtgggaattagatctgcgttcttggtggtgtccatagctggttctccattttctacattcctcatgttagaatggccataaatacggactgagcatcaatctgggactctttttcagattgcctagagggccaaacactggaaaagaaaagggctgcccgtgaaacttctggttcctgccttactgagggcttcaaggaaaggctgggtttagggttcctgaacactctgtgctgcctcggttcatttcctgttggggaagttctgaagttcatctgttacattcccaatgcttatgttaattcatatgcaaaatgggaacccgcttaactattgccttttattactctgaaatcagccaaaccagcttatgcatcttagcagtcttaaatcagcgtttcccaagtatgatctttgaaacactattaccaaaaagctgctcaaaagagagagagaaattataataaaaatatcatagttcaaagtactttggaaatgctgcttattatctctcttccgttagtttcacgtacaatgctaaggtcaaagaagttcttcaataaagaacagtatttaattttgcttagctgagcatttttcaatgttacttgccatagaatttccttcatttctcccccccaacactggctctcataatctgttatcattctgaagaacaaagagcacacactttgagaagagatggccctaagttaatcagcacactgcattaggtggctgctatcaattttgatttaattacacaagcatgcactcagcatttatgcaacgtaaggtcagaataagggttatgtactcctcaagggtaggttcccaaattggtgggatatgttccagcccctccaaggacttacacactttcctaagacctgaaaagctatggtttaaaaatagttgatcaatccttccagttgtccagctggggtcagttgccaactctggcgggcaaaatatcaggaaccaaggacacaaaatatgaggaaggcgtggcctcttccctcaaggaggctaccatggacaactaaccacaaaccaggaaaagcatgatatggaaaagggagtggtttattctgcatgaagggaaaaggaagattggtaaagacacaggctgctaagcggggctccagtgagaagaattcccattgctgggtagaagaggacagatgggtaagcaacctgagaaggactgaggctgcaaatgtgcagggcatggccgttctaagccagtcatccccccgacatcacagatgaaccaacaggacaaaaatttaagagttccatgatagaggaggcaaaccttagccaatttcttcacaccaggaagccactgtgcctatattctgaaccttgctgacggtaggtctggagtgggcctttgtgtctcccagcagcaggcatacataggagtcatctcttcgatgggcattcacatagggctaggtgtgcccttgctttataaaacatatgggttcttaaaaattggatattcctggatgtcttgtaagtaaaatcattttacatgaccatgaggagtgatccatttaaaggatccttgcagggaagactctggggaacaaggaatccacatgcactctgagatttctgtttagatttttcctgaagagctgcctcttaggggacttctgaatttaaagagacgttagaaagcagacatgatgaaactgcgttgtctccaaactaaaaacaaaaagatgaaagtaaacttaaaagctacagatgccattcgacaatgatttgatgtaaaataatagtccatctataactcaatttagccaagtccataccttctgagatccttgacttacctaaaggctctgtctaaatagtgaccctatatcatacaagttgaacaacaacaaaaggagaaactagcagatttttacatcatcgggagggacatagctggtcaaacaggcagtaaagtttgagcacaacaaagcgagctttgaacctcctaagcaaactgacaaattgcgctcaggagtccagttcccagcatcagcaccactttgccacaatggcttgtctcctatctctcctgcctaatggctttccatgccaaggagggcagtcagtgtgatgaaaataaccatcaacaaagcatttggtgattagtcgtctgcttttttaaatataatgcctgccagccaagattgataaattattttggtcattaacaatctatttaacaactgtaaatttaaagtgatcactttcctgaggcttagtgttatagaggttagggggtagaatctatttagccagagttaagagctggaaaattaagccagaacacgagaaacaagattacaaagtagtattcctcagtgagtgctgtgaagctatatggaatcaggctattaccaatggtgggggatatgtttaatcacctcttaaaggaaaaacaatcttaattaatgttgtatgtcataaaaatataatttagatggggatgggaaattgctaaagacgaaacccagagcaaagtgaagacttggttcaaaatgaaccacccacccatcaattataaaaatattgcccaacagcaaatcaaagaacatgctctttggtcatatttgggcagcctgaaaacactgatccttgaaaagcgttttcatactttatacaaaaaagataggaaatatttaaacttactttaaattagaattttaagtgccatatttaaaaagctgaattactcatagacacagtcaaagttaacacactatattttaaaactatatctaaaaaactcataaatatgtagtcagttgtgttggtcagtgaacaatattattatctttatgctgcaacatttggaccgaacatttcacctgactaaagtttggcattggtccacttgttttatttgatgcttataggacatccaaagggaaacatagcaaattgtttctgtagcctattcattagtagcacagagaaccaatcccagcttcaaggtgtcaactggtgttgcatcccaggccccatctaccagtagttcaataaggagcaagatggcaggaataagagggaaatgcatctcccttcagctttcaggttttagactactgtacatggctctttccaaacaagaagaaaagaatataacatgaactgattggtgcagtaaactaaactggatttatatgctctaatatggaaaaaagatccctagaactgatcctcaaaagcatctcccattaatggagaaataggagaatgtccccaagggtgaaagtctgggaccagcaatatggcaacattataagtgcgctgaacagcatttttgtaggaagtgtgttctaactgcctttgtaaaaggaaaaaggaaaataaaacaaagcagctggacaataccatttccactgattaaagttcaggggagcctgaaaagttacttatgagatatagttcaaccattttcccccttgctttcagatttacgtgatattaactcctatgcgtccacagcagccccatgatccgcctcagaggaattcagtgcctaatacttgactaggaagaaacattaggtattgatgggcaaagagttttcatctcaaatgcctctctgatcaactagcagtagctcttgttgaggagtccgaggccatatttaaactcagtggaaaacagcagcatgggaaattagcagtttggcatagagattaagaacatggattccagcagggagcagtggctcatgcctgtaaaataccagcactttgggcggccaaggcaggcagatcactttagaccagcctgggcaacatggcgaaaccctgcctctacaaaaaatagcctggtgtggtggtgcacgcctgtagtcctaattatttgggaggctgtggtaagaggatcacctcagcccagtaacgtcaaggctgcagtgagccatgatcataccactgtactccagcctgggcaacaaagtgagaccctttctcaaaaaacaaacaaacaaaatgatcatagattctaaatacatatggatgtttgaatcctggccctattccttaccagcataacaacataaccttatgaggttattatgaacattaaataaattaaggcaactttcacaatgtctagcacataatttacacttcataaacattagcatcataaccaggaggactaattgccattgttgctaattggcattgcagagtagagttgtggcttgtcttttgcccatcaggctatctgtgtttcagaatctgctcctcaactcaagtgtaaaacttacaagcagtggtggagtgggacaagtcaaatctacacagttctttatatgattgaatcagtgaactggatagactctaccaccaagatgtgatgtgttgcgatggtggttctgtagtatgtttggaccgtgaaagatcaaaaagtctttcaatgattcatattttcagggcattgcaaagtgatcaatttggtacattcttgacttaaaacaatcacttggacttctccaaacttcccagactgctaataacatgcaatcctacttctaaccaaagtgaataaagcatcaaaaggaaaccttggtttcatcccaagtgctaccagctgctttcacatattgaaagtttggctctaccactaacaggaaaggaaacactttcaaacctggcaggtgatgagaacagacttcagaacttggctacactgtcatcagacatcaggggctggaattagggcaggggttctcaactggtgacaattttgtcccacaggggacatttgacaatgtctggagacatttttggttgtcacaactgggtgggaggtgtttctggcatctagtgggtagaagcctgaatgctacaaaacatctcactatgcatactctcactccccaaactctgaatcttcgggtacaaaatgtcagtagtgccaagactgagaaatcctggattagcacggaacacagagcagtgtggactcattgctaaatgttttcctcactatactggaggctccaggtaagtaggaatcattgtatcttcagtgcctagcacagttcccagtacttagcaggggctatattaatttttgtggagtgaatgcactataatagcagatattaatgcaggtcagctaccatttttcttcacagcagagcaaatatttcttcaatattaaagtcagaaagcaaggtgaacagagaagacatatcagaacatgactttgcttatttgggcatctagcacatcagacacttccaataaatctgtcccacttccttcattccctatcttccctagagaagtaactgatgccacatccagaacctaacaataagttacgtcaacttgaccagcaccaacatatttctagaatccacttgcttctctccttccatgaagcctaagccaccatcatcaacatctctaatgagtcactttgcttttgctcttgacctctaacttccattctccacagagcaataaccatatgtcctgttaaaggcgttaatcagattacatccctcttgtgtttaaaacttgctaacatcctcacgggggcttaaaacatcttacaaagtctggcacctgctcaactctgcactacaatcatagcggtcatcttcctatttaaccaaattgtccaattcctttgcttctcagagcctctgcactggcctgggaatgctcttcatctagatccttacatggctggcactttcacataattcaggaagtggtttaaagtcaactcgtcagagaaattttttgactgcacagaatcttcacctgtgtagtcagacaagttttcttgtctttagattatgaggcacaatctgagagctttatttgctcatttacgcttgtacactggcatccctcccagactggagtgtcagcttcatgaaaacagagaacctgactgttttgttctctgctgtgtcccaagcaagcacagtgcctggcacaatgtaagaagtcaatacacatctgttgaatgaatagataactgaggaataaatcgatgaaataaacagttcatatacatgaactagtcagagaaaaaagaactcatctaaaagaaaatatgtgttaactgtcacttacaaaagagttgcctagaattttcaaattaaactccaaatagcatcctttatttaactgcgatcaattcaacataagactgaaaatcagaataatagagggtagttagtgttcatctagcaccaagagtaactcagaaattaaattaacagtttgttagtataaatctccctcgttctctttatgagtactaaattaaagttcatcctatatttttaaatctgttacaagcaaagagacaatgaaataatgaaagtataatgaaataattttactaattcttaatacataaccatagcaatgattttgtaagtttccaaatatggttcagcagtgtggaccagcatggcatgaaaataaatttaagtgtgttttccttttataatttttattactgtgaaagaaaataattaaggtatttaatattcacaagcagtatcagaggcaagaatacgagtatgacattactgacgaaatctggaacataacgcaagtgtaatgttgctttttttggaccacgtgatatatctgaatgcaacaaggaaagaagccagaaacatgttagcaacgattgggagggtgagttgatggtagcatgtagagtcaagcaaagtcagaggctgtgacaaaccatgctgaattagcacatgcagttcctcttggtctgcctcccacccacctttccaactgcagttcttatcactccaacaacatccccaaaacttgcagggttctaaagtttatatagtcttggggtatctgtgtccttatttacaccacagctgagtctaaaagaactttctgcaatgatggaaatgatctaattctgcactgtctattgcttctgtatcgagaaactgaattttgcaaagcatttaatgttaattaacttaaatttagccacaggctgccaaattgcacagcacagctctagacaccctccctatagtctgcaaactcctgctcgtccttcaagacccaattcaaatgtctcttcctccagaatccccttcctcttcctgttccctaaatagcaggtttcatggctttaatgataaccatttatcacattctattacaatcattttatggtatgttggtccttccaactacatcaagaatctctcaaggggacagactctgcctgactcatctctaaatactcagttccgtgcttggcacatgagaattatttgataaatacttgttggatgctcaagtgaaataatgaagccatctttagacatgaacaaatataagcacagcttaccagaaaagttcttcccaggggaaggtttactccatttatataagaagctgcaaaccagatatagcttgagcatccctaatctgaaaatctgaaatgctccaaatgctccaaaatctgaaactttttttttcttttttttttttgagagggaatctcaccctgttgcccaggctggagtgcagtggcgcgatctcggctcactgcaagctccgcctcccgggttcacgccattctcctgcctcagcctcccgagtagctgggactacaggcacccgccaccacgcctggctaattttttgtattttttagtagagacggggtttcgccgtgttagccaggatggtctcgatctcctgaacttgtgatctgcccgccttggcctcccaaagtgctgggattacaggcatcagccacggtgcccagcccaaaatctgaaactttttgagcaccgacatgatgccacaactggaaaattccacatgtagtgttatgatgggtcacagtaaaaatgcagttaaaactctgtttcatggacaaagttatttaaaatattacatacaattatcttcaggctatttgtacgaggtccatataagacataaacaaattttgtgtttagacttgggtcccattcccaagatatctcactatgtatacgcaaatatttcccaatccaaaaaaaatctgacaactgaaccacttctaggcccaagcatttcagataaggggcagtcaatatgtatgaccttcagatttgatagtatttcaccatatttgtatatatgtgtgcgtgtgtatgtttgtgtgtgtgtgtgtgtgtgtgtgtgtgtgtgtatttggtagacactgcttaccaatgttaaaaacagatttccaacatttcttgaaacaaatattagatctggcaattttagtcccatatttgggcttggcaacaatgaactagaatgtaacaagcagctgcatcatttagataataaatatcctctacagaatctttttttttcttctttttttggtacttttagtccactgttgtcatttatggtctctgtctttctcctgcagccatgtgaccttacaacaccagacaatgaatgaagagacagaaatttcaagttcagacattgatttctcaccgacattagtaaaataacaacagtgacaataatagctgcaaaaacaacaataataatggctggtagtatttattgaacatgacatgccaggtattatactaggcaattaatagacattgtcagatagaatcctcctccatgacctagaaaacagccttagcttcattttatcaatgaggatagtgagatgctaaggggcaagctgaaaacaaacagaaaggtcttcccctagtctgcccaccatcagagtcctcactgccatctcttcattacaaggcgacatccctcttcactcctccatgttcctcccagcctggatttagacccagagcacaagacaaagtgggaccttgggcaactgacataacctttctgcattttgctcctccactcacaatggacttcagaaataagagctgacattacctccagggtcacatgcgggcacatgagatgatgtaggtcaaacactgaacttctcagacacttttcacaaatggaaaatgatctcatctgagcaggcagagaatggctggacaaaggctgacacatctggagtagggaggcatggaaaggactgaactctcttaaggtaaataatggccttgtggcttttgctagcacccaccctcaaggagccctcatctagggagagcatgtctttgtggaactaatacaaatttggctccatgaggcttgcctagcttcgtgccagttaggtgatattgaaaggatgcaagtcaatggaaggtttaagaatcagctattgtaggccaggcgcagtggctcacacctataatcctagcagtttgggaggccgaggcggacggattgcctgagctcaggagttcgagaccagcctgggcaatatggcgaaaccccgtctgtactaaaatacaaaaaaacaaaaaaaaaattagctgggtatggcagcatacgcctgtagtcccagctactcaggaggctgaggcaggagaactgcttgaacccgggaggcggaggttgcagtgagccatgatggtgccactgcactccagcctgggtgagaaagcaagtctccttctcaaaaaacaaaaacaaaaaaaagaatcagctattgcaggcctagcactctgccaggccaggagttggcaaacgttttctataaaggtccagatactaaatattttaggctttgccggccataggtaaacaaatgagtatggccatgttccagtaaaactttacttacaaaactaggccagggcccacaggtatcgtttgcccacaacccctgtgctaggcaccatggaggcagagcagaggctcttcacagtcatccggcacaatcaccaggggcaaagcatgaagcagcctgttggattccccactctggtagccacagtcctctgaggtaaaggcctggacagcaagaatgacttaagcaacagactttcttggtggctccagccccagactcaccccacagggcatgaggagagtgagcctctctttcccatgaatggttcctcccagcagttgtgcaggcctgtccgcagaacaggtgaggctacatggccttcaaccacgtgatgtattggctcctctgactaaatcaaagtccacagatgataggcctacaatatccaagaagttgccaaacaaagatgcttaaattgatacagacaaaactaaatacctctccttcccttgtgcctgctttgactcccctagatgccatccctggtgccacttcacactgagctatctccttgcacttgaatcccccatgtctcattaccatgtgtatatcccaagacggggtggctcctgttgtaggccacatatgtttggttgttgtttgttttttttgagatggagtttcactctgttgcccaggctggagtgcagtggtgcgatctcagctcactgcaagctccgcctcccaggttgaagcaattctcctacgtcagcctcctgagtaactgtgattacaggcacccaccaccatgcttggctactttttgtatttttggtatagacggggtttcaccatgttggccaagctggtctcgaactcctgacctcaaaggacccacctgcctcagcctcccaaagttctgggattacagacgtgagccactgcgcccggccaggccacactgtttaaaatctatgcagtccttctttgatatgataaccttggggttgtttatatttcttccaagtgtatgaccaacaggatgcagagaagcaaaagttttcttactgttttgtctgttaacgtaacctcccattgtctttatgcttttgtttctgttctcatttaatcctgttttccttcacaggattaagtctgctcatttctaaactattgtctgaactttaatattctaacatgtcttagtgtcatgtttactcttcactgtttgactttctgagtgaaatagtgaagaatatgagagtggaaaaggtatttggaaagattctaggttttaaaatttcagctttagttgatccttcctacctgtgggaccttgggtaaatgagtgaataatctgaacttgaattgcttcacctgcaagacaaaggtaagtatgccaatctcgggagaggtatcatgaggattacgagttaaacatggaaaattcctcttccaactcaataataaaaacacaaaaaatccaacttatatgggcacagaatctgaatagacattcctccaaagaagctatacaaatgaccaaggggcatgtgggaagatgctcaatattagctatcagggatgcctcacccaaacaaaaggacaatgagataccacttcatgcttattgcttattcggatgactataataaaaagttacaaaataacaagtactagtgaaggtatgaagaaactagaatcttcttacactattggtaagaatgtaaaatggcaacgctgctttgaaaatggtctggaagtaccttcaaaaattaaacatagggttaccttatgacccagaaattctattcctagttatataccctagagaaatgaaaacatatatccacacaaacacttgtaatattaacagcagcattcacagaacgattattcataagaagcaaaaagtagaaacaactcaactgtctatcaaatgatgaacagataagtaaaatatggcctagccatacaatggaatattatttagcaataaaaagaagtttgtgaagagcaaagaaaacaagcaacatagtgaagagacaatttacaaaatgggagagcatatttggaaaccatatatcagacaggggattaaattccaaaatacataagaaacccattcaactcaatagtaccctcccctgtaaaataacccaattaaaaaatgagcaacggacccgcatggatatttttccgaaggggacatacaaatagccaacaggtttataaaaaatgtgaaatatcactaatcttcagggaaatggaaataaaaaccacagtgaggtatcatctcacacgtgttaggatggccattatcaaaaagtcaaaagataacaagtattgctgagggtgtgtagaaaagggaacccttcttggtagaaatgtaaacttgtacagccattatggaaaagagtacagagtttcctcaaaaattaaaaatagaataccatatgatctagtaatcccactcctggatatagaaccaaaggaactgaaatcccccatccaaaagagatatctccactcacatgttcatcgtagcattattcaaaaccaccaagacatggcatcaacctaagtatccactgacagataaatacagacatgcgatgtatatatcaataatggaatacgatttactctttaaaaagaaggaaagaaaatcctgccattcgcaaaaacatgataaaactagaagacattatgccaagtggaataagccagacacagaaagaaaactactgcatgatcttacttagatgtgtaacctaaaatattcaaactgttagaaacagagcatggaatagtagttaccaagggccaggcatgggggaaatgggaataatctggtcaagggtacaaactttcagttataagataagtaagtgctggcactctaatgtctggcatggtgactaaggctaatgataatatattgtatacttgaaatttgctgagagagtagatctttactgctctcaccatgcacacacacaaaaggtaactacgtgaggtaaaggatatgttaattagcttggttgtggtaaccatatcacaatgtatacgtatgttaaatcatcacacagtatatcttaaatatatataatttttgtgaatcataccttaatcaagctgtaaaaaaagaaatgaagtgcggatacatgccaaaagatgggtgacccttgaaaactttatggtaaatggaaaagacagtggcacacaccaccacataatgtatgatgccatttatatgaaatgtccataacaggcaaatagagacagaaagtagattagtagtttccagggttatggaaggggaggaatggggagtgacagctaataggcacagggtttcttttgggggtgatgaaattattctggaattagattgtagtgacagttacacaactctgaatatacctgaaatcactgaattgtacattttaaatgggtgaactgtatggtattttaattgtatctaaataaagctgttactatatggaaagttcttagcttcatgtctgagacaaaggaagaaataaaaatggtcactacggttatcattcattcacctgcattttaaaaatgcagtcggtttttctagagacttttcacccctgttattctgagaattaaaatactcaaacatatgtgtggtgaggtctagaagaggaggattattgtagcctggagtagttagaaaagccctcgagaagtttaaacagaataaaggaggaggcaaaggagaaatcaccaaaggcagcaatctgaaagtgaaaaggtgggaataatttggttccctgtgagagccataaggaggcaattcgattaagcaaatggctcatgaatgcaagggataagttgaagagaaggcaaagttagatttccaagggtcttggaagcataggccaagatgtttgggcttcctccagctttggaatgtcaggaactgaatttaaggaaagccatcctgccagtttatgtggtacaaaagggactggctgaaatcagaacccaggaagtatgagttagttagggcctgaagaaagataataagaatggaaataggaaagaaatagcacaaaatagtggctacttctttttttttctcccccacacccccccgcccccggacagccagttgttctaaaggggctatttctttatgataaaggtgacagaatacagaagaaaaaaaatctcccttcctccttcatcaacacctaacaaaaggaacaataataaccataaaatcatggttaaaaaaaaaaaagggaaatttaccagtaagctctaaataaggaattaagcacaaacttgtgccataaaattcaaaagaggaaactaattaaaaaaaaaaaaaggaaggcaggaaggagcgagggaaggtgaaaaagcaaataggagatgattttcatgcaatttgaagttgcatcaaaatcttccacctcaactgtcagaaacagattggagaaagtatttgagttgacaaaattatgggatttcccttcaatattccccacaatcaggagacaagtagactgaagtcatgattttgatgtaggatttttcttctcagtcactttgcaagctgggaacccctggccagtgatgcccgtaccaggccttgcttggccatgctggtgtgctccagcttcttgtgttatagcttgtacccgtgtttggtggttccctgagctcttgtaccatgcccaagaagaatgaggatacactggacattgaagggtgaggagggcagggaagaattttactgagtgacgaaaacagtttttagcgaagaggggatatggatttggtctccctacctgaaggtgagaaagttcccctgtgtggctgggcctggggccttttccagacttagaatgggaagtgcctgctgatttgtttgtgagtctgcaaataagtctaaagcaaagacaccactcaaaggtgggcacaacagtgtagaaaaccaattaggaaagcgcaggtatatgtaaaacaggtgaagggtggggaccaatcagaggagagcttaccaaacagaaagggaaattctcaatccagtctgaggatttaacttgtagcttggctttcaggctttaaactctcttccacttgaggtggggtttcactggggacccacccctatctgcctaggcatttgcctgcctcctgttgctatcaatttggaaaccttggtgaagccccagaaaaccctggggagtacaatcccagaacttcagcccagccaagaatagcaataattatgacaggggcttggcaggaaaaaagaattgatagaactagagaatgacagcatacagaggacgaacttcaagaataaactggagatgacccaaagtttctagcctggatttttcagaatgggggtgataccagtaagaccaggggtcagaataggggaacattttatggtagaagggcatgcactctgttatcagataaattaagtttgagcaactcatcccttgaattcgtatgtctgtataaacctaacctagtgcctctcacgtagtaagccttttataggtgtgtgcaggagggatgaggcatataaaatttaattaaatatgaacaaatgatggtaacaataaactcagattttaaaaaatggttttgtttcaaccactgtggagtcaatagactctatgagacttaaaaattttttaattttaagctgtctcttagatattataaagccacagtgagtcatcttgcacttaaaatccagaaaagcctataaaagaatagaaaacccgaatacgtaacttcctcctgtgacagaagaacaaaaacgtcaacgttcacagcttaaagacatttagcacctcaaaaagatgtatcataggtaagtttctatacttgaatgatattatataatcataatgcattggaaattaagtcaatttacaaaaaaaacccctcagaaatgcaaataacagtgctttgtaaaactgtatggcctgttttctggaaggtactgtgtgattctgggactggacttttcattaaaaagataagagattcaggcatcagacatgttcaattattggctccctaatgaagttcactatcctgtctaatggatctttccttttcaaaagaccccttcctccttgtgtattctggcattgcgtgtctctggcatttgctctatgagaataactggacagtacaatgctcttgaatacagagagctggagcttgaatggacaccatagccccaaggacatgaaaactattttttgattgtgtgtgtgtttataaaacttcttgcataaaatcagtctttgtaatttcctagacttcaagggcattcttttcaagttggggcttcttaatgtggcccttaaaaatcctaaaattaaatgcatttttaagctatctgtgtaaatatattaaaaatttccctcattaggaagttgccagtttatggcaaagctttcagaggagtctgtaacacaaagtggatccagaaccacagcatgtagacccctaaaaattaaaaacattgaaacctatttagcaaatctgcatgaaatgagccaaattcatactgcttctgtggagttggttcctggaaatctaggcatttagtggtggagttacagatggatctcaatggcctgcgtgattttcccagcctattgttttcgtatctgattaattattctcttaaaatttccatccataaaaaatttccaaagatattaggatctctcttcacatagtctttccttcttttgaatgatgctattgttgtcactttgaaaactgtaaatagcattcaagatgatatttaagtttgtgccaacatttagtggaaatgtctaagttttgaaatagtagggagctcacattccatctggtgtgttttcattttatctcctattctcagtgaattttaaaagtcagctgcagtgtcaataccctttctgctatgctaatgtgacctccacgtggaaatcaaaggaaaggagttctcagggcaagtgattctttctcaattgaactatttagtgtcatagaatcacaaagtatcagagctgaaagcaggcttacaggtgaccatgatgaatacctctcagtttgaagggaaactgagcctcaggcagagggaactgcccatagtctcattagccacagggacaggagttgaacctcgataggaagcctttctgatggccccatatcaggtggtcacttccttccccacacttccatggccctttatcagagaccaccatcccatgttacttagcggtttcaactttgtagcacagttactgtcactaatttcttacccatgtgtagcaggctaatatttcaaagtaatcactggtgtgccatttccttcctgaccatctcttggctaaagggaagtgcatctattgcttagcagtagtctccttcactcaccagcttagcctttaattcaaaaggcgctgccccagtgtgagagagaaatgattcatgcagggataaggacacagaagagttctaactgcccacccccagagtttaaaatagagtttcaagctggataatggacagagtcaagagagataaagcaagaaagagtgcatgtgtacatgagtgggcacgtgcatgcatgtgtgtgcatgtgtgcactggggcagggtgtgctctacccttgccttttccccaacccccaggctgaatcctgaggttgggtaatatatgagttttctatttgctactataacaaatttccacaaactcagtggcttaaaacaacacaaatgtattatcttacagcactggaggtcagatgtccaaaatgggtgtaatgggttaaaattcaggtgttggccagtctgcattcctttttggaggctctttgccttttccagcttctagaggctgcctgaattccctggcttatggctcaattccatctttaaggccattgatggccagttgaatctttctcatattgcatcactctgacactacttattttgcctctctcttccacctctgtgattatattgagtccacttggataatccaaggtcatctccttatcttaaagttggctgactagcctctaattgaatcttctactttaattctcttttaccatctaacatatttacaggttctgaaagattggtacataggcaccatttgggaggctattatttggtcttccacagctgactcactgcaagccatccctttgaatttgagactctaagagtagattgaatgtgcattcagctttttccatccagaattctggtagtacacagctttgcaaagagaataatgaaggactatagcagcaacatgaatgtctgctggaggcacctaatttcctgcaggtcttagcaaagtatgtaagaacagacaagttttttttgagcccatgagaagaactctgacaagctggcaaaggccaaagagtaagtgtccttcatgtgcttgtgacaagagactatgtcaggaccatggacacctctaggaatgtaggaggccaaaggtcaccatcctgcaaagaatgatggcattccttacgggtatcagaatggaccaaagatgcacacaaggaccaggcaaagtggattacttggacaccagaggccaaggaaacaacagccaaggacaacagaatccctgcctaccccacacgacatgttgctcattaaggccccagaatacagaatctgaattgagagattataagccagaatatgactgaatgaattacaggcctgaactgacagaaacggcactgaacttgctgagcaaaacctggcccagggctgatgagatggtttgctttcacagccagaaattcaactgaactttgggagtcaagaacatttcattttttaatagtccaactggtgactgtgaaagtaatcattgttatacttggcactcaaatgaacctcagacacagcaagagttgacttggtgattgagaagaaactggagacaagacaaaacaaatgggaatataaaactgtagactatcacatcagcacaactggctagtttatttttatttatttatattcctttttatttttttgagacagagtctcgctctgtcacccaggatggaatgcagtggcacagtctcggctcagtgcaaactccacctgccgtgttcaaacaattctcctgcctcagcctcctgagtagctggcactataggcacgcaccatcgacccagctaattttttgtatttttagtagagatgaggcttcaccatgctggccaggctgatctggaactcctgatctcatgatccgcctgccttggcctcccaaagggctgggattactcgcatgagccactgcgcccggccctactttttatttttttaggtggagtctggctctgtcacccaggctagaatgcagtggcatgatctcagctcactgcaacctcctcctctggggttcaagtgattctcctgcctcagcctcctgtgtacatgcgattatgggcacgcaccaccacacctggctaatttttgtatttttagtagagacggggtttcaccacgttggccaggctggtctcaaactcctgacctcaagtgatccgtccgcctctatcccagggagtatctttatttttttttctaacaagtcaaagagtagaaataccaaaaaagtcacctctttgggtgtttcagctacttagctagctcacacacacatgtatttcccatgaggttttgatcaaaactaaagtcaatttttttcactaggttcaccaaacaactgccagtaaatattggcttctgccaatgaatgaaaaagaacacaggatgtctgctcttaaaaagtgacccctgatgtttccttcacattatcaaattattgcatactcattatattatgtttgggaaatgcaagagaatatgaagaaaggaacaggagtgtaacattctatttgaagctacaatctctcttaatttcaaggtacatgtgcttccattccattctccatttatatgccactctttccattcaatattatatcccaatgtattttttcccagtgaatttagaaagcttattttgccaaggctgaggaggtgcacctgtgacacagcctcaggaggttctgaggacatgtgcccaaggtgatcagagcacagtttggttttatacattttagggagacatgaggcatcaatcaacatacataagatgagcaatggttcattctggaaagatgggacaacttgaagcaaaggcaagaagactctaagtggggagggagcttccagggcataggtagataggagacacatggttgcattcttctgagtttctgactagcctctccaaaggaggcaatcagatatgcatttatctcagtgagcagaggggtgacttttaatagaatgggaggcaggttgcccctaagcagctcccagcttgacttttccctgtagcttagtgatttgggggccccaagatttcctttcacatttcccccccttctctttgaaaaaatcttttggaggaagcattttagaagaaaatgagtctctggtctcaggttttgtctcatctctcatggctaggatggcttattcctagatgggtaggtcttgagttattaggtatgttcatttttagcaggttgtaagtctcatgttctataaagaaaaaatagggggaggaaggaaaaaacaacaacaacaaacaaaagaacaagcctgtaaaatccatataggccatattactctgaagtccatacatcagtaggcaggtatgaaagtggcttatgtatgtaaataggttgctgttatctttttctgaagtttccgttgtctagcttcagttcacttggctttacgaaagcacagcttagtttttggtgactccaaattaggaaagatgggaaaaaaaagaaggaaaaaaaattgaaaacattgttttgcagacttgtagcccagaaaaattagaattcattccaaaccacagaaaataataaaaacaggcaagactagaatctaacaacaggtatactacagtttttgaaatataacttttctctctccagtttcccatttttactaatgataaatcatggtaggactaatttgctttattattcttggtctgattatttgtgtacagtgttatatcattaatattattcataaaaactcatttgatggctacatagatgaatatatagtattaaatatattcctctattatttggcatttaaattgtttcccaggtttagatttttcaaattaattagatcagttgtccaagttttatagacacacactcacacacactctgatgtaaactggaaccataatgcaggtaagagcattttgaacgtagaggggatgacacagaaatgcctggtattctctgggttgggtgtagacacagttccatacatgaaggtgtgtgttgaccagcctattttggattgtctatcttggagagtactggtgggccttttaggggagcaatttatcaagctaattttcagggagattccagaaacgggtacaggggacagagctggccttggtgatttgattctggagttacccacaaagttccactgtgcctctagactaagcctcatattccagctttaaaatcccattcttttctcagcaggctttgttggtttgaaaaaataccttggcatctcaggaaggacaacaatttgaactactattgtaataactgaggtaaaagttctttctcagggggaggttttgacaggaggcaggcagtgcccaagaagtggggagacttgcagctgataaaggaaagccacggacctgaggattcggagaaccaggctttgaatgcagggggctggggaagtgccaggttcagctcaacagtcatttcttgacaacctactctattatgaagtggtattttttgggtgccgggaggcagagacgatgaagatgagtaagatgcctctggtagttcataaaggcagcagagagaaaagaacccagactctggagccagacagcctaagtatgaatctcaggtctgtttcttactctctctgtgtcctcagaaaagttttcaagtctgcctatgcctccgtttctacacatgatggagataaatgtaccttaatgcccaaatgagcacttcattgtatctactaactcatcagtatgctaatgtcattatcatatcacagtctccctccacatttgaggtatctccaactaatgaaaattttgtttccagcctctttcaaggagtccaattcagccttatcccagatcaccaatagatgaaactagcccaatgccccagggaaagaaggtaaatggtagacaccgcatgtggatggaaaataatttaggaaaacaagtgcagttgtttattccaggtcacgaaaaggaaattcagcctcagtcttcaatatcaactgatagggtcaagattaccagagaagccagctgaaatttcatatatagatttgacctaaatgtgcaatgtcctttcaataactctgaagagcttactaagagaaacaattttttagagtcgctaaaaggaaattcagcctcagtcttcatatcaactgatagggccaagattaacagagaagccagtgaaatttcatatatagatttgacctaactgtgcaatgttctttcaataactctgaagagcttactagaagaaacaattttttagagggaaaatatatgttggagcaaggttacatttccgtgcaaagggaatattctatgagttccttagttaccactaatgtaagaaggatttccagcaggtactggtgcaactggcctacaagatatttatggtccattaagagttgtaagcaagactgtttctttttcagaaaaaaagcaattttctcttaaatattttagtgtgttatgacatgaatacactatagggcaagcaaaagtatttaagtggttcagcacacaaaaccagctccaaaaggatgaccttgggaattttagaagcttggctagagcatgttgatgacttccttgtgtttaacaaaaactataaaaaggagttataataaagtacctagatggggactactgggccatatcctaaaagcagagaaaattcctgactttgtaaaatgtcatttctttcactgtaagtctaaattactggtagtgtgtctaggacttataaatttattggaaatccagtgtgtgtgttgtgtgtcgtgtgtgggtgtgtgtgtaaatgtctctaaggttgaacagggatatgaaaaccatttgggatttagtactggaagtcccagtgtctaagaaaatcgcttttctccctatacatgggttttccataaaattgaaggataatattttccttaggctaaagcaaagggtgatagaaacagggacggctttgtagtcaaacagactttgatataaacaagctttgccatgagctggttatgaggttttgacatagatatttactctctgcaaatttagtttcaattcaatggtatgaatgatatgcttggcacctagcagacagtccagcccaatgtgtattctcattgacagtaataatttgattattattctcaaatattacatttatttaaaatagatgtattactagtctcagtgtattctcaatgacaataataattgtattatattattatttttcattagtgctctccctaggagcaaagactgcgaactatagttgtttatgaccactaaccttacactagaagcccagtatgattgggtatttttcccccattttaaatatgggaaacataagatactgagatttaaatagcaagttaaacattaaacagtttgcaataaaccactatgttgactcaaggtggagagaatttagagctacacaggtataccagctatttcttgatttccttgattagaaagaaaatctggcatcattcaaattcctattctaaatctggggaaggtcataacagtctccacaaacagctgcttgccagtaagctgaagcagtttgaaagcattctagagcaaaaccatccagaagaaatctaatgcatgatacatatgttattaaaagtgtttggtagcaacaccaaaacaagtacaaagaaacaggtgaaattaattttagtgatataatttttaactcaacattaccaaaatattatttcaacatgtaactattataaaacattattaatgagatatttactttttttttggtagaaggctttgaaatccaaactggattttacatttacaacgcatctcaattcagactggtcacaggtggctagctgctaccaaattgaacattaatggtagacgtcaccccgcagtgacaaaaatataaccacatttgaacactcaagccgggattctaaacatcaggctatgtttccaggactctatgtctccaaaagcaggcaacttggaggccttaggattccttcctgctggcatgtggcacatgaatgaaccttgctccaagctaagaggttacgggatttatttatacaggttgtttgaattacgtgtatcattcttttgtctaaagaatgacaggtgataatttaaaaataaaaacatttacaaatgctttgggactttaaaattgtattaatttttatcttctgtttccccctaattcttgcttattttgattttcttcattaaaagagagataaagttaaatgtttgggggcttttcactttggggccattataatttatattgagggaatcgtgtcaatgcttaattcatatctgttttatctttacctagtttatccatttctgatcataatttatttttccaatagtctttttttttttctatccttaatccctatactctcatttctctaagtaaaatagatttggaaaaactactgaggtcttggtagtttgctttagcaggttaactccaaacttatcaaaactttttggacaattttaagtgactgtttattaatagctatgtcaagaaccttgaatgtaaacctaagatttttttaaacactgaaacagcccattattcaagcactgtagttaaacttaggtttcattgcagcagccactgtgagactgagagcagaactgtgagaagcaggtaggaagacagatggactccagcaacaaggacacctcggaggaggcattttcctccttcaccggcaagcaccttagagctttctgatggaatgtatctggttggagcgagaattcactgtggagggcagataggactctgcacaagaaagcctgattcgtgaaataatgagagaggaccacatggagtggtttgatagagtggatttactatggatgctatggatagagtgacacgtgattaaatttttcttatttctcactaacatgcgattgaacgtattcaaacaacataggagagcaattttgggaaactaatctagggtggcttacctcaaagcaaactctaggaaaaagccatggcatcctttgccttgaagctcaacctgtagatacctgcatcctcctcatcaagcactcttcagccttctttcattacttttcctctttagtgtccaatgacttcatgatcttccttggaggctccagctcaccatcactaccattatagccctccatgcttctcaacattcctcatttgctcagctctagcctgggctgggcacagtggctcatgcctataatcccagtactttgggaggccaagccaggaggattgcttgaggctaggagtttgagaccagcctggacaacattgcgagacctgtctctacaaaagcattagccaggtgtggtggtatgtgcctgtagtcctagccactcaggaggctgaggcaggaggatcacttgagacccggggtttgaggctgtagtgagctatgattgggccactgctggccagcctgggcaacaaagtgagaccctgtctcttagggaaaaaaaaaaaaaagagttaataaaatgactaacctgaatcatatattgtgacagttaatattgagtgtcaacttgattggactgaaggatgcaaagtattgttactgggtgtgtctatgaggatattgccaaaggagattaacatttgagtcagtggactgggagaggcagacccaccctcaatcttggtgggcaccatctaatcagccgtcagcatggctagaataaagcaggcagaaagtggaaagagctgacttgctgagttttccggccttcatctttcccctgtgctggattcttcctgccctcgaacatcggactccaagtttttcagcttatggtctcttggacttataccagtggtttgccaggggctctcgggccttcagcaacagactgaaggctgcaccgtcagcttccctacttttgagattttgggactcggactggcttccttgctcctccgcttgcagatggcctattgtggggcttcaccttgtgatcatgtaagtcaatactccttaataaactctccttcatatatacatctatcctactagttctgtcctgctagagaacactaatacatatattatctgaatatttgtttctgtgagaaaaatgggcacaaataacttttaaccagataaatgcttttctgctaattttgtgtctctcttttgaggaacatagagatttagctcagtaataatctgacataggatagggtaaaccagatgcttacccagctttctcattactaaaataggtagtcaaagagcattcatagatacagagggagcatttgaggtcataggtcattaaattagcattactatatgcttatttgttagttttatcacatctggttctttgaataaaaagtctccattaatttagaagaacatatcaagttgttatcttattctgagtgagagacaccaaagttttcattccaaaattctgaaatacccagaaacttaccactcagtgggaggacatcagtaaacccagaagacaaaaagctaattaactgtctcactgaaacattccttcctttttgaaaagtcaactagggacccatggactctgagcccattgtcaaatgccgtgtgaaagagatccaagttcaacaacaaatatcatcagcaatataatggttctctccagccctcagggccaaatggcctgcattttagcaagttgattttgctcatgaattgtgttaagccaagcaattgtttcccatgacatgcttgaacccacagttgctttgtctatgaaattcatggttgaatttgtccaattgctgattgctattcccacttgctttagtaatagtcacttccttcatcagtaatgggttttatatacagtgcacagtcacaaccattcaatgtcacccataagcatttgatgaattgtccaatacagttatgagagttggttatttgggatacagctagggtaagtcttactgagttaatgaaatgatatgacattaggccatgggtgtttcctcccccacattggctatacacactcttttatctaaggacgcatttgggtcattaccataatcttcatcaacttgtcaagataatgaagggcccattgagttcagggaaggcttggcataattcatgaaaatttaaagaacatagatgtagaaagagtttgggagctacagataaataagatctgcatagacaaccacaaaggaagagcttcagcagacaatctgctttggaagggggagagtttgagctcagttttgagacagaagagaggctcatactctgaaatgtctaagacatactgctggaggaacagaaggtgaaaacaaacttagagatgataatcaagattggaaagaaaggaagagtagctctcgagcctgctttcagcaaatcctacatctgtatttgttatagccaccacacaaatctaggtttggtgggagggggcaagttagttatcaacttcgacatgtgcctatcagacttgcttagcaatcagacaaggtttataattgcttccgctaacctttccagagtaccacaatttgtagccttctgcacactgatttctgaccaaaggattctgttccatcaatgccccattaaattcacctcagatggctgatggcaccatgtcgaagtctcacccagtgtggctatgagttagtgaattgaccgtctgaagagcaatatatagtctccttttaaattatgttagaactagcagagaatttcaggttcttctagttcaacaccttgtttttttttaaatgtgttcattcattttcaaatattcactgaaggtccaccctaggccagattagatccctgccctaaagactgtaacacataattgggggatgcaggtattgaataataaagtaataaattatgtcaagtgtgggaggtgttaagaaggaaataggtatggcgatatagtagagttactctagaggggacagaggattaactattacagatgaaatcagagaacagtgaaaaggaccctttgaggaggttctgcacatgtatcccagaacttgaagttaaaaaacaaaaaaaactcacctggggccagagcactgtaaatgaataggcagggagattaaacagatgtttcagttaaacagcatgcccagtataccagacagaagatcctggggaatagtaatctttgagtagcagagagaagaggagcagcccatgaaataggcaaggatcttaaactccaatgccttcaggagctatgcatgcaccattagccagtgaagcaagcctaggtagaaggcagtcgtggcaactgtataggcctagagaatgagcaatatgcctaacagcattcaaactcattaaaaaatactttacagtcacaataaagcaaatcaccaaaaatactttgcaggcaaaaataaaacacatgtgaagaggcaagcaaagcccaaggaccatcaatatgcaatgctgagctgcaggaaaagcaggaagtaggctgggaatgagaaaaaaataaatacagtgtggtttcctctaagttaaaaagaaaaggttttaccttttatttccatgaacttaacaatgaaaacaatatgtttcactaggcagtcacccaaacattgcaatactgatcacaaaaaaccccccactatttgttacagaacttgtaaaacctgaaaatggcggtaatgatcaaatgggtcaaatgtgtaaagagaggcaccacaaatccaagtggcccatgcactgaccaaatgtagatatcctcttgaagaattgtggccatgtgctctgtgcttgagtgaatccagggatgggaagctcacccccttggaaggcactctttaagtgttcattttttttcactttgacccgttattatggagagctaatgatatctgccactttgtagtccgatactcacagatctgccctctggagccacatagaatgtatttaatatctttccacctgccagcccttcagatatttggaaacagtgactctgttactatcttccctctacaagtcttcctttttccaggcaaaacattcccaccatcaattagtctccaaatctgttttcagacccaaccacctttcttatgaaccttcttatttgtcactaaccatcttaaaacagtgcctagaaagaacacaatgttcctagccaatttatactctggggcttctttaggcataattttctatgtctgcagcagtagaaatacaattacattttatggagctcagtctcctgctgttcctgtttcctacctcccaccctccaaggcagtctgtttgttgaatgtcctgaacagatgcataatctagagcaagtgctcccatcaatataaagaatgccatccctcatcactccatcgcttctgattaagatcatttggtctaatgtacattaagttctattccaataatgcctgtgcggtactgcatgcttttcatgcctctttctggacactgtgttattagatactcagcctggagaaacatttccatacaaagaggaagataaaactgagaatgaatggttaaaggcaaagagaaaattgggaatctcacccttggaaagaatggtagatgggaacatccaatgacctggctttgaatctggttctctatttactaaccattgctacttaaagaaaaatagtaataataacagtaagaacagaaactactatctattaacaaattcttggtaagtaccaagccctgaaataagcctttcaggctacaatatcatatggttagtagatgccactgggatttgaacttacttctgcctgtttctagacttcaatctctacatagtcttgtaccacaatttcccttagtggatactgtctatactacatatgacttataccactgatttttaaaaaaagaaaaactctcacagtaattacttctcctgagatgatcctccaaaatgtgggaagtagaaacatgtgttttcttttctgtggggccatcagagcatgcagacaagggcaaaggaataagacaggagagagaggccatacaccaaccacagcactgtacattgtgtcttgaactgggctgaaaagtaaccatgcagcttcattttaagcacagttggaacatcgacaagatttcaaggtgactgttcagcctaaggaaacagtgttttcaagcacttttatgctactttagcagtatttactagtatataattcacgtgctaatttattcattaaaacagtcgtatttggcaacattaaccttagtttacattagtgagattggtatttgtattttaattacatctctttataattactctataattctgattttcttccaatgtgaactaagcccttatcaatccccaaactgcattccacatccaacgaaaatgagttcaaattatagttttacagaaaatggctttgtaaaacccagagagcctattcccaaaggtagtcatgcatcagagtctcctggggatttccttatacaatgactgattcctgagtgctgtgcaatctacttgatcagaatctccagcgacgggacctcctgggaattgagacctgcagcaactggtccacaaatcagcacttagggactggtgactagactatttccactctacacacatccagtacagctcttggaaaacatacaaagcaaaagatagtaagggttatcctaaaggcagaataaccagccacctcacggaatccaatgtgttccagaaacattaattatacgtttcattattaactgctgacctattgttctttattttcagggtttgagttgctgttttaatttcatcactgcaaagaagccctatagacacacacacacaaaaagatgcatagattttaactggtccctggaaacaaggtagagataatcatgtggtttatttgatagagccacatgataaacaatcgagataaacaatgtgttttaaaaagcattctcaaagagttagaacaggaatgtcaaaaagacggcaaatatgatacctacctcctatccaatgcccttggcaggcgttgctaatcaatcacagcatttttccttgcatccacaaacagcctcaaagtccatttaaccaatcactccagggcactagtgctatctaatctgctctaccgtgtgggggacatactttctcctctttggctacaataaacaggtaaattgaaatcaccttataacagcctgatccatgacaggctgtatgctccacaaggtggaaatgggcatctgaaagttctcatgtagacagggctttaggcgcagatcacctggctcttgctggttcatgtttgtagtggtttcacacttgtatctttgaatgggagtacttagaaataaattaactgctttaatatttatgatatgtgagttacacttactcaaaccaacctagtttttgctcatgataatttacagtttcactttgaataaatgctgttgggaaagacaagctgagttccaaagtgttttaaaaattaagtgtagcatttgactaaaagaatcatatatcaatctgcttgatttccagtggtagcactgtaggttttcttctatggagattctgggccatatctccatgcaaatatttactgtcctggtaaatgacaggatagaaatcacaaggacacttggtttctgctggttttcatttgaaaaagaaaatcattataattaattagtcatgggttcccacgatggccattcttgactccttggcctctattgccactttccaagtctggctaaatagaattccatttcagaccatatctagggtaatacttgattcattaggttgatgtcatcccaccgacagtccccgtgatcaaacaataagatcagagagaacagacccacctcctcatagatgctgtcattcctgtgaaagtctccagccttcctgggaagaacatggacgtgaacgtgctgaaaatgtacaagaaagaaaaaaaatgtgattatctccccatgtatttttagacttgacagtgatgctctcatgaagcccaattactccacgatggttcctgctgggttatttttcagaggaagttgatatccaccttcggtaactatacctgaaatctgccgagaagagagtgcactaagcaagagagaacaacttggggtatatatgagagttggtgcgaaatgctagagtgtttcagagtctctgtggaattattcatggttgtcagtcttggttgtagttagccagtgctttgaaatgacagtgcatcttcaaaggtgaccatcatgactctgaaactgacaagaaataagaattggctaacagagaactgcataagtaaagagcgagtgaatgaggtagcaagtagtatgggcagaattacagacttggggcttcgaaaaataatcatataatagtaatacaaacagttctcatttagtaagcatttatttcctatgataaggaaagctctgtgtttggcattcttcatttagtactcttaaaaatcctatgaggtggccgggcacggtggctcatgcctgtaatcccagcactttgggaggccgaggtgggcggatcacgaggtcaggagatcgagatcatcctggccaacacggtgaaactccgtctctactaaaactacaaaaacaaaaacttaggaggctgaggtgggagaatggcctgaaaccaggaggcggagcttgcagtgagctgagatcgcgccactgcactccagcctgggcgacagagcgagactcctcaaaaaaaaaaaaaaaaaaaaaaaaaaaaaaatcccgtgaggcaaggtctactatgatctccactttacagaagaagatatcaatgttcggtgaggacagggcgccacaggaagtaaaagtcagcaccggaaatgaggttgcctggctttggctcctgtgtttcattagcacatgcactgattctgcgaacttaatcttttaaatagcccatttctctagtctactaaagcacccaggtaatatacatagcaatgctattatgcaatgatggtgaatcagggctcagagcatatctaattcaatatattcttcaaagctaaactgctatttgaaagttttactttccaaatagcctctattgtacctcggctgaagttaaacctcatttctgcccttgagctatgttccacttttattacaaaccgtggggaggaatgcgaaaatgaagagcttaaatagagagaggcagacagagggtcaaacctcatccctgatcacccaccccttcctgattactgcgatcgggttccgaggctccaaaaggcctcaagagaacgtaagatttaagtgtccctgtggcttcgctgtacaaggagggggaaagtgacacgctattaaagccgaggcagggtgcaacgtggtccaaggtgaatgaagcagagaggagcttcaaagcagcccctgagcacagttcccaaagagtgacacgcttttgccagaatattcgccagtcaatgataaagccagtcacggatctctcagcaattgggccaagtgtgcacttcagtcacaaagattacgtgagcatggagagagaaagtgaaagaacaaacaaggaaaaaataaatcacaaactacccatgaaaccaaattcttaggagaaagccaggcaggtgggcctgggctgaaatctactgaaatctccagatgggctgacttaaaagcaaaaccaggaaaataacgtagaacaaggatacagacaacccttagaaggagccttcactcactctttaattccagaatctcctgccatcctttcttcttctcctctttttgtcctttcttctttctgtccccctcctcctttcttcccctcttcctccctcccatccatccatctttcatcatctcccttatacattctaggaagttccagaccagtgtcttccagtcaaacttcctaacacaaatcctggacctaccacaaactaactgtgtgaccttgtctcacaaagtctatgtgtcagtatcttatctatatggggattataatggttgctacctcacagggttgttaagaggattaagtctgctaaccatgtgctgagcattcagctttgcatgtagttagtactcattacctagaactgtacaagaattagttttattatttaaaaaaacaaatttaaacctgaagatcaagtagacatcacattcagggattgatttctgcaccagcaaaaaaataaaataaagatattaagaagctccttgaatgagggcattgttcaagcatctcttttgtgaaagctgatttctgttgctttgactagccattctcaatcttccacctgtacttggggcttattaaaatgcagactgcagggccctaaaagtctgcatttctaacaagctcccagctgatgctggtctaatgccacactttgagaaccactggcttacaatatccacctggtttcttaccttgcttctgccagtgtgggcacggaggtcacttgctgttttgcctgccctactgcattatgtgtagactctttgtctcttttcttgttttttcctcttttttttccttctttccttctatcttttctcttttttcttttccttcttctttccctccttcctatttttttcccttcctttccttcttttctctctccccacagaatctcactctgtcacccaggttggagtacagtgatacaatcatagctcactgcagccttcaactcccaggctcaagagatcctcctgcctcagcctcccaaatggctgggactacaggtgcatgctaccacatcaagctaactttttttcatatttttagcaatggagttctcactatgttgcccagtctggtctcaaactcctggcctcaagcaatcccctctcctcagcctcccaagtagctgagattataggtgtgagctactatgtccagtatgtggagacatctttctgaatgcttctctggctttctgcactctgaccactctccttgcgtggtcctcaggaatatgcctgttagtatccactactaacatatggggggttgcgaacctgcacttgggaacctccagggtccaggtctatcccctgcctactattctttaccctcgtcttctcgatttagttcagggctatctctataggctgtgttaccactaagttctagaaaagccactcttgatcactggtaaccacttgaaattcgccgtgacacactgaaaccgtaaatagctcactgtacaggtggttttttcccgagggcatagatctcaacccaccctgatatcgtgacataaattcttaagtgacaggctgatcacacgatgctgacaacccactcagcttctcagaacagggaaatcacgatagagccagctcaaagcctcattgctgtgaaaaaataccatcactatggacttctaatagaatgacattctgataaaaacgctatgaatagcagagatgaggataatttgatataatctgttcttactgctttcatattaagctgtggtgatcacaacttacttttctaagtgccaacaaaacatctatttaataaaagccttccacaaatttgctaggggttgcagttgagctgcttgagctagaagagtatctttttaaagtcccatgacacattccacaccaaaaatgttttcatggtcaaataacatttcacaatgctcattagcacattaaagtatgagaatttccacacaaaagatgcttgtttaacttcatctaatccagcattccagaaacttatttgattgtggagtcctgattttcctgtttcattcatgtaacacttctgtacacttttctaaagtatacattgattcactcaaaaatatctatttctaggtgctattctaggagccagggatacggtaatggacaagacaaagcctctgtccccatagagcttatattccaatgggtgatgcagaagataagtaaggaaatgactatacattctaattttggatagaaataagtgtcctgaagaaaaacataacggtataaggtaaatactgagcactgggccactctaacgtttgaagtttgggaagagaagcaggactcaatttaaggctgtagtaaggaaaggggcaaaatcaagagagggtaagttccaacagcccagagaacaaatttcaaagagtgtatcactaacggtgtgaaatgtttttgaaagcttgaattgtttcagtaaggctaggagaacaaaatttaaaaccccatgaaaagatgctccacattattagtcattagggaaatgcaaatcaaaaccacactgagctactacttcatacccactagaaaggcaataatcaaaagacacacaataacaagcgttggccagagtgtggagagctggaaccctcctacactactggggatgtaaaatcacacagttactttggaaaacagtttggcagttcctcaaaaagttgaacatggagttaccttgtgactcagaattctgatcctaatacatacccaagacaactgaagacatatgtccacacaaaaacttgtacgcaaatgtttacagcaacattattcacaatcaccaaaaagtataaaaaactcaaatgactatcaactgatcaatggtaaacaaagtgcagtatatgaagacaataggatatgatttggccataaaaaggagtgatgtgcgctgagtgaaagcatcatgctcagggaaataagccagacaaaaacggccacatattgtaccatgccatttacatgaaaaagccaaatgaggctgattcatagagaaagaaagatttgcggttgtgaagagggatgcagggtaactgctaatgggcacagggtttcttttgggttaatggatatgttctggaattatatagcagtgatggttgcacaactttgtgacaatactaaaagaatgaactgtatattttaatagggtttcttttatattatgtgaattatatctcaataaagctattacttaaaaaaaaaaaaaaaaactgaaggccgggtgctgtggttcacgcctgtaatcccagcactttgggaggccgaggcgggcggatcacgaggtcaggagttcgagaccagtctgaccaacattgtgaaaccccgtctctactaaaaatacacaaaaagttagccaggcgtggtggcacatgcctgtaatcccaggtactcgggaggctgatgtaggagaatcgcttgaacccgggaggcggaggttgccgtgagccgagatcgtgccactgcactccagcctgggtgacagagcaagactctgtctcaaaacaacaacaacaacaacaaaaacccaaaacttaactgcagtgggtttcagagcaagcaggaggtgaaatagagacagcatgcaatgccatcatttttagaggctctgcctcttctgcgctgtctctgctccttccaccatctctttgaacacatctcttctgcccatactcacctgaggattgccagtgtggttgtatcgatatcctttttccttgtcagaatatattgtaattcaattctaagggatagaaacatggctcatggcgggggaaagagcaaggaaggctgaagagctaccctgctccacagctggtgtcctgcaacctccaccagttggccctgtgtgaatccttctccctcacatgtgccaatgagcaactgcagaaggcaggtctgattctaaagaacaacagacgatactgtggtaaaacgataatggccaccttcaaagttatccatgacctaatccctgacctgtgattatgttaagttacaaaagataaattatggctgcaaatgaattaaggttattaagcagctgaccttaagattggcagaggtatcatagattttccaggttgccccaatgtcatcaggagtccttaaaactggaagagggtgaacatcatcaaaattgtaaactttctacttcaaaggccacaagcaagaatgtgaaaagccaagccagagactggcagaaaggatttgcaaatcacctatctgataagggaagtatatctaaaatacataaagaactacttacaactaagtaataaaaagacaaaaatcctaagtaaaatgggcaaaggatatgaatagacatttctccaaagaggatggataaatgaatacatgaaaagatgctcaacatccttagcccaaaaccacaaagacaataccacttaacacatactagggcaactgtaataaaaaggacagataggccgggtgcggcggctcacgcctgtaatcccagcactttgggaggccaaggcgggtggatcacaaggtcaggagttcgagaccagcctggccaatatagtgaaaccccgtctctactaaaaatacaaaaattagccaggcatggtggcacacacctgtaatcccagctactcaggaggctgaggtaggagaatctcttaaacctgggaggtggaagttgcagtgagccgagattgcaccactgcactccagcctgggcgacagagtgagacttcatctcaaaaaaaaaaaaaaaaaaaaaaaaaaggacagataataacaaatgctggcaaggaagtggagaaattggaacccttgtacaagctggtgcagatgtaaaatggtacggctgctttagaaaagtttctgcagttccccaaaaggttaacaataatgttaccatatgacccatgcactgtttccagcaatttgttatagcaacaagtagagaatgaatacagatgccttgatatttttaatgcatagtttacacatttttcttatctctacaacacctgtatgaagtattattctaccaattttataggtaaggaagagacaaaattttccctcagcaagactcagaaatcttcacgtattgtttttttggtttttttttttttttttttttttttgagacagggtctcactctgtcacccaggctggagtgcagtggcacgatctcggctcactgcaacctctgcctcccaagttcaagcgattctcctgactcagcctcctgagtagctgggactacaggagcacgccactatgcccggctaatttttttttgcatttttagtacagacggggttccaccatgttggccaggctggtctcaaactcccaacctcaggtgatcatgcccagcatctattgttctatgtttgtataatcaccaacagctctcaacttggaataaccaaatgtaatgtaacaataagattgtttccatttgctgaatatcaacatcaaaaacttacagcatagaaaatctggaagagacagaaaaacacataggagaaaatttagatcaccagttaatctcactaccaagcaataacaatccttttcttcatgtagagtgatacaaatatgatacacgctttttttttttttttagtctcaattgccccagacaaaaaccctgaagcaaggatgagagtgcaagtagtttatttggtggatgatccctggaaacacgagtaagggaaggaaacaagaaaggaaaggaggccaatataggatgtgtgatcaagtgagttattatttcatgtgactggagcttataaaacctgctagagaactctgagaaccagtgaagaatatgcatcccagagttatcccagccaaggtgtgagggaactagcgtattcatacaccaacttttgtcctcactggttgagaactgctcctggggagacatcaatactccagcacttctgccttctcccacctggagagtgagaaaagccaggtttccagggccagtcagatgcaagtcaggctaggtaggatgcattgcagccatggtgggtgggggtaacacaatgtgggcagagcacagaccccacttgtagcaatgctttgcacagtgctgtctcatttctgacacctggagtctcataatttgctgctgaaccgaaagttcaagtatttagtctccttttcatgggtgagataccagacagataaagatctggttagaggttcttaaactgcaaatcccaaagccctagagcttccagaacaagcctggtatggccaaggagcagctcatgatggaagtaagaatggggcaccagaaagggcggcaggcttcagttccccctccgtgattcaaacagagcagctctgttttatctgtttctatgttgggatcccatgcacgatttcatttgcaaaaagaatttattactaaaacaaacaaacagaaaatctttgaaaactactaggattagaattaggaaacgttggggggtggtaagagtgattaatttcttcatttcacagaagaggagagtggcttttagaagaccaataacaaagcaatggcagggctgggactggaaccttgagaaccccgaaaccctgacttgtgttccagtgctttctacctcatcttgcccaacctacctttcccagatctcagaaaggtagaagcccctacaattaagcagtttggtgttcagtcactggagatgggtggccaaggttcagatcctacctattcttttgactgagtcaattccttaacttctttcatattccctcatttatcaagtgggcataaaaccagtatcccaacgcataagacttttataccgattatgtgaaatacataggtaaagtgcttaagctaatgctgcacattctgaatattcagtcaattccagcagtgactatattacaggacattagttttaaaaataattttgacaacctgcttctgttctaaaccagaaggcttaattctacggtgagccttgctgaatgtattctacttcatccagaccatcaccaaccccaaagctgtgtgttctacatggctggatttcgcctttcttgatttggggaggcctcatcttctgcaactaagtcgagtcaagggtcagcatgaaattactgacagccacttagttctaaaataaatgtcactggaagtaatgccacttacaggactttgaggatacctcagcatgatcaactcaagaatcaaattagtggcctgtcaaaatgcacaggcacactgatggtttctgatgctactgtcaatgagctccttcacttagaatattagcaatgctcaggcagttggtatgcctttcaggaaacagaggaaacatagtgcttttcatgtgttcaaagtgtcccaatcaagttgggaaacttcgaggaaaaaaataaaataaaaaaaaattcagtttaaacaaaaaaaataaacagaaaacacctcctagaatttgtggagactctgttgagtttcgtggcttaacaattgtgtttttaagccatacatcactggtggtgctccaattgtgagttataataatatatcataagagggatggtgatctcctgatatatgggtgccatacatcatctaagcaccatggctttgatgatgtattgctccaagccacaatgagagtttaaaggagcttttagcagccagacagctttaaatttcaaattttcaaaaattaagatcttttcaagtaaaaaaaaagcaagataatggaatgtgatgctatataaagtgtcactgaactctgagagcctgggtatatgccttttccttttggctttgagctcacaaggtggaaatcattggcaagttcttcttcaattcctcctccatgagcacagaggtgagcaagtgtcaatgcatccattttgccaatcaatttcccccatcttccacactgcaagcctgagtagctcatcatcatcccaaagactggatcacataaaatgctgtgataggcactggataaacccaggagaagttattttttattttttattttttggtttgttttaaagagctcttccactgagattcagaacaaaaagaacagataaaaagtagatagacttccttcctcattgctctcaaactcaaaacagggcatgtaggaagaaaacatgccttgtctagcatttgtctttgtaaagcaaaggaagcattgattgcagatgaggagaaagaggggaatggcatatgggcttctcatccagactaggaaagggagctgttgtcatagttctgtcacctttcctattttaacgatgggtttataagacggtaatgtggcttaagagaatgtacccacttcgtttaaaagccactcacttttgggggcaaagtaatcacaatcaattaagaaaacaggtgttgagagaactcctccctttttttttaaatcctactgcaataaacagaacaaaatgagaaatcttcctactgtttctgtaatagacctaaacaggaacagtgagagacgattacacttcaagtggcttcttccattttcctttactaagtgaattaaaggaaagaataagagtagttactgccatgtggagggaaacatctgggcataaggaattaacagtcttccctcccattctcctatctctaattttttgctccttgggcttcctccagtagattctaagtcccaaattactgtagatattttgcacccggctccctccttgaccacttccaaagggcaaaaacatcttatttccaccaaagaaaaccaatggctgtctcaaaaagaagtcccaggcttcttttctcctgtagtagtaagttaactatataatctgggtaacaaagacatggaaataaatgcatcacccactattctgaggctgtcagttgaaagatgtgaatgaggcaggctttgcatctagagaaatgtgggttctttcacgggctggtaaataaatcccccaaattcagtcctcttcttctctataaagagaatactgacacaacacttaattatttctttcacataagccaaaaagctttacttacgtatttatagtaatagcacaccattcatccacccaccatttttaagtcattatcagttataaaacttgctgccatttacataagaatattatatgttggaatggtacttagtactgtatattatcacatcctcaccaaaacactaaaaaatagaaactgttgtctccttttttttcagtaagcacactgatgcttactggaattaaataaattgtgcaagctcaccaagctggcaaaagtggccgagttaagattctaagtcaggttgataggatgtcaagcgtaatctgtattttgctatgctccttcctgagtaaataactaatgtctgggtgaccatatgccccagtctgtttggaaccatccagctttaggcctgcaggtatgaacaggccagtgtaataacaaacagcatcttctttcactctcctaagttctgctgtggacaataaattatatggtctccctaactagtagtatagttcatgccaggaaattttatttctgctcattctaactattctcatctgcagatagcaggggaaaaacaaagaagaaaggaaagaaagaaggctctgtgaaagtttttaaagaatgggctactaactcttatctatcaatacctttcatgaaacctccaacatgttcagagtagagctctgggagggaaaagaaatactttagactaaaacagggcccctcaagctctaaagaaaaaacctcaagcatgctagaaacctctccagttgagcattctttacttattatcatcacaagaggcaacggtaatagctgttgctatttattaagctcttactatatgccaggcaccatatgccaggaactgagctaagcactttctttgtaagatctcaattatttatcataaaactgcatgatagatataatccaaattattatcatcattaatttatagatgaagaaactaaggccgaggaacgtggaatgaggaggtctgcccgattccaacatccaagtgtgatactactatcaacactctggtacagttgaacacagcctagtaaaagttctaagcccactgcccctgcaccccctgctattcaaccttatgacagtaagctcttctgcaagaggggcccattagagagaatggacttctaacaaattgagatcaatcttgtacaaatattctgtattatcttttggcttctgattggttttcagtgacataacagctttaaattcttaaagctatttaatgagaagagagtagatgtattagtctgttctcacactgctaataaagacatacctgagactgggtgatttataaaggaaagaggtttaattgactcacagttccacctggctagggaggcctcaggaaacttacaatcatggcagaaggggaagcaaacatatccttcttcacatgggggcagcaaggagaagaatgagtgcccagtgaaggggaatccccttataaaactatcagatctcatgagaactaactcagtatcatgagaacacgatgggggaaactgcccccatgattcaattttctccacctggtcccacccatgacacatggggattatgggaactacaattcaagatgagatttgggtgcggatgcagccaaaccatgtcagtagaatttataatcactgcctctagagaagttgacaaacctaaccaacagctataaaaccaggataactccagatgtagggctctcagatgaggtcatctctactgccttgggttatggacaggtagaaccctgggaagaccattccaagatagagtcttcctgttcagttagacatgcaggagctcagaggttcttgtaaaattggttctgcttgctgctgggtgggaagggacagtgccttagtaatgtctccatctgaaaacgtatgaaagtttcaaaatgacttttaggagatacagaggatgtttcaagatttgtcacccttgtgcttctcagctgttgttgtagtcatggagtttatagtacatgtgcttggtagaaaaaattataagtgttcttccttccatgtggagttcctttctctttccttttcttcctctgagttttaaagagcatgctcaaatgccacctcctttgtgtactcttcagactctttcaggcttttctgattcattatacatatgtccatgacagctttttaccacaaagtataagtaattacaggttttctcttccactagtctggaactctgggctatttattacttatttttcccctgattatttcttttccctaaccctaggttcctaggttagaagacatattttctaaatgttgaatggatggatgaatggatggatgggtggggtggatgggtgatggatgggtgaatggatgggtggatggatgaatagatggatgagtgggtgggtggatgggtgggtagctaggtacatgagtgggaatgtggacagataggtgcatggatggatgaatggatggttaaaaaatagacaactacactgctcttaatttcttagcttgcttaaaagaagaaatatatgcactgattttcttcgccattcttgtcattttcttttgcttgaaagttcttgtgcatacaaagatatggtctatgaagagccattatgatcacattgtacacacctttcttccccactgaaaagtatctttttaccaaaatgtaagtttgaagttcttgtgtttctagcctcacataaatcccttttaaaaaactcctcagatatgctcaagtgtctggagaaatagcttatcctaaaaacagtcagcattgcaagggttgccaaggggatatatttgttcttcagtattaacttcattaagagctactgtggttctctctcaggagagaagaagaaacctaacctttctttggatatcttctgatctttacaaattatttccagggtgctgtctttgttagacaaaatatgaagaatatctatttttttatttatacatcatatcagaacattaatttgtagagtgattccctctgggtgcctttctgttgggtacacaaaaaaggatttggatgcaaatgaaacaatgatagcatttttccttgtcttactcattttgtgacaaatgcacattgctttactgtttgctatacacataattacagttctttaatttatgtttcaataaaatgtataataataaacatttactgctccatgaataaacattcgagtgaagcctctaatggaggttacatgtttcgaggcagctctgtggctttttcagaaatctgccttctacttaatgagcatcatttccataatctgtgcattattgcttaagcctccctttaaaacatttcaaaatgcaaaaatttgtgaaatatgatcagtccaaaggggaaaaaatgttaagggaattagcaacttgtcctgttaaagggacaggacaagctttcatgtccctccagagacagtaacatagtaattatggagacagcacttcctaattatctcactagctgagcgcaatactactgtggtttttgcctctaagatctggtttaaataaaagtgataagaaacctggagaggtcagccatgaaggacaagcttgtgctaattctctttccagtgctaacaaagaaaccagaaagtagaaccagaaatttggggaaggtcaagatacctgtggtatggacattcctggatgtagagacagacaaatggtttgattaaaacggtcaccccaaagtaactgaattcagacaaaagcctatgctgagctttatgtcgatggtgtcacacattattttcagtgtgttatttcttaggaaaattacttacataattttatgtcattatcactttaaaaggttaatctatttcagataatctttgcaaattgtgttctaaaaagcaggtgcttttaaaaataactaaaacatgatgacatatttcttttttctttgtccaacagccatggctgggttgtttaactagagagaaaaaaagatgccaggagaaatgaaggaacaaaggacccttcacagtgtgataagatacagatagtcagcctctgcagagcggtgatgaaatgtgttaaaagtgatggctgtcacttcatgacatgtcagcgtgctttattggtgggttggcacaatttatttaaacatcgtcaggagggactcattttggtgtagttagaagttgtgtttctttagtgtgaataaatatctctgggcccacgtgcaacattttaaaactgtgctgttgtttactgtgggaattggagcaaggagctaagagttccaaagtgaagctctccttctcccaccattttatgatttgctataagtaatttgctccttgctttgaccgttactacaaaatctttcaaaggaacattattctccttaacaggggctaaatttaagatttttcatcattcaatattgctattttcacatgtgacttcaacaaaataaaacattcggcataaatagaatttagtgtaatccaaatcctgcttttctcttggtacatatgctttgttgcttcttgacattcctgaattacaaagtattaagcagaatcatctttttaagggttacattttccttctaactcaagtgagcaggtatttacgtcaaagtcacacatttaaaaatgacatcctcttccagcatggggcaaatctcaacctacagggctgccaagtggagctgcaactttttgcaagggttctacccagatgtgctacaagtccatattacctttgaaatcaccatcttgtaaagatatctgcaccctcatgtccactgcagcattatctatagtagtgaagatatacaaacaatgtaaatgtccatcaaaggacaaacagattaaaaaatggtatataataaatacaatgaatattattcggccttaaaaattaagagattctgtcatttgcaccaacaaggatgaacctggaagacatacactaagtgaaataaaccagacacagaaagaaaaatatcacatgatcttacttaaatgtggaatcttaaagtaaaatatatagagatagagaataaaacagtggttatcagactgcggtggaggttgggagggcagaatggggagatacaggtcagagaatagtaagcagcagatttgtaggaagaaccagtctagagatctaacatacaacatgaagactgcaggtaaaactgtactgtatttgggattcctgccaaatgagtatactttagttgcccttgtcacaaaaacaaacacccaaaaaagtgagtaactatgtgagatgatgaatatgtgaatttgcttcattatagtaactattttactattttgtatatatgtcttaacaccatgttgtatacctcaaatacacacaataaaatttatttaaaaaccaacgaaaaagcacattcccttcataaatgagattcttttcaaaataagtttgaaaatatacattgtaaaatatactagaaaaaccaccccctaactaactccccacaacccaggagctctgatttgatagcttaagacaggataaatgactccgattaggacaatgagccccagttttatggggacctcctaaatcatatctcggtttgggtctagaatgatggtgctgggagcacccagagagctgcatatcatctcagcctggcttccacacagggagccagagagatttatggggccctgtctggtggctttgaggcacaaacgatgaatactgctaaagcaataacaataaaagaggcaacagacagtgggggaagccccagcaccaaccctcatttttctcataatatactctgttgtacaatgagacagagtgattccataggtaccagccagaaattacatgaaaaattgatcatgtttctttttctgggtgatatcagtgattgaggcccttgatttatgctggccaaactttttcagtgcagaatggaacccttcctaacttcagtctccgtggctcacacagactggccattaacagaagacacactgcatcataccatttagtcaggaccctacactaacagagggaactgcagcagagtcttaatagcaactccaatttgccaggaatctcaccacagatcagaaatttacagtggcggagaccttttaggaactttcagcatggatgctccctcaaggtgtgggtcagaatttgcggcgcaggaggtgaggtgaggtgaatagtttataatgatttttctatgccttttaacctttggaattaacatttggtcaagaaagccaattgaaggctaagtgtgtacttgacatgtgaaaaaatgaatgtgtcttctaggcgttggcttaggacactgctgagccctggctacagccaactcaggcttaactcattaaggtgattagccaacaatcaattctttaaaattagtaacataaaacaggccataccaggctcatggatataaaatttgggtatcaagttttgctccagagaaatgtcacaccctcaccggcaaaaagtctatagaggtagggagtgtcacaggtaaggttgagttaatgagacatcctctagctggcatgaatgtgtaaagtgcgctccatggtcatacatccagcaagtcaggatttcacagcaagcatagctttcactttaagctaagtgacatggaaggttcaggtccttaaccttaggtcacgggatgacaatatacagaatctgcagcttgacagcctgggcttaattcctagtcctgccactttccagctgtgggacctgagatagtcaacacctcagagcttcagatttcttgtttgtaaaatgaacccatctcagagggttgctgtgaggatcaaattggttagtactgcaaaatacccagactagtacttggaacttagtaagcatagatgtaaggtgtttgcagctatcattgctgctgccgctgccacgattattagtactacaactacttaaccacaaaatctgtgctacttgaccacaacatctttcagttaaaaaaaattcacaatttatttttttaatttaactttctcttaaggactttaccattgttttaaaaattactctactgaagtctaatttactaaatgggaacaggtagaagaaccattctcctaaaaactaatgtggagtcaatatacttatcctgggcatgaagaaaccctggagcttccaaagaacacagtgtgaaaaactttgcttggggagggagatggaaggcagagaacgagggtttctcccactggggtacaaatccttaggaagtggagcttggtgattaagagcatcgagctctaaagtcagatgagctgggatgaaatccccaccccaactttcatttcctgtgtgacctgtgaaggcagtcgaatatcttaattctttgggttctatatttataaaatgcagataataaagtctattcttcaaagggcttctgagaggattaaatgaaataatacatgaaaacctcttagcaccgcccctggcaccattagaaaatgccttataaatgtaagctgctcttctagttacttttacccagatctctgctcaagtgttacttccatagagaggacttccccaatttctatattacatataaacagttccggtcctatctcaaattaaaatctgcatttattcactttttcattttttgttcccatactcacggccatgatcccagcatctgtgactatgactagcacttagtaggcacccaataggtatgtgttaaatgaatgagttaaaaaggagagacaggaagtatctctaactcaatgttaagagactgcaaaaactctattaggctgaaaactaggaagtataattcttcaaagtaataacagaaataaaacttgaagacatgttcttttgtgtatgcaatagtgtatgctgattgttctcaagctgccaactacccttaacagtgctctgctgtgaagacacaaaaggggcaggagggtggatcagacagacttcatatgagccacaatgcaggtccagccaaagtagcaaggatacagttggaatataaatgcctttacccacctctcactgttttcttctcctgaaaattgctctacattatgatctctctctctttctctatctcttgtctcatacttggctttcctctgtccatgcaaagggcctccttgtgatatcccacattctcttttatcctgacacattgcatagactcctgttgtgggtactgtgtagttatataaccagagttgggatgttttactgccttgatgcttgcgttgtgggtctgtgtaatctttgcattcaaagtgtgataacagacactggacatagcgcataacactcagagctgcactccaggtactaagatgtcatgaggcccacgagagagatgcacatttctgcaagggcgtcaagggacccaggagaggaaggtaaaagccactacgaggtcctctgagggcaaacgctccctgctctctcctgacaatgatccccaatgcatgaagtaggatatagtgtgttaaggtgataagggctgaggatgaagtgggttggctcaactggcaaagcactgtgaactggaaatgtgttagtgtgtggaaaagcaatgttaccttggatgagagctcactcctctcgtgaactagacttttccctcaagtgccttcccccataatacagtcagtaaaatcttctaaagccctgagaactggaatcatctcacgatctatagtaacccaaagtggcctagcaactaggggtggaccctgttaactattcacatcgccaccctgacaaaagtcttcctgctcccatttcaaggctctctccacacttggtttctctgacctttctgaacctttcaccgtatcttgctctctggactgcagcccctggctgtgaatacatatttagtctctcagcctgcccttcctatagacatattatttgatgcttatgcaaagatcacccttagccttcatctttccatgcctttgccatacactaccttcctcctccccacactcctgtagtcagatgtgatgcttcaaactcagcttgagcgcaggtctcattttcaccctcctcatacgcctgtggacaagtttgtcagaccattggttaaatattcgaccaagagtgaggttggtaaaaggaaggcatatttacgagacagaacaaaggctttgcattaaacaaaacaaaatggcagttttccttcttgctgaaaccctcacttggatattcctccagaatcagagctttccaagactccacatgattcatcccctctcccatacttagctgtctggattacagcccttagttctttttttattttttagagacacggtcttgctctgttgcccaggctggagtgcagtggtgcaatcatagctctctgcagcctctacctcccaggctcaagtgatcctcccacctcaggctcccaaaaagcttggactacaggcatgcaccacattggctaatatttttttaaattatttgtacagacagagtctcactatgttgtccaggctgctctcaaactcctgggctcaagcaatcctcccacctcggcctcccaaagtgctgggattacaagcatgacccactgtgcctggcttcctagttctctataggagtctctaggttgttctgcctgagagattctgatagttcagctagtttcaaccagaatgctgaacccattattttgagcatgaatctgctctcctgttatattactaagaagaaaaacaaggtattccattaaatctgtgggcacatcctcaaaagcacatagttttgccgagatcttacacctgacaatggaagtgcttgcacgatgcaggtagtaaaacggaaaataggaatcaggaagctgatcaggaaccagctcagggctttgaaaaggagaaggccagtgagcgcccaccatttgcaggttgacagagtcaattttttttttaaacctgggctcaaagagagattaggcagctggatggggagcagactaaaaaatatgttcacctttaaataaatcagcaacgaaattggaggaggattatacctcagggacaaaagaggaagaagaacatgaatacctgctttacttgaaatgcctcccttctcccagcctttcctgcatggagtatgacaagagaggcccttggtaaccttcactttaattagaatcattaactgcaaatggaagtaagaacaactcaactctccttgtctaattacaggggctaccttactcctgtctgtaaaaggcaccaatattgtcctatgaggccctggcatgaagactttgctactctctcaagtaccaagaacagccttggagtggaagaaagaacatatttgactctaccatggaaattcttctatacctcaacatcattccttcatcatactcacatcctggcttgacagaacttatgtatccctgaaagccaaaggcagcttaagggacaggatagtggagaaaaatgcagccctggaactagactccttgtgcatgcatcctcatcacaccactgactgctacctggagcaaattacttcatatctccagattccagtttcctcatccgtaagaaaggcacaacaccactgtctacatctcatcatagtttttccctgacaattaataatacattacataaaataaatctttaataaagtcctaggactcagtactaggtactgtctaaatactagctatgatttaacatttttattggtaaagttttagaaacacttgctttgagattatggattcaaaggaaggtacaaaatagtacagagagatccctggtagtgtactcttcatctagtttctcaaagtactatgctgacatagtttataaaatataacatacctatagtacaatatcaaacccaggacactgacattggtacaatgcgtgtgtatagttagttcaatgccattttatctcatgtggagattggtataactaccattgcgctcaagatacagaatgaatccattaccacccaaatcaccattgtaatcctttggggaggcactcctgttccttctcctccatccattacaagactggcaaccccacaaccactaatctgttctccacctccacactttcgtttatttttcttgaatggtgcaataatatgctgccctttattaaacatttttttcttttttttttatttaaacttttattttaggttcaagagtttaagcgcaagtttgttatatagggaaattgtaagtcacaggggtttcgtataaatattttttcatcacccaggtaacaggcatagtacccaatgggtaattctttgatccgctcccttcacccaccttctacactcaaatatgtcctggtgtctattgtttctttctctgtatccaagtgtactaaatgattagctcccacttataagtgggaatatgcagtatttggttttctgttcctatgttaatttgcttaggatactagccttcagctccataaatgttgctgcagaggacatgatctcattcttttttgtggctgcatagtactccatggtgcatatttagtacattttctttgtccagtctaccttggatgggcttttaggttgattatatgcctttgctattatgaaaactactgcaatgaatatgtctatgtatgtgtctttatggtaggatgatttattttcctttgtgtatatactcagcactgggattgctgggctgaatagtagttctgtattaagttgagaaattgccaaacaaccttccacaatggctgagctagtttacattcccacaagcagtgtataagcagtccccttcctccacaacctcaccactacctgctattttttgacttgttagtaatagccattctgaatggtatgagatggtatcttattgtgtttttgatttgcatttctctaatgattagtgatgttgagcattttttcatctgcttgttggcctcatgtatgtcttcttttgagaagtatctgttcatgtcctttgccaacttttaaatagggttgtttttgcttgttaatttatttaaattccttatagagtctgaatcttatacttttgtcagatgcatagtttgcaaatattttctcccattctctaggttgtctgtttactctgttgatagtttcttttgctatgcataagctctttagcttaattaggttccatttgtctttttttttttttggtcacaattgcttttggcatctttgtcatgaaatattttccagagaccgtgtacagaatggtatttcctaagttatcttccagagtttttacatttaagtcttcagtagttttaggttttacatttaagtctttaatccatcttgagtttatttttgcatacattaaaaggaaggggtccagtttcagtcttctgcatatggctagtcagttattcaagcaccatttattgaaaaaggagtcctttccccttttggtcagctttgttgaagatcagatggttgtaggtttgcagctttatttctgggctctctattctgttccattggtctgtgagtctggttttgtaccagtaccatgctgttttggctactgtagccttgtagtacagtttgaagtcagataatgtgatgcctccagcttcactttttgcttaggactgctttggctattctggctctttttagattccatatgaattttagaataaatttttctaattctgtgagaagtcacgttggtagtttgataggaacaggacagaatctataaattgctttgggcagtgtggccattttaacagtattgattcttcctatccacgagcatggaatgtttctccatttgtgttgtctctgatttctttcaggagtgttttataattctcaatgtaaagatctttcacctccatggttagatgtattaggtatttttttgtgtgtgtttgactattgtgaatgggactgcattcttgatttggctctcaccttgaatactgttggtgtatagaaaaagctactaattttttacattgattttgtatgctgaaaccttgctgaagttgtttatcaaattaaagagcttttggacagagactacagggtttcccaggcataaaatcatatcatttccaacagatggtttaacttcccgtcttgctatttatatgccttttatttctttctcttgactgattgctctggctaggacttccagtactatgttgaaaaggagtggtgagagtgggcatccttgttttattacagttctcaaggggaatgcttccagcttttgttcatttggtatgatgttggctatggatttgtcattattattttgaggtaagttcattcttccaatgcctagtttgttgaggatttttaacaagaaggatgtctaattttatcaaaaggcttttctacatctattgagataatcatgtggtttttgtttttagttctgtttttgtgatgaatcacatttattgatttgtatatattgagtcaaccttgcatgccagggataaagcctacttgatcatagtggattagctttttgatgcgctgctggattcagtttgctagtatttggttgcggatttttatatctatgttcatcaaagatactggcctgaacttttctatttttattgtgtctctgccagattttggtatcagaaaaatgctggcctcacagaaggagttagggagaaggtcctcctcctacatttttcagaatagtttcagtgggaatagtaccagctcctctttatatgtctagtagaatttggctgtgaatctgtctggtccgtggctttttctagttgttgggcaatttattactgattcaattttggaaatgttattggtctgtccagggtttccgtttcttcccggttcaatcttaacaggttgcatatttccagaaatttatccacttcttgtacgttttctaatttgtgtgcatagaagtagtagtaatagtctctggggagttttttggtatttctggggggttggtggtaatgtcccctttgtcatttctaactttgtttatttgaatcttcttttttccttattagtctagctagtggtctatcaatctgattaattttttcaaagacccaatttatggttttgttgatcttttgtatggttttccatgtcttaatttcattcagtttagctccgattttatttgatgctctgagggtttgattatggtataagaggttcagttgatgagcttcatttctggaagatttcagggggccacggcttagctcagcactcctgggggagtatgctgcaaccctgggggggctggtaccagtcccccagctttgttctctgcccctcaaggttaagaacctgctgtgctggaggggcataggtgttccccatcttctggaaacaacactctgacagaggatgctggccaaagcacttcactggggcagtggcagcaggatccatgcttactagcatgtgctggcaacagtggcagaatggtgggtgtatgccaattttgtttttttgaaaatctatataaaagactcctatattatctgaccttttaaagtgggcttttgtcatttaacattaatgcccttgagatccatacaagctgttttgtgtattaatagtttgttcctttttattgctgggtaatattctatggtatagatgtaccactgtttgtttaaccattcacctgctgaagaaccttttgactgtgtccagttttcagctactataaactacctgtgaacattcattcatgtacagatttttgtgtacacataggtttccctttctctgggataaatgcccttgggtgcaattgttgggtcctatgataagtatacgtttggtttttaagaaatcactcggccaggcgcagtagatcacacatgtaatcccagcactttgggaggccaacgtgggtagatcataaggtcaggacatcgagaccatcctggccaacatagtgaaaccccgtctccactaaaaatacaaaaaaaaaaaaaaaaaaattagccgggcatagtggcatgtgcctatagtcccagctacttgggaggctgagtcaggagaattgcttgaatttgggaggtggaggttgcagtgagctgagatcatgccactgcactccagcctgggcaacagagcgagattctgtctaaaaaaaataaaaataaaaaaaaataaataaataaaaaataaataaatcactattttccagagtagtagttgtcttctatatttccatcagagagatttggtttctgttaccctcaccagcatctggtgctgtcattttaaaaattgtcctaatgtatgcagtgataactcatcatggccttaatttgcatttccctatgggctggtgacgttgagtatcttttcatgtgctacgtgccaccctttattatcttcaatgaaatgtctatttatgtcttttgtccactctacttgtattgttcattttttctatcataaagttttttttttccccacagttccatgaatactatagactttttttcctttttcaacttttattttagacttgggggaacatgtgcaggtttgttacctgagtaaaggtaactactgtgtgaagctgaggtttgggggatgaatgatcctgttacccaggcagtgagcataggacccaatagttggtttttcaacccttacctcctcttcctctccctctactcaagtaatccatagtctatattgttaccatctttatgtccatgagtacctgatgtttagctcccttttgtgagaacacacatataccagagttttgagaattcattatatcttctagatatgagtccttcatcagtaactttttaagtttcagagatcctctctcattcccttcaactacgagtgatctcttctttccctaacttctttacaaattttcacataggaccttttatcctgtctatcttgagtctgccatagatggccctccctaactgcctcactcatctatgaacaggctctatttctgatttgtcatcactcagtgtcttgctaacatttgggcacctatctggcattccactaatgtccaccaagtgactgaatcaactatacctggattttcattcagttactataagacttcagcctaaagcaaaagccacggttaccatggatacgcaggcttgggatagatatgtatcctaagcatttaatactttggaaaggataactaattacaaaaagaaatacacacactcagatgtgttagtgattaatttcttctcagctaccacacttctagctaacgctgtgacacactaacgtttattgaggagtttctatttacgccaacctggggctcacatttggctaattaagaacacatacatttcagaacttgtgatctgtgggctgtgtttacatatgaacatcatattcaatacacaggcaattgtttagcacctctaacctatttctagccttatatttaattagtgagaattgctgatggggaacgcagggtatgactttgcattaaacaaacagctatcctccttacaaatcacaacaacaatgcataattaaacaatgagctacctgagctttattcagtctttcttccaaaggaattaaatctctaatgaggaccaggcctcaggaggaactgcagaaggaatagaggtaaggagacataggggtcaattctagccctgcttcctggcctttctgggtcttaatgtccttattgtgagatgaggaaatgaatactcctccctggctccccatccttctcttcttctctctggtatgcatgttctaaagatcacatgcaataacagaggcaaatctctttgctaaagtaaagcataatataaaatataagaattgtcactgctgtgagttaagaggatttcattatttttacactggagaagaaaaacaattgccattaaacaggttctccatgacctgtccccatctcttccctgccctcatcacctgtccttcctctccctgttcacatgtaccagccacctgaccttgctttgctccttcccatcatatcaggcacatgccagccttgggcaaatccccctcctcatcaaagcctttccatgaccgatcctccaattgaaactatcactcactcccctcttatatcacttcttttaatacagtcagagtacttgccactgtctaaaaaaactgtttgtttacttgttttcttttcttttcttttctgcttttcctactattctctcctgcttttcctactactctccaccagaatcaggagcagtaaactcaatggctctgtcttacttccatgctacaaactcaggtgagttcactgtagcctccaggagggaaatgtacattatgttctctgggacaaagctcccaggcaacaggcaaaaatgttccttttattctacacaactttggaaaacacctctgaatccaacgttgagagccatcatccttatgctgagtactcaagagctcccaggattctacagcccataaatgagacaatttgacaagagtcactagtggtgaccacagtaatagtattaggatgaaccacatgaaatcactgagattcactgttttggccctaaccactttcatatggtttggcatagtaacaacaatggcagcaggagcccttgctacatgccaggctttgtattaaggctttaatagatactagttcattcacttcccaccacaatcttataacctaagtattaattacctatgtgttatgcatggaaacagcaaggcttaggaaggttaagggatttttccagaggagaggtggtagcatcaggtcacaaacttaaccccgtattatcctggaagagctaatgtgtgttcccttcctagggaccaccatgaacccacctgggttctgtgcatggaaataacacagaaatggaagttgctgttttttgctttattgcctccacgactttgtagccattgctgttgactgggaatctctaaattacaccaacactcagggtcatctgagttgacaactttcatggccacggccactacgcccaagaaaaaaataagttggaggtaaaatggggtataaaactatcttctagcactttctgctaattgtcttttacccagacaaggaactctgaaggactctgacatcagtttgcgatgcctcagctacctctgtcctttggccatctctgacccttcagccaacttgggaccctcagtcctggtaagagatcatcaggccttgtgccccccaccccaccatcttggtgagctgactctttcttgctcacaccatacctaagttccaaatagaactttagggcatctgagatcccacacaggcctccccactgctgggatcaatgataaccatctcatggaaagcctcttcattgagatgtccccagttacatcaccccaccagcccagcattctcctggctcacctctctccagccacagaatttgcatctcacagctgagaaatgggattggtcttctcctctctccatgtctctgaaaacatcactcaaccaccttggctcaatagtctcctgcttcaaccagtgccactgagcatgccaatctctttttgtcatgttgacatcatgtgtggccttgatttgcctcccccaaattcctcctaggatggcccttctcacagccttgatctcatcctgggcacctaaaggggtactgagaatggtccctcccacagctttgactgaaagttcttggattccttctatatccagtcaatttcactaccttctactttagctacttagtcttgcggatgtttgaattttttggacactggatttttttcatcgtataaatgatttcacatcccaaatctgacattatgtaacacctctttcctgaacaacctgccgagtttgtctataagaccacccacactgtgcattaagttcaccaggtataaaacataggtggccattgcaccaccaaagccagtatcccagacacagtgggttggagaccctcgggacatgcagacatctccccactcccagtcagccatctgactctgtggagtctcctccctctcttgttaccattcctcagttgtgccaatgtgacacgccacttccagactctcacctcccctgaccaaagctagaggcatggcctttcaatgatctcggcttgtggtctcaccatagagtctatatgccacattcctgctcaacatctagaggtgtcacttcaagctaccctcccattatagggtattaagctctgaagttagccagtaagggggaaaacatggttaaaccactctggaaagatcccttaaactgaccaaccttcaacaaatctgaaaagtctaatttctttttcttggaaccaagcgctggttctgcatttgaacacaagttggagtcctggttaggatttggagggctagagggtgcaaaaacgtccttatccattagggtcacactcatcacagcaagatgctccccttgtggacagctgtgtgggacggcagccagtgaagaggagactagccactctgaagcctacgttccttgagtagaatggtccacaatctaaatctaggggttcactccttctctccctctgcatttgtctctctttccatgtctgcttgtgtctgtctctccaccccccgaagtgtgtgtctgggtgtttctctctgaatctcggtcccctagcgtatgttgtgtctgtctttatgtacgtatctgtgtgtacctggctctgtgtctctctcagcatgttactgtgtttccatgtgtgtaagggtaaatctcccctgtctctatctcttcttgtctttctctgcatctgtccctgtctctacgtgtgtacctctttcttggtttctctgtggctgtctctctgtttctctctcggtcttgatgtctctctgtgtgagtgtctctctctccttatgactgtcttcatgcgtgcattgggtccttgtgtgcatgtcctcctcctccagtgagtgtctccctatgcacacatttcttgaggtgtagggctctgcaaaacacttagagttgacccatttcaaatatgttagccgcacatgattcccggccaggtatgccagcgctgccctcttctgcattgccacgcagacgcctaccttggtcgaaacacttgcagacatatctttagcaaggtatctttcctcgtttttccccaacaaaactcatgctgtaggaatctccaacatatacaatgaaagagtattgagctgccatagataaattaagtactgtgctcggcctcccactcagcaccaagaggccaaacagaatctaaaaccactgctgacacctagcacaccaaacctttccagcctctgcaactggcattctctgcatgtcaaaaacctctgaatcattctgggtcaagcacacatgcctcctttcacaaaggttctgcaaacaggtagcatcctgtaccccgagtgtgtgcctggtacctactggtgtacccccttctcattgagaggtcctgatgcctgtggtgtgagtcagtttgagtgtgttaatggagtgttctgctttcaaggccaaactgcataagcagagcccatccttttcccttcttttgtgcccagatgggaggaatttgtgaaacttgtattccagtgttaatgctgaagttgggaaatggctcaatcaagcaatggcagtttaacttgaagagtgcaaaggagaagagcagggagaaaaccaacactggaagcaaatcagaaggccagaaaccttcatgggcacttgcactattgtttacagccacaataatcatgtaagggaacccagcatttttcagaagttattttgttctgtttttttttcttttttttccaaatgtgtgtttgtattgctttgtttaaatataggcctgattcattcaggcttgggtctgaagatcccaggctttcagaactcaacaaagctttcatcatttgcaaataattcaactcaacaaatatcatttgagaaaagctctgtgctagtgcttcttgtagagacacaatgaagaaaaaatcacggtccctgctctttggagacaaataacttaggggaaaacacacacacctctcaactctcacctaaggagtgctgtgcaaagtgctgaaggagatggagactcctctcctgggaaaatctgcaattcgaaactcaaaagaagatgaggctaagggccctccaggtggaggaacagcctgagtaaatgcctagaaaggaatggcacatagtaggcacttgcaatcaaagctttgctaaatgaatgcatgttgaacatgttccagaaaactcaagaccagagtagcactgagaagtagaggtgtttcagggcttccttttagaaatttcttatactgaaggtttcagaatgctaggagggaccagggagatggtttattccaactggtttcttttgaaaacgaagaaaccaaaaacccaagcttacatgctagggccagaaatgagatgagaactcagaactgttccagaaggtaatcactttgaatttaaatgcctactcttctgatctcaatttaaggaactaaaacaaaatcagcagtactgtttgctagttttctgtgaatcattcagaccctggagaagccagcttcacttttgaaagctgagctgatccacttacaactgtgtggctaggttcccattactgagtctcagtcttcacaactgtaatataggaaaaacaacagtagctatcgtacagcgtagttgtaaagattcagtgagatcatgtacaaaaacagctcttaacaaggtcatcagtgaccttcactttgccaaactcaatggacattttttgtccccatctcactagacctctgggcagtggcatctggcacaaaggggctgctccttccccaaaacaccccggcaccggctcctgggatagccttctttcctgctattctttctttctggatgttcctcggtctccattgccaagtcctcttctatccaatttctaaatgttggcaaactgcaagagctcaattctatatcctcttatcttccccagcgacacacttttctcattgaacccattcagcccctccgctttacacaccatccaaatgttgctggcacacacttttatatccctagctcccacttctccgctggttgtcagactcaaatatcaaactacctgcttgagatctccatgtggaagtcatagaagagtctcaacccaatatgtcaaaaactgaactctccattgccccattcccaaacttagtttttcctcacctgcttaaatggtattgatactcaaccatgacttaagccagaaatctaagagtcattcacagcacctcctctccccctctcccaacatctgccatcaggtcctaaatttcatttgtgatatatatgttaaccgtatacgtttttctttatttctaccaccagcactgtctctcatctgaatgacggcaatcacctcctaactccactcctgtatctccacagtcagttctctgcccagcaaccgccatggtgtgtaacaaatgaaactgatcccagtactctgtgttccatccatcagtggcttcctcttgttcatagaataaaggatgaaacctgaaatacttcttcaaacttctccaggatctactcacaaaaatcctctggcacagctctcttcttctatcatttggctgcatttctacttgcctatttttcatactcggaacaatcatgctttttgtagagccagggccctcacatgtgttgctcaggtctttagtcagcaaactcttcttccttaatctagtggttaaaagccccagctctggagtcaaactgacaggggctgggtgactaaagacagtcttctggccaggcatggtggctcacatctgtaatcccagcacacagcctcccaggaggatcacctgagcccaggagtttgagaccagtctgggcaacgaagcaagacctatttgccaaaaaagaaaaagaaaaaaggccgggcatggtggctcacgcctataatctcagcactttgggaggccgaggcgggcagatcttgaggtcaagagatcgagaccatcctggccaacatggtgaaacctcatctctactaaaaatacaaacattagctgggcttggtggtgtgcatctatagtcccagctacttgggaggctgaaccaggagaattgcttgaacccgggagggagaggttaccgtgagccaagatcgcgccactgcactccagcctggtgacagaacaagactgtctccaaaaataaaaaaaagacaatctccttagtaaaactatgtaccttactttaatcatctgtaaaatggggataagaacagtagccacctcacatagtggtgaatattcaataaaacaaaatgtgtgaagcactgaaactactacctggcagaagaaaaacactcagtaaacattattgtcaaaaatccctatcatcctttagttctcatcttaaatgtttctgcttaaagcactctccattactctaaccctcagttttaatccattttatttcctagtactaatctaaattggtcatcaaatattgattttgagacttattgtccatttctgcctctcaaattacactctacagaacagggactttgtctgtgtttccttcagtcctggaaacctggcagaggagctgaggaactgagctttacaggctgagttctgtgaccctgtgattattatgttgaagccctcatccccagtacctctcaatgtgactttaattggaggcaggggctttaaagaggaaagtaagttaaagtgagaccatcaagttaaaattatgccctaattcagtctgtctggtgtatgtataagaagagagggaatttggatacacaaagagaaaccaggggtgtgcattcgagagaaaagattgtgtgaagatagagcaagaaggtggctagctggatgctcacaagaggggcctcaggggaaatcaactctgctgacaccttggtctttggcttccagcctccagaacggtgagaaaataaatgtcttttgtttacaccacctaatctgtagcatttttgttatatctaccataaaaactaatgcagtcagtaaagactgatgagtgaatggatgaatgtgtcaacccagtgctcagcacaaggtaagtatgcacaaaggttgactcctattcctgaaataatgatgatgaatgtaataacatctcaggagcaaatctaaccaatgcacattgaccaagtcactgagaaaaatatgtctcagtggcacttacagtgcttttcacctgtaatactgaagtgaaatgtgattagctatgaagatctgagaccttcctttaggagccagcacatactactctatgacttctgtttacttaatttgtacatgttggaacttgactgttttatggtagactcttggctatacaacatggaacactagacatttccatactcagtaaacaaatatttctcagacatgacagcaaaactagaaatgagaatattagattaatacttccaaaataacagcctcatcgttttaatcaacatgtccttgaacacgtttgaatgtgtgtgtaactgtgtgggaatgtgagctacatgtgtatttttccactgaaggtgaccataccatatgcaagagcaggatctcaaattagatattcagcataggtagccatattatccacatctaccaactgtcttcaaattaaagcccttctctagctggaacatgtatctgtcactggaaagtaggcagtgttgaaaatcatgacaaaattggcacatatcttgatagttgcatcatcttttctgtggcagtccccagtaatagagcttcatctaattcagcaaactattagctcataataagaaacagcatgtgtattgattcttttaatagatcttggaattaatacacatgattcctataaaaggactgtataaaaaaaatcaccaagttgattattgcacaatgaggtctcactcaaatggcataggctacggcagaaaggtaggcaattcctcttttgaaaaaaactctccatcttacagactgattctctcctgaggaagaaaaaatataatgaagtgctataattaggtatctcacatgtaagggaagataacaaaatcaggaacagcaaataggtttttactgagtgtcaactccattcaattagctgcagctacctagagggttgtattaagaagcccaaggtcgacagtaaacaatgccttggtgaaataatgatgttggctagggttgcaaaatgatgagtagatggccgctatgtaatttctactctgaaacagatgtcactaaagtctcttccggggccaaccttctatgactctctccttttttctcctcttccctcactcttgctcttggagttgggatgaataagttagcatctcctgagaatcccaactttctcctcttatataaagtggtcaggctcagttttcagtatcaggattcaaagcagcaacctctgtcattacaatcatgtgtcgctttggtataggcattgaaaagctgtaccagggtgctgactgtcacttaagtaattagactaaactataataaacaagaagagatcactgctggagacccacatttgttaatgacctccagggtcctctcccctggcaagagatagacagatgaggtaccaggagtgcaggcctccttgcacgtataatgacaacagccagacaacaatgcaacaaaaatggtcccatgtcctgttctgtgtgtatagggagagtgatgacaatcatcattaccaccagaactaccaaatttcctctccagttctttgatgcttctcaatcattgtcggagctaccctttaaagatgtctcaccatgaacagttactatgacaagatactaagaagagagtgtttcatttaaccccttccatcactacccctatgagacatgattgcctttacttgacaggaaaatgaggttcagggaggttaaatgtatgtagaagattttagcaagaatattctgacttgaaatctatgttcttaatgatttaggataccagctcacaactcaaagcatgaagcatgtggcaatactataggaggtaagagatctcatgacaggaaactcgggttattcattcattcatccatctagtcattcatccatgcatatatccatctctccactcagtcactgtgtcaacagatatttaccatgtaactatctctgtacttggtactggggcagaggtgagcaaaacagataaagcccctggcctcacagtgttcacagtctaatgaaagcacaaacatcaatcagtgacattactgtgcaatcacaaattgagataatacttgaaaggaaagtaatgggagcctatgacaaagatctggatttggggtagggtcagatttaagaaaatgagacctgagagctgaactgataggcaagttgacattaattaggtggaaggcaggtgaaagaatggggctagagaactaataaggagataataacatatgtagaggttcatggaggaagggaatataaagtattcaaggagctatgagccagagcacatcgagcaggtcaatgagggaaagagtggtatgagaaaaacctggaaaggcagagaggaggtggaccatattaaggtgcatagggtggcagtggaaaccactgaaaaatttgagagagaggaagacagtgggtggaagaaaggggacaactgtgattgttcagacttcagtgaccacaaacaatacagggagcatggtgagatcagaatggagatgcagcaacctgtaacaggtcacttagttcagatcagagacacttggtagctttgattaggtgatggtggtagagatgagcagaaatggatggatttaagaaatattgtggggtaaaatctaaagcacttactgataaattggatttgggaagatgaggaagcaggaggcaaggataatccctagatttctgacctgaccagatagatgttgctactcactggctggcaacttcacaaggtggccttgttgactttggaataccttttgggcatcctagtggagtggcctaaaagggagttaggttttacatgttaggagttcagaaaagaggtctggggtggagacattatcttgacagtcagttttatagctagaaatggttgaggctttgggatagatagagaaggggtactttggaaaacaatgttcatggaaagcaataaacattctcgtcaatcactatattcttctaatacacttcttccttttgttatgagcatctgcatctttcttcctcttgcgtttcaataaaagcttctatttttaattacacttcccttggttctaatttttaaaagtattttgcatatctgttttatactatgtatccctataaccactccaacttttgtagaatgaggagagaggaccaattactagttttcagaagatccacatgagactccaaatggtcaaattatcctgacagcgaacccagcaaggaatagattaaatttgaatagtgcactcaaaaggactatctttgagactctaagacgattcttgattcattcatttcgtgaaagccaaaatgtccgaaagtggtttgcggatgaggggactgaatcgtgaatttgaggcctaaagaatttcccaatgttcagccttatggtggattaaatttaccatgactaattggaggattcaaagctgttaggaacactagctattagggccatttttctcatcttcgatcttactgcttgactgattcatagctggaactgctaggccgttatggaaatggaaatgcagagatgaagcagttcccaatgtcaaaaacttccagggacatgtaaatacaatacacgtaccaagtaatgagtttaattacttaattattagatactgagcactaaaatttaactaacacctggttccataaggaaaaaaatacttcatttcgctgtacttatagctctttattatgccttttgaattatctgaaatccactgatgtacgggtaaaaaactcctgcagctagctcagtgtctgtccaaatggccacccagttttgtgcttgaaatccaggaccccactggtgtaggcatctgtggggaatctcctggtctgtgggttgtgaagaccatgggaaaagcgtggtatctgggctggagcgcaccattcctcaaggcacggtcccacatggcttcccttggctaggggagggagttccctgaccccttgtgcttcccaagtgaggcgacaccccaccctgcttcccctcgccccctgtgggctgcacccactgtctaaccagtcccagtgagatgagccaggtacctcagttggaaatgcagaaagcacctgccttctgcattgatctcgctggaagctgtagcccagagctgttcctattcggccatcttgacagccaccaccccatttttcaattttttttatgacaggctaactgtgggctttcctaagagacatgagagtagtatccttcccctacaatcctcaggcctagcatggtgtctggcatataacaaataaatcaatgcagcctctcaaggaatcctcaaaatacagcagaatcattctagaaaacaattcatttcgattaaagaaatgaacaccatagagatgttccattggaagacttttgaaccaaaacatttaattcgccagtcctgaccatatctataacaaaaggaactatgtctttaacgtatttttcttgaaagccagttcatatggttgagagagcttataaggaatactaaaatagggaatataatcagccttctgtttttgagcaaaagtgctgtcaactagagatggggctcttggaaaatactttatactgcctgttctcagtttttttcttcttaagagctacttcatttcattgttcaaagtttagtgagagccaaaagaaaatacaatctatttacaataaacctatactttccagaatcaccttaaattatttctgctaactctaagcataaatcaaaagttctgaaaagcagaatggcctaaagaggaaatatgtcatttgtgtagttttgggaggggagggagtctgttaggaaagataaattattattgtcctaagcaaaaggacagctaatgaattcctaaatgacagggtttaatcctcaggcttgttgactacaaggttatagagctttcttcctttccattgttaaggagatatttaaatgtaaacatcttttctaaccttggaaggaaactgatggaaaacagtgagtattttcttggtgcaatttaaatattaaattcaaacttaaagcaattgttcacacatgcatttgctagctcaagaacacaaacataatctgtgggaataagaatcacaataaatgaaataataatagaacaactgaatccatcaatttttctagcatatatacactaagcaaatagtttgcactttgcataggattcagcattgccaatattttatttctaataagccaggtataataagaaaagcaaaatgtattggccaggtgcagtggcccatgcctgtaatcccagcactttgggaggccaaagcgggcagatcacgaggtcaggagatacagaccatcctggctaacacggtgaaaccccatctctaccaaaaatacacacacataaaaaaaaatttgctgggcatggtggcaggcacctgtagtccccagctacttgggaggctgaggcagcagaatggcgtgaacccaggaggtggagttcgcaatgagccgagatcacaccactgcactccagcctgggtgacagagcgagactccatctcaaaaaataataataataataataataaaagaaaagaaaaatgtattgttagtcttaaatattttctggttttaaattgagtcgaaaactcatggctcaagttcatttaaagtccaagtctgaattctaaaggttaaatgctagtaccgttagttcctcaaattattcacttgttttttatttttgttacatgagagagagaaggaggaggagagagagagagagacagaaagagatatcacagaattagaacttgaatctcattcagtggatagggatgagaagaaaaatgaacattcacagagcgcctaacatgtttcacgtatccaagtatcacatcaggaactttcatacttatgatttcatttattcctaaaaattaagtaactaagtttcagaaaaatagagtgacttgctaaagataattcagtgactgagtggtggaatcccagttttgaagatagagctctttgactccaagaagaattctcaatccataaagctttactacaaattagggaaaatggcttatctttaaaatagcgtgtgaataaataaatgagtaaagtttccatggggacataggcagcaaattaacagaacacaatttaaaatgttggatgtaaactaataaacagatgcatgtcactaaaacgtcacatttttcatcgtaacagtgtattatctgttggcaaagacctcagtaaagctgtttttatacaacagaagcacagctggctaaaaacagaacaaatgtggtcaaccaactaaaattttcaattcgttcaatgccaagaatctgcatggaatgacgttttaaataaaacaacctgaaagtaagctgacccataacaatttggtttttatctttaataactttaaatttttggttaatgtctctataaacagcctacatattattcagggtaaaggctcaaatatattatactaaaattgcttttagacccagaaaattcctttgcatggaggtatgaaaaaggaacatttgaaattagcttgaaatttgggtgtatttcagatatgacatgccattcacattcatgtgtttccattccccatgaacaatgggctgcgtgggccagtatcaatcatctattaatccagaactttccatactacctattagttaataaagtacattgacatccattaccccatgtgatgggatatttaacacacttccagaacatagaataaaaataaaggggtttatactttacctagaaggctagtgacttaagaattttggtgggaagtttcatccactagaggaaaagtcttatgattatgtggaaattatttatcacatgcccccaacaaaccccacaacatcacaatagacaaatagtggtgctcaaatagtgaacattatggaaataagggagaacatacatctctacccattcccaatagttttgaacttaggtatttataaaattaatttcatgatgctgcacataaatcttaattctaatgtgcataaacagaaaaaagcaagttgtataattattctgtgttattatttttaaaagccctatatatcaaaccaaaacaaatcaatataatgccaccaatgtgaatatcattaggctcagcatcttaaactcagcatgatatccatcgggccataaatttgaaggaaaatattcaataccagtttcataaatcatattaacattaggagaaaatctattatagcacaaagtcttattcaagggaaaatcatgttcataggaattaaacaaacaaaaaaacacttgtggccctctgctctattatccttaaattttaggaaataactaattataggagagttttcagtcatgtaaatcagagagttagcaaaacaatggttatattatgacagcaatcaataatagcatgcatttttattaaaacattactttctaaatttgtagggctttaaattgtctagcagaacacagcttgaagtatgatatatggatggaggttcatagaaaatatagtgtatgggaaatacagactccactcaggagatatatctgatttaaacacatgcatatatatgtgacaatatatatctaattatatactaaatctcacagaactacataaatatcttcttgcttgctttctacagtttctttaagaaaatattatttaagaggtgacaagtttcttgttgttgttgagcaacttgaattacttagtttcttgcagaactgtgtcttcttccagctagagtgtaaaatcacttggaatcataacatattcaaagagttttgtcttaacaaatccatgagtgatcaacttccttccatcctcaacaaagctgagaggtagaccttgccagttctaacctagcactggagtttaggtttattagatttagccagaaccttcaagtgattcttgaaatgaactttttaaagagaattaattaagcccaatttctagcctacatgattcccatgactatacatttatattagaattgatattcaaaactaactataaatatttaaaatccttttatcaacaaatgaaactagatcagcacagagaaagttgaactcaacttctaatttcctcctcttggctctatcaaacaagagcaaatcaaactggctgctaagagaactgatgaccaagacagactgggaaatgagacttctagggagtatgtcaccgtcttaaaggcctttctagactggatgaatagaaataactggcagataaaactgataaactgatttgaaaacatctaagtaaacatggccacatgcaaaggtatccagagaaagataattctagaatttgcagataaaactgctgaattgctttttggagcctgtgaagaattacagcagaggtattctaacaaagcagaggtattcaaacaaataagactcttagtattcaacctcccattgggcaaaaactagaagctggcacccaagagagaaagcacctctttcttgtcccccaagcatgtggcttggactggattttaccccaagtcccactgtagccagaaactttcatgtagggcataacctgtgcaactcacatatggttgtcctggatctaaatactgtataagaataaatatctctttatcaaaagaactaactacagctagccatgtgttacttaacaatggggatacatgctgagaagtatactagtatatttcacccttgtgcaaacatcatagagtgtactcatacaaacctagatggtacagctctctgcacagctaggctatatgctatacccttcagctcctaggttacaaaggtatagagcatgttactcacttaatactgtagttaatggtaacataatgataagtattcatgtatctaaataaatatagaaaagatacagtaaaactatggtataaaagataagaaatatggtattcctatatagggcacttaccatgaatggagcttgttggattggaagttgctttgggtgagtcagtgagtaaggggtgactgaatttgaaggcctggggcattactgtacatttctatagactttctgtacactgtatacttaggctatactaaatgaatcttctaaatttatgtaataaattaatcagcttactggaactttttaactttatcaactttaattttcttaactttttgacttttgtaataacatgtagcttaaaacacaaatacactgtacaggtatacaaaaatattttctttctttattctatttttaaaaccttttattttttactttttacacttttgtgttaaaaaccaacacacacacacacattagtctaggtctacacaaggtcaggatcatcagtatcactctcttctatgtccacatcttgtcccactgaaaggccttcaggggcactcaccatggagccgtcttctcctatgataacaatgcattcttctgcaatagtccctgaaggacctgcttgaagcggttttaaagttatctttttaaaaaaataataaatacactctaaaataacaataaaaaagtatagtatagtaagggtacaaactagtaacatagtcgtttattatcaagtattatgtactgaacataactgtacgtgtgatacttttatacgactggcagcatagctttgtttacaccagcactgctatgaacaagggaataatgcaatggactacaacgtaaagacagctacgacattgcaaggcagtaggaaattttcagctccattataatcttatagggccaccttcatacatgcggtctgtggttgactgaaattttatgcagtgcatgactactataaccttacaagcttgataaaaggcaggtaaaattctaaaatgcactgtttcagaagggttggtggaagcttggcaaaggtgttcacgaagagccagcatggctcccaaaggcacctcagtttctatgtttgttggataagcccagtagatccaaagaatgctacaaaatacaacatatagtatataaagctaccataattctgctttaggggaggatggagaagaaaagattagatgaacaaaggaagaaaagagtgaagaaaatgaagaaaaggagaaggaagaagaaagtctaagaaacataaaagaaaaaagaatggagaaaagatatcttagaaaatggaaaatgaaggaattaagaagaatcaggatatctgcaagttatatgacatactctctcacaatacctttgcgaagcatgtcattttcatctaacacagcagggctcaagcaagagtaatatagtaatattcaaaaagaccaggggtaggtagtcagttttccacctttaccaatatggaggaacactgatgtaaagaaaactatcacctatctttttagggaggcatttttagtgtataatcaggactttagaaggcaaactttctttaggctgtacccaccattgaccttaactgagaacacctctaccaaggtcagggggccaagactctccactccaggtgatgaaatcatacagtttcgatatgatttcacaatatgaactgtagatttttgataaagtaaaggcctggccagaaaaagggcagaaacctatatgaactttaaggtggtcagaaagctcagctctacttaagaaacacttttagactcactttagtaggctatcaaaacaaaaacaaaaacaaaaacaaaaaaagacacaaaaaggaaaaaaaaaatagttgtaccttcaagatatctcttgcaggaagcctagtccatcaagaaataaaccttcatctcccgattccaaaaatcagataccagcagttctcacaatgcctctagtggtaattctgtggttttatatcaagttctctatcctccccagagactcacagaaatggcatctcagcacttttaatccattactccccattaagtccattagttacataagcctagaagataccagtataggtcagcatgtgccaaagtgtgtttccacaagcactcaacgctgctagatgctaaaacacgctctgtgaacaaaagcgcttgctgtcaaatgcttttgagagatgctagagttaaacaaagctaaagttgtttatttgctgccagatttctgggagcctttcagatgccaatgcagcctgtggcagtgcaggaaagagaccaagaatgcaacatttcccacacattcttcactagggtctcttcatcttcgaattttgctgagcatcatcacagtcaactgctctaatgaacatattttgggaaatatacaaagaagaggtcagctaggtcatgtgagaaatccatgtttcgttcattgctcacacattaaattttctgcacaaacacattattctctgtgaaattatccttcactcgtagggaaaacaacaatagaagtcctctgcatctaaatccaaagggatctgagctgttctacgcatatttactgtgttgcttaagaatgtctcatggttctttcctatggcaatctccattccattattcaaaaatacaaattaatcacattctaagcaattgttcagtttccttcatttgtatgtggttgcagtctgtaagtgaaattccttaatttcttttctcaaagaaagcttctatccatacaaaacagtccccaaacccccaaattttgggctctaatatgagttaagtagaaaggtaaatgctaatgtttcattaatcctaacgcttgaatttcaccccaacctctgcagtgttctgctctctctgaagtgcttgtttgcttttcagttccccaaatttggctctggtaaaaacaaaacaaaacaaacaaacaaacactaatgggaacagtaactgtgttttgtataatttggggccattaccagctactttatgcttcatttgcgtacttgcgtgtattagatacattttgttaagttcacctaaggatatttccctcaatgggcacaaattcatggtgcctataaggtgactttagtacagcttcatcatctacactaatatttccagcagcccctcaaaagcgagatattttcttgaaagtaaaataacaaaacttactgtatgtctgatactgcagaggccacttaaattgtctataataagtccaaggaaaggatcgttgaagttaactggccttgggaatttcaagtacacctccctttgaaataaaaccatttccaaagaacgtcatgtcaaatgcacatctccctccagaaaattgtgttttcttttcaccccacccagaacataactgaatatcattttgctgggtagggaacctccctaacctgccttaagtctcatctatttccatttaaccatagttcccagctaacactacctctttcccaagtttacctctggcaagacaaaaaggatggtctttatgaacagatggtcttttcaaggtaaagtagttacatttaaatacagataaatgtactgtaaaaaacggctttaaaagaatttaggtctttaagggggaaaatatgagagcacaagacactattctttaattacatgagatttcttttttcttcccttgaagacaaaaccaattcctaatgaagcataatgaatcgtaaagaggcaccaatgctcatcccaacagatgtttattgattggtgttgactgaacacaaacacaagggtgttgcttactattgtcagtaagtggtgggaagcagcaccagttccccctggttattttacctttcaaagacaagctgacaaatttattttgtcacgagcagctgtgttcttatttttataagggttggcttacaactaagaaagcaagcggagggaacagccttttggtgtccaatgtgttatctggcaaggacagattgttttagggtgcaatggaaaagatttttaatgaaactacatttcaaacgagcagcatatgcttgattttcccttctgctactcatcctgccatttgttaatttttgttattgttgttctccgggactcctaaattttcatacaagctgtctcgtccggcactaacacagcttggggcgaattaatgcttgggatgcaaaaacctgcacgtcccactccagccatttttttttttttcatttctaaaatttctacattcaatcagggtttaaccggtgaactagttgacggaacaagcagggattaaaaaaaaaaaattcctcctctttgtgagtccttggagccccagagccagaaaatgtgacttcagaatatgtgtggacttgtcagcagctcagctgcacacaattatggggtcagagcccagattggaggtctggagaaactctgaaattgggaattaggacaaaatttttttctttttaacaccgtaatgccacatattaatttaaatgattctctcagaatgattctgtggcccagttaaatgaagttcaaggaaatgaatttcagcctttgacactctgagtcctatttgaaagtagtcggctttacaagattaaaaacaaattacagggaatacgaaatctttgattagcaggtgctttgatagctgcaagaatattttttctcaaaaatgtgaacacacatgggagaggcaccactattattatctttgtgtggaaggccttataatgaggattccattgtgtccagagactgaggacatgaattgctatgtctgaagggtcctggttcaagaggtgatttcagtaagacacagctgatagatagaacctaaggtttcatgggttcataaactctctttttttgctaacctcccataatcaattgaagaatttaagggactcacccctttctgtaggattcccttcataactaatgggaggcagaacttttcaacagagaaagagaatgctcgacatttttcaataccatgtgcatcaaccaatgggagaaaagggtcttggaagtttagacagagtctttggtcagctctgagctcaggaagactgaagtccatgtccaggttgccccattcactcattgtatgaccttgggcaagatacgtcaattctaaggagttcagttttctcgtctatactgtgggcatttcaagggtcactgtgcagatgaaacgagttaccacagggtgtggcatacagtaaaaacaagttaaatggcaacaaaatataatcagaaattgcaccaacgtcagtgccttattccatctcatttctcccattcagttagtttccaagttataagggttcaaccccttcatgctaggccctgtgcagacatgccttgctccatcacatgttcagccttgaatggataggaatgtccactgcttggtcactgttacagaactacacatatgagatgctccatcattatgtaactcatggaccagctagcaagatggcactagtgtcctagtgaggatgggtactcagaaccaagatattagagacagaatgtgccctgttaagttcagaacatataaagtaaatactctagagtttcagactaacttgatggaatattcaagaggcttgataagccctgaatggggccttgtgagacatagggccacttaaccttggacagtaagaatattattgccagcaactcaagtgtgtctctcatgaagaactggggctacctgtgaagcttggttcactagccatccccagactattccttggcatgtttggctgggaaggtatccttggcgctcactgtagtatcatacatttcagtagctctatgggtcagggttgatattctcaccaagcctccagcctaaacctctgagggtgcctattcttcattcctccagtgtcacctgtctcacacggggccagtcagctttttcctgcaggttccatcctgccccagattctgaaccaatcaaactccctgacaagtggaatccaagtcctatgagttcacagcttaaagtcttcacagcaagtcagaccaatgcctgaccctgctctgctcctgcaagtggcttataccctagtttagctcactgagtttctcttgtcttattcagtacaggtctcagtagtactcctgttcatttgggattggttttctaccttgtctcctcgaggttctctggaaaacagaagcaaaccagtatttgctggcccctacctagtgctttcatcaaattgatctacatgttgctcttcagtcacaggctccctcacttccgtatttttgctcctgacttatctcttcctcaaccccattctcaatctcagctcctctactgataaaatccctcccagttgaataccaactcttccatgaacctcagctagacagggtgtgtctccctcctctaactcttaaagtacttggtttctcaattctggtgcttctcactgcttcccatgatggcaattactgacatgtcttctctttctggttaaactcttgactgtcttccaaatgcatcttgccttatccactcgcatttcctctaatctgtcttccatcctaaccgtatagtgacgctcttgaaacacaattctgattccctctgtttctggccttcagtcatttcctaccatattaaaaatagagacttggatcccaaacgaagcctagaaggctttagttggccccattatctttactgccttatcttgcatttttggtcttctcttgccttgtgctcccaccacaccaacctctctcttctgccacaggccctctgcacatgctgtatccctccccaacctctgtctctgccttcactgacacctattcatcccttacaacccaattcaatcatgttttaaagaagatctcttgtggtctttccaactaggccagttttccctaagatatcctaccacaaacatgtcttctttatagcataaagatgtaattttaagttttttattaatttcctgctatcccactagattgtaacctccctgatggcaagaaccatgttagattttgttcaacatttcatccccataagttctgagaatatttatataatagttgctcaattaaatatttgctgattgaagttattttgggccaaagaccaggtttcatttttcttctcagcccactgatttctggcacaaaggagaggttccataactaactgttcaccaccaatgaaaatacaggtataatgtttaaaagcttcctatttcttcttgtggtactattaagtaggaccagagcagcagtacttcacaggggtagtgtggcatcttcaagtacaatgatttgtaggggataaagaaaagaaaaaaaaaacccacaaaactagtttgtgccacatataaggaagaatatggttctcttgggcaaaaatggcattgttttcaacaactgatatggactgcctcataattgctatagccttagcaatctatactggccataaaggcaagccaaagggaactgttatgactccagagagttaccattgcctgtctattaggccaagttgtaccccaaccccaaaatgacagatgatttgctacacagtgcccaagagaaggaagaataataaaagaaaagccgtgttctcattctgtgcatagttttgcctcacttcgtacagtaagtccaggagtcttattttccaaagtaaaaatggtgaaatttgtctttaaacactgcttctaaatgtgttggttagatgcttcatttctacaattaaacacctacctactggcttcagcaccaggtatttaggccatcctggcctagttccactgactattccagtgtctataaaacaccttcaccaagcatgagaaacaaacacagactttattttctacctcatctgtcttgcatttccttgtgcttaatactgtgacatttaagtggcagtgacacaatcagcaaacctagtgaaggatgagtctatgtaaaggcaaccatgtttgcgggcagagaatatcaactttatacgtacctaaatgactgctgtgtgcacagcagccaagcccaataaatgttaaatcacaaaactcacactataagctgaaagtgcctttaggtgtgtgaattccagtttcatgttgcaaagctacctaatattctaaggttgtcgggggagatatggaaattgagtctatagtagagagaaaagttctacaccaactccagaccttatcagtggtcaatataccaacccaacaaaagcaggttgcattctaccacggctattcattacaaataattttacttatattcagtgccaatgcccagccttctctagtccctgttctagctttacttttcttcattgcactaatcgccacttaacatgtgcatattttacttatttttttgtgggccctcattcccctcaaccaaaatgcaaactaagaagacagagatttttatcagttttattcattactgtatcccaagaagctaggatacaggggattctctctgagattatttgctggcaaatgaatgagattcttggcatttgctaggcactgttcctttcgctttccatgaattagaagaaggcaacataaatgaatagccaaaagcttgggcctcagagtgagataacctaagtcccaaaccttatgaagtgtttatcttgggcaagtctcttaaactctctgtgtcccaagtggctacctctaaaagggagatgataaaaaggacactacataaaagggctactatgaaatgtaatgagattataaatatactgtaagatgctttgcatagttcctggccacacagtaactaaacaacaaatgttagccattatttttattttctttctattatttttataattattaactattaaaataaaggtaggaactattatcattctctttctacaattgacggtacaaagaatgcttctgcttgaagttgcaaaatgttacaaatggttaaaaaaacattagagaaagagagcaggagagaaggaagagtaagaagcgttacaggaagaatcaagagatactagcctagaaataaaaagactcatcctggagaacttggttaaggtgggttctgtgagcatgtgggagcctggtaggtccagaatagacacttcttatagcagatctagaactggcaacgaactgtagtaagccaaagagtgaggtaggacctaacagattggactaggaatccaacctacatgacctagatttctgattatctggctccacttcctttaccgtcacagagagtaaggtctccagttcctcccctgtactagaatgctcccagacaacctaggtgattagtgagagtttaagttctctactctgaaggacttgggttcagacacaactcaatcacttataagcttagtgaccttggactgacccttaatttcttcatttgcaaaatgaggaaactaactgcatcttatcccatagggttgccatgaagataaaatgagatggctcccaacaagtactggatgctgtctggggggtaaaggaagctttcaataatcacataaacagaagtagcattcaacctggctgagcaaatgctttagataaaatcgaagttctttctcttccctgccctgactccccagaagagaataatatatggtataagcaaatccaaaaatacccgctaaaggaagttaacaatcagcaactatcattcttaatgtcttgggcaaatcagcatacttttcaaatacaaaaaacacaaacaaacaaacaaacaaataacacctcaaataattaagtactttatgaaaataagtcaaagtttctttagaaactttgtcttaagaatcagacaaaggccagcccaccacctatgtcatggaggggtcataaggaaagagaatgaagaaagagaaaaagaaaaaggggtgaaattctaatatttaacatctccaggcacacgccccagcctctcacgcagccctacctaccacaaccaaccaccacatttgatgcttgaaatctacctaaatcaaatcgatatttgccttagcactttccaaatatctaggcttcccctagaaatacttacaagggagatgatattcagtttagactcaaaggccagttgtttcaaatgtcaagtgaaataatatctcctcctccttcatcgtgctcataaacttatacaacaaagacatcctgaccctcagaggtcagagaactcaagcaagagaacgagaatgcaagatatctccaaggttattttggaactaggcatggcttgaagacacatctaatggtgaagggcttttaattgagatgctgcacaccacctggttggggttggggtctctgggtgggtggatcaggcagtgggggacagtgaaaactggtgaaattatcttggaatgtgcttttatccatagagcttggatatacccttccttagctgatcagagagggcccgggaaccaaaagacattaagatcttagaatgcattttctactctctcattttatagatagcacaactgagtcccagataaaataaaagtgtttttcccaatatcatacatctgctgatggtcctgacttagccactaggcaagtcccccagactccagcctgcggttgcttccatctatcaaggcctcttttcaagctacttggaaggctctcctagcaaagatgactacaatttatgctcccttcacaacattttgattgatttttggtggaaaagtaggcatccctgaagcatttctttaaaataaatccagcctgccaaaccagcactgatgtacaaccctagtagaagaatccaccattggccacaataatagcaaaaagggtaatgagaaataaacgtatttaagtttacaagcctcgaagaggttatcacacacaatgacaggaatctttgtgtcaggactgaacaagtaaccctgatttaactttacattttgatagagtcagccgcgttgcagtcattgtttcgtctaacaattaaaagcggaatttgaaactattcctgtccatagttccccttaaaaaatctaaagcaaagagattctctcatgccaggattgaatgaatttataattatctatctgtagctccaggacaaaagacttaaacacaaaaaagccaaataaaccaaggacaaatttctgatagttctagttaccctgcctattaaatgatagacacattaaaagaaagagagtgatatttggaatattcagaagttggtggtccatttctcatgctttgttttagtatcactctttcttagacgaaagacagtcatgaagttgtttgtgaagactctcatcagacaagagtacagtgttaataaatgcatttagcaagcatttactatgtgccaaacactatgctatgtatgggctgtcatgtacaatctcagttcatcctcataataaacctgtgggtaagtattattgctaatttcagtttaaagaaattagcaataatacttgaggaaactgaggcctaaaacaggcaaagtaacttactccagttgcatggctaataacttgcaatttggactcaaattccaaagcctgtatgtttttactcgctaaagtttgtggtcttggccagcaaatttcaagaaggcctgtcataaagccgtgctgagagggccaccttacatgccaattacaaccttatttaaaatttaaagtacgttatttcttcctgaaatggaaaataaaccattagatatctacaatattactatgctttagagtcccaaaatcactcatgtataattagttatacccatgatgtaaatattttaaatattattaaatgccttactataaatattagaggctggaatagttaaacagccaattaactagctagtggccatctctttacctctcagcatttctactctgttatctgaaacaacccatacaagtatctaagtagaagtttagaaacaacggggctttggggagctgctgaggagggacactttgcaacctccaaaattactgcaaaactatgtgcatatgcctatccaatagtttttcagtaattttggaggtttcaaagtgtccctcctgcccagctccccaaagcccatacagaaacctatttgagaagctttcgatctaagaaatgggatctgggaccttaaaaaaaggctaaaactcaatggtctggatatttgtgagactatattccaaccagtacaccaggttactgcttcccagactctgttcttcaaaagacaatgtgtcaagtttccaaattatggggggcaagggtagtgaaaagtgagtgtgaacctaacagacaactaactgaatacttccctctgcatctggaggcttaggaattcagcagacagacataagcaaaccattctgtgaaattgttagggtgctattctttctgacattgtgttggtttcctattgaacatctgaagactgttttaacatgtgtgcctaaaaatgtcacactgaggctgagagagcacagagccaggggccacccagactttcaaatcagctctcagaagcagccagggaaattccaaccttggtcttgtggtcctcaagaactacagaagcatggcagaattttagattcacaggttgtttgtacagttagtgcatttatacctaactcctcaaagccagagatattttttataactcagcattgccctcattgctttcttatcacatattttgcatgtgtttccatctccaagattcagggaaaacaagatacttagttgggaatgtctagagtggagaccttataaaaattacttgacagacttgggagaggaaagcattttgcaaaacaccagctatgagaataaacaattttagagaatcccttggggacattttttttcctatggatcccaaaatcttttttaaatagaaacatctcaggcaggggtaagaaattattggttaagcccatttagaacgtgtacgctgtcatggaacattcctatcaatggggcacattgaaactctacactaagatatggtggggctgtggtgctttactggataaataagaaggggtttggtcgctatactcccaccctgcccataaatgagtaagcccgtgtgacaagagtacatgttttcgaaaagaaagaaactgtgaaactgagcgtcaccatcctgccacataaaaagcaacagaaatgagaattaaattcagcactttcttaatgggagactgaggaaatctgggagatgaaacagtagctcttctccagtccttcccagcataataaggtcagctgacaacactgttcgacagagaagacttaatgtgtctgacagatggcaaatacaccatattgacttttcttcctaatttaacaaatttgaatcttttgtcaattttctttccccagtgaaaagatattctaaaacaccacttaagcttacattgctcttttccccctctccctcttacacattaagtttgacactatctaaagaaactgaagctaactcactaaattaactcacctttccagctcttcatgatcatcacaaatttgggcattggcatgaatgttaattcctcatctctgccaactgtaaggcagatactcacttcaggccagaggaaggtggctgaatggacaacaaggattccttgaactcttaaaaataacacacaaaagtgtgcatctatattcttcatacttcaaaactatgtatctatgttcttcaagagtccccagttttgcccagttcctgaaggtataatgcctctggctttagctataggttgttataattagccctcattctacagtttctaaccggactttggaattttatggggtttgtctatataagatggatgggatgatagcagagaagagcttcaaactagtggagctcctggatcacaaagctgtgtaagtcatcccaagtgtgactcaagttcagcctggagaagccatggccaggccaaggatagcttgtcccacaaggaggcaaggggccgtttcccaccactgcctcatcccttccaccatgtgaggacacagggagaagatagcatctatgaaccagaaagtgggcattcaccagacaacaaagctgccagtgtcttgatcttgaacttcccagcctcaagaatgtgagaaaaaaatgttggtcgtttataagccacccagtttgtggtattaccttagagcatcccaaatgaactaaactactgttttcataatttacaatgtgtcctaaaattaattataatcctaactatgaacatgaaattctgccaatgtgaaaataacattagtttctcttgacaacctttgtagttatgttacccaaaagtatctatagacaaagcatctgaagattttagtggttattcactattataaacaacaaccacaaaaaacccaccaccaacaaaaaaaacactgggtccatggagaaataagtttgaaaaatatttcattatgcaaagtaaaatggatttattacaaaaaccttcttagagcatctcatggaaatggagtttagaagaatactatgctttagattattcctgaatccagacacattttttttaaattttaactcaaaggattaaaatttccacacttggaatgcccctgtatgaggaagaactgaacgctgtcctgtcttgtctaagtttcagagtaatccctatgtttctagctgattagctggtttcataaggcaaagggccttctgaaaatgggccattgcttctgtgacaaattcaatatccaaattctattgctgcccttgaactgtgctctctgatttcctgctgcaaaaatgtaggccatcagtggggacgtgaaaaatttgttcattacacacagattcccacagtggcagtgcctggccacattaccgaacctatagataacatcacagcacctgacatccagcccacatttcctcagcctcagagtaaagaacataccacggtgcccgcacattaacgcagagagatgcccttgataattaacagttcttatggagtctctcgaatgctaaatggtcaaatagagaagttaaacacacataaaacatttaatgtgaaatgaggcaaatatgccaaattaacctgaaatgcacacaaaagcctttcagctctggaatcgatattaatcattttctggaattcaagaaaaagtctgatgtggttaatttaaaattgtattttatgatagagaacaaaaatatcccacaggattcaaggtatcagtttacactactgccactcctttttgctgccagggtcagcaaaaagaaaaaaaaaattattgatctggtattaaaaatcagttgacttcacttctttctgaacaggtattctttgaccactaagcactggctagtcttacctctctctagtgacaacatgaagagataaatagactattcaaacagagctcttcgcgttacattagctgaataaatagtgatgtatggtctcttttctcaagcactgccttagcttgtgaagatgagagtgaggaagatggggcttatgaatcctatttgaatatttaaataaacacaaaataacatccctgaagatggttgtttaagtggaaaaagaaggtatgaaaatctgtcttttaattgtagcttttggggcaacaaaaaatcccccaagaaacttttgagattccagtgtcaagtgaaatcacagaagaaaaaaaaaattaatttgtggttttataagcagtatccagaggaaatgggatgccagtcccacagggttttcaaaggctgcaaagctagcacaaaccaattcacctaaagtgaagtatattatcaataactaactgtgatcactttttggccttccagctaagatcaagtgtaataactaactttactttgggaatatttcacaatgaatttttgccctctttaatctgctttaagatttctgtgctcaatttccggtatatgccgtacttgcagaaagggatgaagttctgagctaggttaagtgcttgtggctaactacaaatgtgttaacacaatgtaattaggtcatcaaacagcatcatgtttattaggtaccaatagataaaaaaagggagcaggcctagaccagcacatcagccccagtccctactgtcttggaactgggattctgagacatctccgtggcttctacacattactggcataattactaaatccaaagttttctatttgtaaattagagattctagcaaggaaaagatgaagtcctatgcatcgtgcattagccaggattctttttttgattttttttttcattctgttgcccaggctggagcacaatgccactatctcagctcactgcaacccccacctccctggctcaagcgatcctcccacctcagtcttccaagtagctgggactagaggcatgtgccaccatgcccagctaatatttgtattttttgtagacatggggtttggctacgttgcccaggctggcctcaaactcctgagctcaagcagtcggcccacctcagtctcccaaagtgctaggattagaggtatgtgccaccactcccagcaggtcaggactcttttggaacaaaaagaaggggtatatttattggttcacataaacacatcctcaggaatgttaaggcagaaccagtacagtcctaccttcctattggcagttttactttctatggtttcaagttgcctacaatcaactatggcctgaaaataagtgactagagtacaatattctgagagcaagaaaaagaccacaattattaactttgtactacaatatattggtatagttgtactattttattagtagtaattgatctcttactgtgtctaatttataaattaaacttcatcgtaactatgtacatataggaaaaaacagtacaaacagaatttggtaccatctgcagttttaggcatccgctggggtcttagaatgtattccctttagataaggcggactaatgtatagtcctttccctctccagtgttggcttcattctctcagaataaagatgacaacctggctgtggaaggtggcctcaggaagctcccaacctagtaatcagagaagaatgagaggattgccccattagtaccagaaaatccctatattagcaaagacagggacctgatttggtcaagtctccattcctgtattacccctgtggccaaaggggattgagtaactataattaatccagtcatgagggaggaagagttgctgcatagaccaaaaacaagagcctctacgtactgaagtgatagggcaaagaacatatatttacgaattataaccaagtctaaattgtattcgaattcctagaagatcaatgttacttaactttcctgtgaataatactcttgcctcttactaagtagcacactatccctaatattccaaggtgaaactcagtcactgagaattgggcatgctgcaccagactgttttcccagtagtagcaggagatatgctgaacctcatattctttctctttactgctttattatcattaatgccttagactgaatttctccagaactgatcatgagacaggaatctgagtacaaatggattatttgagagatgggcccaggaagcaccattaggggagaagtggaagtaagacaggggaaaaaagaaatctactacaagaaacatttataagaatattagtgcttcaagcaattggggctcaaatccactggggggggctctggaagacagcgtggaacatgctaccctctgagttttcgcacttacgacataggaagctggggaatttatcctcaaattcccactggtattggctaaacattgttcctaaagtcaataattcctgacactttaggcctacactctacaccagcaagagaaagccccagagtgcagagtaaaaggcatgtgaaatagaataaccttagcacatatgagaagggtgagtcccagagaatggaaccaaggcacacagccttggctaataccagtaacacacacttatgaaaatgtgccttcatttattcaaatacttaccaagctcctattaagtttgagttttcttctagatgatgggcatacactgagggacaaaacaaagattattgtcttatttaatacccagcacaactgggcggggcaggggcagattccaggggctacatgtcataatcctcttcacaacagcaacttcaaatgtggtccctaatcttaagagtagcagcagggtcagcagtattgggcttcaccattactaagccaggtgtgttgaggtctatgatccagtaatgaacctgaatcagaaatggaatctcagataggtattggaaaagtgggagagttcccatcgtaggacagtgagttacattttgtttaggaaactcttcagggacatcttctctgtggtggcttgtgtccagaggcactgcagagttgcctgctctaactcttgacagttgagtggggcatgcagcttctggacatggaaaggactaaagttaatttgcccatctggggattgaactggcatcagtgacttcaaatgtgccctgcagagcccaaatgatctccattacaaacacagaatgctccgccttccaaatgccacagaattccattttatctgcactggcagggtaaggcagagtatttgccaaaactccagacatagggggttatttgtaaaaccttagagtattatcaggtgttgctttcaataaaccattacacttgtatagaaagtaacaaactacgtggtctaaggaccagttatccctattccaaaaaataaagtgtaagtaagtaaagcaattttacattgaatcttgaacatctatgtacataatttagaatttgctaaaaggtaattttatctgtgctgattatctttaccatttggcatttcccatctcagggcaatgagtacaacttcacaagtccagctccgcttagctgtgagtactcaatttcactaaagacttaaacagaaaattaaaaatctgtgagaattgggatgagtcctgtctgtcttaaagcagggtgagcaaatatatgtggcacatgcccttaagagacattattaattgatcacctctcactttcacactgagcctaggctgaaccttagaatccgtcacagcgcaggtgtccactcagtcatgactggccttccagaactgggtactggaaatgaaacctacttgacacttaggatacatttatagagcctggtcccctcagtactatactcccctctcacaaacagagagagagaaaaaaaagaggaagaggagagcagagaaaggatgggggaaggaatgagaggaagaaaaaaaactctgaaccaagtatcacttcctttgcggtctgcacatgtcaaggaatactccattttaagcatattataacggcaaaaagaaaaaagcactatcaatagcggttcacactttatggctgctcaccctgaaactgtagcagctaactttcttgggaaaactcagacagactcattctttccaaaaacaaggaaagaagaaaaagaatttcccacatccttaagataactgagaagctctcagtaggagtaaactgtccaaataaaattcaacggcaccccctttggaaggatagttaagaaacaccacatgtacaaagaaggattaagattccaaatactgtcttttctccaactcgatttttccttcttgtgcccttacttctcaaacagttattccctttgctatatcacccagaagtctgtgattggatctcccttggactccaaagggctctgggtatgagaaagtagtccaaaatatatatatatatatatatatatatatatatatatatatatacacacacacacacacacacacacacacatatatacacacacacacacacacacacatatatatgtgtacatatatgtctaggatttactatagaaaatttttaaaatatttttatgtatttatatttataatatatttacatatttagttttatatatatttatataaatatatacatatatttatataaatatatacatatatttatatatatataaatatatttatataaatatataaatatatatatataaatatattttgtattatatattaaaatatatacgtatatatgtgtatatatgtataggatttactatagaaaaatatttcatatttttatatattcatatattttatattatatattaaaaatatatgtacgtatgtataggatttatatacatatatgtatatatgtataggatttactatagaaaaatattttatattttatatatattaaaaaataaaaaaataaaaatataaaatatataaaatatataaaaatataaaatatatctatatatatctatattatatatagatatgaagatataaaaaatctatatattttatatagatataaaatatataattatataaataatatagacataaaaatatatatttatatattttttctataggaaatcctatatatatttatttatttatttaggactgcttttcctgaaactctgtaaaagttttcatcatactagctatttcttgtgatgagccagatcatcattcacctggtataaatgagcttggctgtgaacacggttagaaattagagccaaggatgatctattagttcatcgtgtgtgtctcatgggacaaaagcaaatgtgtttctctaaagagttttcttgaatggtttcccaagtccaacttgaaatcacattcacaatcttgtcattttcctctttcttgcagcacaccagtaattagatgttttaacacgtcatggcaatgatatctaacatgaaggcaaactgtattaagacacagcatcacccagttttatactgtaagctcatttccaaacattatttgtttttataaatttgagcgaggctgactctttcctctctgcctttaattaataaggaaagcttaatatgcacttttttttcatcaatctggcactaaaaatcctgaattccttttgtagtaatttgaaagaagagtttggggctattaggagaaattcacattaggcatttccctacatggcctacttatgtttttcaaagtgaagggatatttcaaggaaagaaagacttggggtactagagatgtctgccccatctaaagtcttatttttctatttcctatatcaagaagccttaggtacattttagtaacatagcttgaaatatattttgaaaaggggaacaagacgtaacctgacccactacagaaaaatgcctcatgtagatccttgaatgaatttatgactgtaaaagtccctctcttttgtttcctgggtaattatttcacacatttgggaggtttatagggaatgcgtatcagcttttcaagtaaaaagtgtgagtctctgactcttcctggaaatctggaagcaacagagaatgagaaattctcaggcagcctccaaaattgagcaagagatactgcaggtcaccttcagtgctgaatattccaaagttaacttcgttaaaaatgcacaaacaacctgataaaatatctgattttaccttttaaaagtaggattaaaaatttaggaagcttcgtgacttactctcgcatctctctttgatatttctttgtttggtatttctctcacctcttatgccctggtggagtctattgttggtttatgtgtaacatgatcgaataaagcaaaattgtaaacattttctttttaaataaatagacttttacctgaacattataatcacagtatctcattcatccattcactcattcattcatccatctattcattcattcacccattcatttattcactcaggtattttctgagttctttctgtgtatctggcgctcctctaagcagtggggatacacatgtcccctgttctcatgagcttacagtctcctggtgaaggattttaatcaaatcatcacacttgtgcctaagggtttcaaactgagataaggatctcaaaataaaggagcaaacacccgaaggatcaaggacgacttccctgtgggggtggtccctgagccaagggcttcagcagaagcagaggttaagtaagtaggaagtaggacaagccctccaagataggggaatgcagttagggcctcgagcaggaggaaacaggggcaaagctctgaaagtaaaggacaggtagtatttgctgagctactctaagacagattctcccacctatgctgacagcatgcacaatttcagctcaatgaatacaaatgaatgctctaagtattttttagattctctagattatgcacattgaggagcagtttggggtagggatgatggaggtctggccattagactcaggctttaaagaggttctgggaaggggagccaatctgaagtacctggaaattggaaaaaatagatgaacagtgattttatctggcttccaatggcagataaatttcctttcgggaaaggcagatattctcatttcaagccaggctcctctgccctcactttagcatatgaggaaactgagctcttgagttcctggaaacctttgagaatatggagacagccttttcactaggtcagtttagcttcagagggaatgagatggctgacttcccccacacattaggactttcattccaaccctcggccagcacctagggaacaaagcaaggccccagctttagttctacttaaagtgagacactgcttgctctttcacactcaggttaacattcactccaacaatgagttcagaagtgaccatgggaagacaagaggctttccaaataactacctcaccatggcacagggtctctgagggctgggcatgttagagtctgagatataaaacacagtataaagaacgttctattttgcaaaacaatcacattctacaatctatacctaagtaacaggaagagagcagatctcattatgtcccttctacaagaagaacatctgcattgagttgggtgtcttcatagggagtcattctcagggaacgtgaagcttcctccccatcaccctgacctcccttcccctgtaaatttccacattgattgattgtaaacaaattgtgttcatctgcccagattccattatatcaaaaagacatactcctctccacaaatatcggagatagacagacagataaagaggattactttccagtagcaggggttcctccccactcttcctccacagagaactttatttctagtacatagtagaagaaagagtcaagagacggatgagaagacaaactcagcaaagccttatttttatgctgctgttgtttttaacctttagtgggaagtaataggagacctcatactttatgaagcctttttgtatctggtggtagtttttaaaaagaccatcagctaaaatataaatataaatttaaccatggatgattgtaatttcctgcattatatttttatgtattttcgaaaagtatctgtaatgagcgagtatcatctctgtaatcagaaaagaaactatgaaaatatccccagtgagatctgtgtttgctcacagggcactatttggcatgatgagagtgaggggaatgatctgaatgttttcagtgccaagcaccatgttggcctcaatcggtagcaattctaattctttttcctgtggatttgtatcagttgctggttcatttaaatcagctattaaaggaataaacatgaatcttaaaaatacatttagagaaagtatattgttctaaattaagcaagcagttggcatttcaaatcatatggaagcagatgaggggaacccgctctcaccagatctcaatccactttgcaaactgcttactccttaacttggctccctaattagggcattttatctttgtgagcatttaccattactgcatcatgataactcttggctagtattctgtgaagaaataattaataataatccacaccagccaaaagtagatagagcaacatgagcaaagaactaggttggtgtgatgtggctcaataaccacttggggaaaaacaatgagagggtttttattgaccaaagtggtttaacaaatgacacttaagtgatctactggcattttagaacagaggcaagactgctcactcattaagtcattttaaaaatagtcattatagagcttttgccataaatcaagaacaaaagattccaggaaataattttttataattcataaacacatagtaatgtggaaagaaggactctatagagttgaacagggttatcaattacattttccagttgtctatcctagagacaacattccttccgtgagttcaaaccttaaacatccagatgaggtattgtgggtaaacttgaggattgacacacttcagcagactaccagctccatgagatcaagggccacatctgttttatttagcgagaagcagaattaggccatgtgtgacagtgggtgttactcagcaggtgctcagtgaataatgaatggattaatgacattgtatagtagtgtctgactttgcaaacagaaaatcacagcctttgtgaatgtaaatttacacagtaaacccaataccatatagacttttagtgatattttggtatttagaaaaaagactaagatcttctccaggtagaaaggtattttgtcaagtatttgctgtgtgtgtttgacttgttttggcctgcaatgtaaatgatcctgatagacatctagttctactgggttccacagcacttctttagccagtggggtcttgtattcaacttgtatttatcacgtccttctaatttcacttgtctcaccctggctgttattataatcccaaacagacagatacattagtaccccaggcttaagtctcatcctattcattgctatcgggttattctctaggaagcatctttcttttcatcttagtcccttcttccttccttccatcagtcctgaatgctttctgagtcaaattccgagagcagaccctggctcctgaatctttttatgctcagaccctgcaactgctcaacagtcgttgtctccctgatcctcttcacacagccatatgtcggccaagatgctcaactcactactgccacctttatacctaggctcatgccagtccctttgcagagaaagagaaacacagagggagagagaaacacagagtcttgagtccctggatcaagccatacctgaagtcagaaacttcccttgaactctttaattatgtgacccaataaatcatccatttactgtagccagtttgggttttctgacacttgcaactgaaagagtctttaacgtatgcagggaagaggagatgaggaagagaggaacataaaaatgaagtaaaacgaaacagaggaagaaaacaatgaaagatttgtccaaggctgtagaactaaacagtattggataagaatatagaacatgaagcccagagcccaagactctttcccctactacttcccttcagaaattagtactattactcattgccacacattgttactttaaacctaaccaaatgagaagtgacctgccatcaagctcccgcaggtttaagacatatatttgtcctgagtaacttatattgttttcctggcgtagtacatttaagaattacttttacaattaagctgcccaaggggtctatagatgcccgttttaatttaaataaatactaatgctaaaatcaatttgtaggatatttcaattggaccgataagtacagtcttcactaaatccaaagtatttccctattagcgcatctttagaagcgtataccaacaacacatcaggattttcagaaacctgctacaaatacattactcccagagactggatcaaacagctgatgatcaaaacataaggcaaaaactagtatttcatctttgaattcggagtacctgatttctactaaatattgattagagtttttcccataagagatcctgctttgtgcctccttaattttcttggtttcaatagtgctttgtgcagagaacagcagaagtaaggcagaggatacagctgtcatctgtgccacagacattgacatgcagcttagtcacagaacagagagaacacgtgaaagtcaccatcacaccctcgcaacagtgtcagtgtaaagactcaggttccagatatgaagacaggactgaaaatgcttctggctacaatgaaatgaatctaccacacacttgccaactttattcaaactgatgatatttttctttaaacaatggatttagttattctacccgtaagaagtccaggtcgttaatgaaatgataattttctacaaactaaaaacaaacatatctcatcctactaatggttcctgcctctccaatatttcacttaggccatctcccttttctcttctggtagaacaacttcaataggtaagaaagttttcttacatccgggaaatttctttaaccaccaaaatccatggtgtttgcttttcatcttcaactcactccttggtcgttacgacatgttgcctcctatttctggttatctatgttagtttcctgctcttcctacagaattgcaaccccggaaagagaggtactgagtctcacacaccttcttcacctggagcttgtaacaacatcctacaaagcaagtaatcaacatgtgttttacagagaaaactggttatccctggactgtattaaaacagtggtatgggtactctaaaataacaccaatgtgagtgtagaatgcatttctcatttaagagaggtgttcattcagcctgaggatgggagaatttacgaaacctcaaaccccaattggcaaacagcctctctaccttcccagtttacaaaaccctacctgagagaaggtgtcttctctcaaatgaagacttccagatcctgttctccacagacaattaaatgtggtttaaaagttgctgctgggagctgaggttattacccactttctgatgaggccggcgccaccaaaaccagcctgtgggagctgatttcactaggactcccccaacattttcttgatgttggaggtgtaacggggtctcagttcctgttcaactctgcctctgactggattctaggtcttgagcaagtcactgcttccctctgaacctcagttaacctcatctttaacatggggataaaattcctggcaccatagctacctcactcaatgctggggaaaattaataatattgatagtgttaataattaaataatagctaacatgcactgagttataccatattctaggcactgtgataagtcccatacctcccttaactcttactattctcataactactctatgacaccaagcaccatcattatgtctcttttacagatgaggaaagtgaagctcagagatgttaaataacttgtccaggatcacagagctaggaagaagcagagcaatatttgaacactggcattgtgggttacaaagcattactcccagaatactgccttacaaaaataagataagccatgtgacacaaaaatcttcacaaactgcaaaatattaagccactgtaaagtactgttaccatcaatgcaaatagatgctcattacatttattgtaaaaagcaggtaaccaccaacccgtttagggaaggtgcataaacctctgtcagcaatactcaatccatctgcagagaaacaattagaactgcattagcacataatcacagaagaagttctcttgacaccatttctgccaaagaactcattcttccctggaatttgaaaaggcaaaaagaaaaaaatcccatgccgcatctgacaataggaacaaactcttcttgcagctctggtaatgcaacacttctgaaagaacaagttaaggaacgtacttccactgccctcattagctgacaacctctgtggggactgcaaaccagccacacattcaaaacaaatcccagggaagaaatcacaccacaaagcctgtttctatttgcaagtaaaatgacggccccaagtgtctttccataaagctgtgtggtaccaaatccaaagcccaaactggttacaaagggtcgccattgataagacatggcatttcaggtccacccaccatgggccaaggaggtataaagctcagaacgtgacatgcaatttttaagccctcctttcaccttgtctatgcactaagttactttgacgccacacctgtttctattctgcctggaagccctgtctgcacaacagatggcagagtgtttgcctaacaaatgttcttgtgggtcagtataagaaggtggtggtggggattgttgtgggtacgaaaggagagaggctctgctagagcagcaaagaaccatcgatctccaacttagctagggaaacttcccacccaatgagggtctgggtatgtctgagctctgaatgttctcacctctgttcatcccttctgacaatcttgtccaggatagtacaaatctgctgctgcaaccggaaattacaaagaaaatctgatgtaggcatttagaaaaaaaaaacaacagaacaaaaccttatcaaatttaaaagttaacttcaaattcaattctaactctatctccaacttagctctcttgaatctaactgaagattcaactttcttaactctaaacttaacccttgaatcccaactcctagctttcacctctcaagtgtcttaactctaacttaaagtcaaacttagtctcttgaggaggtaattaaacttcaacaactaattggaatgagttcttgtgaactgagagcttggcttatcaacacatctggtcttcagaggttaagaaaaaactcactttctgttattgtaaacttaacaccagagtaatgttttatttcagctatgatggtaatattttttaaattatgctattatccacttaaaaaatccatgatgtaaggtataaagtaacataatgctccttgatggtgaaagcacatcttaggcaccatgctttggagaaaaactgtggatctggagggaatctcctcctcccaccctaaaccacacatacctaaaccacacacagcaccgggtatacctcagtcttcaacataaagaaccaactcggcacgttccatttcatttgactcacttgcttagatagcttaggaaaccaatctgctcaacattagtaagtctgggcccattaaaaggggactgacactaaactgaaatccatttcatctcttctccagggttttcctcggactctctgatcagcctttccttcacacaggggtgaggccaaaactactatagatgaagaagaagagagtgagatgatgttctttttgagggccaggatgacactggctttgtccagtgttttcatcacagaaattgaagtgggcatgtagtaggttctcaaaaaaacaaaacaaaactggtgaataaagacgatgtgtgctaagcactaagcagagacctccccattcgtgctcttatttaatactcacaaaatcctaacagcagggggtattattattccaattttgcaaccaaggaaacacatgcaaatagctaacagtggacagcatcagatttaaatacttaaagcatgcatttcccatgagtgagagagacattttgcaaacatgggtagaatgtggctttgtgacttgcctcaagattcaccccatcaatttaggcaaaaaatacaatcttccctgactatttagttggaagataacaagtcagggaaattcagtctagcagtccatgggtaagcctcaggggaataggaggcccctgaaattaaatgcgacattttgtgtgtatgtgaatttttccatggaaaaagtctgcagctttcgaatacttgaaagattctatggtcctcccagcccacaaaatttaatgacttagctgcttttaattaaagttatgcttctaattctcatccccaaagagtccaaagggctccagacaccctttgtatgcctactgaaagaaaaatgattagcatgaaagcctggtgggtattagacatgagaatagtcaaacaccttaggtatggaaagcacccacatagatcattacttaacgaagaaaagtaattgagaatgtattccattgctagcatttgtccacaatgagattgagaagccattctattgctgaccagatggtcctgaggatagtgaaatgacagaacccctgtatcactcatcagattcactgctcttcaaaatatgaaaaagaaccaacaaaatcctcattatgacagtgcctacaaacaagatccttctgaccatttcacattctgcaaacttcatctgcaataagaatgtccagacctgaggctctatacttggtgaaaccatgctcatgttcaaaaagcatttattgagagcctactatattctaagtaccgcaataaatacttgttcctataccatctggatgccctcatgtgattctaggcaacacgtttaaaagagaacagtcaccaaatagagaaccctgagatgggaggaaccagtttgggaaagggataaaaatcatgccatgtacacagccaaaggcattgatgattctttaaagggaaagtaatacattttctttcaacttctacaaagtttctaggtagaagaagaaatagagaatcaatccaaattgccagagaagtctgaaagaggaccacaaggtaaatatttcagagaagcaaagtgttggttcacaataataaaaagaaagaaaggaaatgaaaaagcaaactattatagctggggttattcaacaatggaataagacagctggtaaaatgttagtcgttgctggaggaatttgaaatgcatttatatgttaaaagcactaaagctaaaactataaaaccaaaagatgggttagtacaagatgattgtcctaaaatacaaagaaacacacattgtcagtatgtgaaccttaaaaactaatgttggttattctgtttaaagagaagaatgtgatgttcacaaatcaacttatcacaaattacatgcttactctagtaatgtaatgaccttgggagctgactcatagtcttccttgacctaatgagcatgctgagtataatcaattaggtttgcaattaaaattgcaatttatctaacacccccctctacccccacctttttataaggctcaggagacagtggggtgataaatataagcccttctgctgtggctatcttttattttttaagcatttctattacgtataatttattaaaccttaaatttcttccctatttgtaagtttcagcaaaatttagtcaggtttcaacacagggtatcaagggataattaggacagttagcagtaatttatcatttctcagctgggttttcatgctttcgctgactgcccgtagaaatctgttagccacttctacacagatcactatgaaatctgctttatctttgtgcaaattgcttttctattttcctaaagtgagctgaaagatgagccaatcgactcctgaaaatctagccaccggtgtgcttgtcatcagagtgcagctgaggccagggccgcagatgaagggctacagtggctaatggatgatgcaatgccatgagaggcttttttccagcctgctgcgggttagaaatttaaaccaggcagcccgacttcaggttagatcttcacaaaatatgcccaggaatctatgaacatgccaatacacattttatggagcaaatattgcctagtaagccaccagagaggaaaagcctagaaaaggcagagacactagtactataccacttccactgaaaagagggattttatgaagcctgaaccaaaaagggaggacctcgtgttctttagagagattcatttactagatggtgaaaaatgaatgcttcgggtaatttcattttgaattgatttatttctaaatggggggaaactgacacttggtgaagaaagtaacaagtggttctctggaaagagccagccagtctcaggtataatccaattattccaacacaggaaataaggacacagagggaagggtggaaggtcacctgagaaagtcattccttgcaatgaataccttcctgtccccttccctacagactctcagagaagtataaactgacccatatttccagtttatttctgacacctaaacctaatcaaagtccactatttagaaatccaatagttattcgcaattagactgcacggcaaattaaatcataaatttctctatctcagccctggttgtcacattcctaaaacacaacttgcctccctccggcactttatttaaatctctgaggccgggctccaaagcaagttatggatttgataatttgctaatgtggccacagtaattgttttgagccatatttatgattttattggatcttacaacaatcaataataatccattgatgtccctgactcgggttttctcgcagtcgacaaatggggcagcagattcatttttaatgtactcacttagcactccctccctgggagagagagccctgcatattttaaaaaagggcaagaaatgaatggcactggtacacatactttactgtgaaaaactagctgcaggataagatttaatgctaaaaagaaaggagagaatagactaacagggcccattttgtgcagcaccaccatcgttaaagttaatggaattaccgtgtggtcacgcactagagggaacctattggaagttaagctcttctagggccattgattcacagactttcattcaaagattcccactagcatgtgatgagtattgcagatatgcagaggcactttagaaactgtttactcaaactgccagttaagcatattaagaaacaacaataactgaatattttagagtggatgatctagtggaacgtgtcttctgttagacatagtaaaaacttcaactccgactggcttaaacaatagaggactttattggtcacctaatttttttcaggctggagtgcagtggtgcaatttcagctcgctgcaccctctgccgcctcccaggttcaagtgattcttgtgcctcagcctcccaagtagctgggattacaggggtgtgccaccacacctggctaatttttgtagttttagtagagacagggtttcaccatgttggacaggctggtcttcaactcctgacctcaggtaatccgcccacctcagcttcccaaagtgctgggattacaggtgtgagccactgttcctggccagatcacctaatttaaatgtctggaagtaatgcaggcttcaagtctggttaattcaacaatccaataatgtcacctagtgtccagcttctttctgtctctgccatgtcagcctcagcatctgttttgctctgaggcatgttgccctagaaaatataagatggctgctagaagctgtcagttacctgctttcttgttcataagcagtagtggagaaaacagcccatccacaactaatgcatctaagtcctccatgatgatgggactccgatcctttagagtgtaggattcctaaagtcaagggaatcctacactctaaatagcttaggaaaggattaatgaaagtcattactgtggcagagacaactgacttagactgggatgggcaaattatggccctcaggccaaatttggcccaccatctgcttttacaaataaagttttattggaatacggccatgcttatttgtgacaattcattttcatatattctatggcttcttttgtgctgtaaagtcagatacataattatgacaaagaccatctggccctcacagcctaaaatgtttactatctggccttttacaaaagaagtctgccaacccctggtgtgtaccaaacaaggtctgcacctggagctaaagatgagttcaaacccatcctaattttgtggctactaaatcaagagggagggtaggaagaatgctagagggacaaccacagtgcctaagatagacatgagagaaaatccttcaagtctagaaaaatgggcttagaaactaaaaaaaaaaacaatttaggaaacctatcataagcacatgtgaaataccctctgccctgaaatacactctgagtatcatcaaaacatcaaatatatttaaaattgaattacaattccttaccacagcataagtcccagtgtaacggctccccgcccactcttcccacttctctcctgctgccactctccctacactaaatttctgccacctggtcttcaattatttcctagaatgtgccaagctcattcccactgccatttcctcttcccagaatggtctttcttctccagctcttcgctggctaggcgcctgtcgttccctgttctgggtttatgggttatctcttcagtgaccaccccatctaaagtagccataccaccccattccccttccaccatgtcattccatttcataacaccttgttttagtctttctagtattaacccaaatctgcaatattttatttgttccctttcacataaggggaagaagacaatacactgagagtttttcctaggctgtcttgccttccactttaacccagtgcctgggagcacatggcacatagtaggcactcaataaacacttattggagtaatatgttaatattaactatagaatttctacaactttttcagccttcctgcattatggtgttcatttcaaagtctgtacttgaaaacaaggactacgtctcattcttcttaggttctcagagcctgtgacgatatctggcacatagtaggtgatagaagaataaattaatgaatgaatgccagatagaaaaacatgagtaggcaggatactcatttcctggaagggaggaacagactactttggtagtgaggaaatcgagatcagagcgattcagaactggaagcagctacctcacagtgctttgagtttccaggtatagaggaagatgaaagacagacttaaatgctacaggggtgattaactgtcaagtagtggatgatgctaatgacttttaaggtcacttgctcctctgggattttcttgaattatcccgtgctctgagtttcttccttaaagagtgagattcatcgatggtcatctgatagtggagcagagcttggagtcacatttattccttccttggccaaacagtttcatcaaaattatactgctagaacctgattacgtctgggaatttataccatttacaaccaacagacgaatttaaacgcaaataaaagcccctggtgagctgtttgtcagggcaccaggatggaaagcatgataagaaaatattttgtgggggaacacgaactgatatatggaccccagagtgggagacttgaatgtgaacgttaggataaatgaattccaccacaaagtaaaagaatatttggtgtgttcactttgttaactcaatgttgtttattcttctcaaccaccctaggcagggtcaacatcttaaagaattccatcttcatttttcatgtaacgtcaggaaccaggaagacttgtttaaaagaataaactaccagggaaagaaatggaagttttcattactggaatccaataatattatctttatgttgaataagcctagaatttcaaaccactgtttgtgtgtgtttttttgtttgttgttgtttgtttgtttgtttgttgcccttccctcctgaggttttggattaatctgatggagaaggcttccgaagatatatgtctcaacttccctgattttggtgaacaagaggcttctttggagaacggatctattagacaataaggtaggatggatgcctcatgacatgggaagttaaaatttcaaaatgaccctttcccagcactaacataattgacttagaaggagggaaaggattcctcaccatgtttggcctgagggccattatagagtctcaccatcccaacatttttcactcaaatgtcctcaggaaggtcattattctaattcttccacatctgtggctctgcaggttgccttgtctattattcattaagctggtttccatctgaccctggctcagccatgaaatctttaccttttccagctgctttttgtgtcttgagacttactttattaatgactttggcataaagggtaaagagaagcgcctgaggggactgaataatttgagatgagtatcaagaaagaatcaagtccaggtcatctagaccaagaatcaaaatatatttataaaaataaacaaatgaaattgcagttgatattctgggtaaccatcagaatcaactgtggacctttcaagaagctacttcatgggccccaccctcagagattggaaaataggaggcatgagaactagctatatgctaaagataataaagcaaagagaatgaattataatagtcatttcttaatggaaagtgcttcaaatggggcccttggtttttcttttaaaatgcactttaaataatagaatcaacaaccatgtacacattacccaatttaaaaataaaacactgtaaagccgaaaccctcaggtacaattcacatcccacattgcactgcttcccctcactatctccacccagaggcagtaagaatgttatctgtgtccttccttctaagccatatatagatctacatgtttataaattatatggcagcctataagcaacctgttcttttattttattatttcctgctgttaataactactagtcaaaagtttgtagcatttggatctgtttcagctaaaaggcccaatttcaatcaaggcacacattattgtatggtctttcattccccattctgtatttaaggatgtggtgtagtctaaaacaaatggttccagagcactttaagaggccaaggcaggaggatcacttgatgtcaggagtttgagaccagcctggccaacatgatgaaacctcatctctattaaaaatacaaataatagctaggcatggtggctcgggcctgtagtcctagttactcaggagggtgaggtgggaggattatttgaacccgggaggcagaggttttaataagccgagatcacaccactgcacttcagcctgggcaacaaagcgagactctgtctcaaaaaaataaaaataaaacaaatggctcatctactgaggttgaattggccactaatatttaatcaaaagtactgaatctttctcacatgattaattgggctgcatttattttacttttttttttttttttaacagaattgacagtttggccagccaagtatttggatatcacaggtttaaaattttgaaattagaatgagctgattacatggagttagagatttttatatttgatttcctaggcttgaaacacccatagcaaaatggtgaggcagagtagtgctccttcaatgattagttattgagcactagtatcctatagcaaaatgacaacagtgagtaaccggccttactacatcaacaaaggtaagactctgactgaataataacgccttacatttaggtggtattttagggtctacaaaacacttgcctttcacaggaggtttgacttcacagtgattaagtagaaattacaggctctgagcctcaggtgtaaaagacagtttactgaatcctataaaacactgaatgtccctactatatgtgccacgtgtcggcattacaaatagcaaaataaattaaacagccaaatatccactttgctatatgtcagggcctctaattactgaggggatttgtttggtagtactaatgaaaaattaaacactaaaagcatataattctgccataaattgacatacagcaataaagcagcatttaggttaagcttcacctgtgtaataaacagggattgtcctctggatatttttagatggaaaccaacattattccaagcagagcaaaataatacagattaatatgtggtaagggtgacaaaatatttacaaaacctgtgcttgagtttcttctactgtgattacaggatacaacatatttctttaggaacagcctggtcatatgatataatgaagagttgaaattttggataggcttgggtttgaatcccaattccactatctgtcaactgtgcttttccagtatgtgattttttttctttaaacctcagtttccctaagtgtaaaatattaatgcctacttttgcaggttgttgtgaggactgaagtaagaattataaaactaatggtgaacatgtattgagactttactatgtgccaggcactattttacagggatttacatgcattaatccatttggtcctcacaacactcccaagagacaggatactcttaagacctccattttctaagtttatgaatgaatgtgggggagctcagaaaggttaactcgcccagggttcatgcacctggtaggcgacagctctgggtttgaaaccaagtagtctggccccagagtcctccctcttcatcagtatgctttaacttccctgcattttcttctcaccctcatccctgcttcaggatctctctcatctctttcaccttagctgcctttgagtttgaatgaacagggaaaaagtaaataagaacgtgaaaatactagggagcttggttaatttttctttcagtgctttgatccaaatggtatcatgcaaatcaaagttaacaaactagaaacggaaaaactcaatgatttgtatctacttaggaaagggcctgagggtttagtaggagagaggaagtttcccaaaggagacaggcaggcccccagccccttctgcctggagagctggggactgggggttttgcctcaaatcaccaggagcgggagagggaggggaagtcagagatatttacatgccagaggaaaagggcttggaacctcaacacttctctaaggcgtccactcccacatgtacacccaaacccatccccctgagcactgcagttgtctttggtttaccaacccagtcaaactggattcattctgagggcagagatgcaaattttaaggcaattatacaagataaaagctacagcatcctgaagataccaattcttcatgcaggaaatacatgcattaggtattaacatagtcagggcactgttcaccatggctgtaatgaaaggataaaagtcctatggcaaatcacatctctcttggagtgtctttccaaatgaaaataataagtaacggtaaaagaaaatcattttcatcctcaagataaggctttctctctttctgtacacatcaaatctttcctagaaattggtttgggttgagagcagcagccccctacaagtgcttcttatcactcctttaggaaagcagcttcagaaaagtgaagtgtgcatcagaatcacttgtggtgtctgttaggacagagtcctaggccccacatcagaactaccgagtcagcaaagcatggggcaggcaggcttctgtcctatggctaccttcttcaggtaactgtgaagtactctatcgatttgtaaccgcgacttactcgtgatcatctgtgcatacaccagaggctaaaaatgttcggacagagagggccagtattattttccccaattaagaaggcagatttctgaattttcaaagtgtcatttttataagttcagataagatatttaaatagcacaagtcatataatcagagtaaagttttctcaagaatttaaccaaaaggcagtcattcgtagcgagagaattcagtgtataataattaagggaatttggcagcaccacaaaccatctcaatgctagttacaaccccttaaagcctagccacaatctattttatagatgagaaactgagattgagattaacgttaagaaacatgtacgaggtccaagggccatgatgtggcagggccgggatttgaactggggtggactggtcagattctatatccatgtccaaatcctagccaatctctgctacatataccatgtactgaacatcaatacgtcagtttttctccactatcattcaatataatagatagggtttccgcattcaaaaaaaaaaaacaaggaaattgatgttcagagaggctaaaaggctgatccaaaggtgcacagttaggaagttaatatggctaatattcctaacggaacctctgatgccaaagtatgttaactactagacttaattaagagataaaatgtcctcattttcatgaatctgaaagattaccaaattttcaggtggaaaatttgttctagaaccacagaaacttctcagtgaacagaagagcttcctttttatctcatttaatttttgaattatacttctacaaataattatcttcttcttctagagcaatctaaaaagtaatttctaatatcttaaaagttattaacagctacttcccactgcgttaatactataaaattaaatttctaagtagaagattcaagtaccataaacatagaagagtgtaagcaagcataatctataaacagttcttacaagattccagattacctgcctggaataaatctgtccttaatatacctaaaaccgcctcccacccaaagatgaacataccaattgttctaaaagatagctcacatttaacttattaagcagcatcgcttctaaagaaatgaatattgccttaatggttagattagatggaattacattttggaacatgatttgagaacttgattcgtggaaattttagtcttcgttagtaacacctggaatatagaagacttttgatagagattccaggaatattgctgactgcatgctggaatacacatacatatcgtcttctacttcatgttaactaaagttagaaacttatgagattcgttccaacaagcaacaagcaaagttccattatcatcatcattctcttccccacacaaaagaggcatagaaaataaaccggagaaaaagctgtgtcatttccttacccattgcccggttcatggctcagacccctgtaacacaatacagattaacgagaggaaagcctaacgaatatatttaatataaattttatgtgccatgggagcctttagaaataaagacctaaagacaactgtgtatttttacggacagtcatgcagaagtatgattggatgataaaagagtatgacttgatggtaataaattggggaaaacttagcaaggcctgtgtgttcagattcttcttggcatgtgagtagagggcagaactcctctggaatgaaggtcttatgacctacttgcatgggtgttaggtcagagaattcttttatggcacacttgagggtagacaaatggaaaaaggtcagagagtgatgttcctgcttctgtagttttctcagtttccttcaccttaaaatactcagtatgcagagctagcatattttgggggtagcgtgtcctgagacctatcataaacaatgacaaaatccaggtcctcacaaagcttaccttctcaaagaactagagaaaagacagaggtacaggtgcatagccaaacaaacaaaagacaatgaagaatgcctcgagagaaatcaaatcatgcaccaggacagagagtaggggctttaggagagctacttcagatgaagggtcagggaggctgtttggatctgtatggttgaagatgaaagaaaaagattatttctcaagcctgcaggacatcaaactgctgcaataatcaccttgtggatggcagggttctactccttttaaacccaaaaaggagagttaataatcaattgtgaaataagaggtcacttttttactttgatatttccctttcctgactacaagtgccttactgagtaagcaaggccacgcttgttctttgcaaagcagaatttaaagcccctgaaacaaaaaaaccctacagtggtatcatgttcaagaggctaactcagtggtgcaccttcattaacgataacaacaggtgctccaggggaaaagaccattactgggcttattgctattaccactcagcatgagacaaaaatggtttagaacccagggatcaggcagaatctcaagaatgagacacagaggcaaagatgaagagaacagtcactgtgctttccatggcaggttgtcaaatgctgccttaaaatgtgcaactgtgtgaattccaaaatatgaaatgctcagaggcttgaattgtagtattcacaactggacagctgaatattaaagatgctgctttgtcccctagaggggctggctactgcaagactggcttccaggggtcataattatgtggccattgccactcaatattttatcatcatacaatactgaggctggcaaatatctatcacgggatgtgcttgttaataatgaagattcccaagccccagtcacagtattctaaataagtagatttggaataagaactgagaatcaactttttgttgttgttaactgataccaaagttaattttcatgcaggtgatacaaagatcgcattttgaaaagcagattcaacaactttagatatggatactttgtctaaaaggacagctttggaaccttcattgttctctgggattttatgtgtgtgtgtgtgtgtgtgtgtgtgtgtgtgtgtgtgtgtgtgtgtgtgtgtgtgtgtgtgtgtatggtggttttcttataaccaccatattctacaaacgagtcaagatatccccattatttcatatcaggaaacttctgtgatcaggttggaaacaactgaaagatgtgcaaaacagcataacctgctgatttaaaaaacagaatcgttttaaaaagttcaacttaagctaaataatcagggtgatgataacaataaccacattcaacaattcatatataagtactatatgttaagaattagtccatcatcatcaccatcaaaggtaacaaaaacattacacattttggccagataattgggacatcaaaaagtaattactattggagttacacaatctgtagccatagttatcagcccagctaggctcactgcttatttgttttgtgtgtgtgtgtttattatttttagtcaagagataattcaaatatgataaaattcaccattttaaaacgtacaattcagtggctttattatattcacaatgttgcacaaccatcaccactaagtccacaacgttttcattaccctaaaagaacctgtatccattaggaatcattccccattccttccttgtcccagtccctggcaaccactaatctactttctatctctattcagagcctgttgcatagcaaatattttctatcccgctttagaatggctaaatgaaattttgagatcatataacctatctattcatataagttttagctatgcttactatgcacctattatcattctgtgcatcccacttaatacagtttgtgcattcccccatgtcactagctatgcctctacagtatcgctttcaatggctgaaggaattccatcaaatagatattgcatagtgcatctaactaatccggtatagttggaatttacatttgaatactgagttttaaaaaatcttggaaccaagtttaaacatttgtgttttgcatttcaagaagtgatttcaaaaagaagccacaggtattaaatcctttctttgcatccgtatatttagagcctcacatggaggtgagacagtgggacagaggaaagctgaaagcctctgtgtctatcaccataccctgtgtgtagagcaattaggaggctagcccttttttatgataaggaatttggtagcccatatggtggcagtccctacataaactttcactgcttagaagtatttcccagagattgtattttaaaagtcccagaatagctgtgttaaagacaaaagtaaagtaagatcaaaagggaacttacgtttatttggcattgtttgtgtgggcagcaccttatccactcacagctagtcttcgaagcattaaactttatttcaacaaagtgtaacattaacatcccagcctgacttgcttctgacttctagcaccaaaaatagagccttttctatgacttaggtgcagaatctacccgtataggaattagcatttgtatgaaaagagctgaaacccagcttctgaatcagccaggattttattattttatttttactacagaagcagagactatcctaataaatcctcctttcttctcctagcacacttaaaaacccatctttgagctccactgactccattaggtttgaactttggtattaagtacacagggaggaaaagagtaggtgtgggggtgacgagaaggagaacagagagaagcacaggagaacagaaaggaagggaggcagcttgatgctactgctgcggttattgcttcactcaaaaacaatgaagcaaaagcagactatgtcaagaagcaaaggtgtgtcaaagacaccccaggcttaacatggggctgcacaaacccacaggaagctcacatgctatttcctagacactctctcacatgaaccactttgacttatgtttccggactccttgatttagtttctgttttagcgtttgcacaataataattttactactaaaagtaaatgtcttgtaaaccaatgggaaacatattgtttggcagagtttataatgtcaggatttacggctctaacactgagggtctctctgacctcgaagataacataatgaaacagcaatgtgctgcatatgactcgttgtgattttttattagttctcataatcgcctcttattaatttgtatgcacataataagcactcaccttcacagtctgtccggcttcggggccatcctagaagtaggaaaaaaccaacagaggtgagaatagatagatggtatctcctgcttattcagaaatatcacccattaataatttagatgcaatttcattgtgtgttaatttatagtattctcatggggaccattggcttcaaatgtgcgggattagacagttctccatttccgcctgagagtaagtgcgaagttatgtataaaaatgatataaattatccagcaagccaactccttgctacttttcatgctctttgctctaggctatggttttaattgcattaaaggaaggctgaaaatgtttggggaggtgaagtatcacaccttctggttatgtttagaggtggtttaattaatgtctgattactttaagcttctactcaggaaatctgctataaacataagccattaaggaagaatatggggtatttcatatgggaagagtcctctggctattctgaccttgtgggagacaaatggtagtgttcattgtagctggacccttttcccaaactggttccctttctctgtttctgaagcttagttggaaatgggcaaactcaccaagtcaccagccataatataaagcaaaagcagatactcagctggttgagatggccaaacaaagcaatggctccacaatcagaaattccaaaatagaatttcacctctgcaactttagccaggtttgtctacctctatgagcctgactaacggggtgagaactcccgccgtaaggattaagcataactgtgtatatcagggattttcaaacttagagtcacaatccattagtgggtcatgaagtcaacttaatgggttgcaatcagcattacaaacaatgtaaatcaggtgttttttttgttgttttttttttttttttttttgagaaagggtcttactcagttgtccaggccagagtatggtggcatgatggcggctcactgcacccttgacctcctggactcaagtgattctcctgcctcagcctcctgagtaactgggactacaggcatgcaccatcatgcctggctaatttttgtatttttcttagggacagggttttgccatgttgcccaagctgatctcaaactcctgagctcaagagagctgccggtcttagcctcccaaagtgctgggattacaggtgtgagccaccacacccagccagaaatcagatcttaatagaataaaaactattagactgcacagaatgagtaaacattgttttgtgaaactctggtttcctttatcaatataggcatatgcatatatttcatatatgtgtgtcaggggagacaggcatgattttgaaataaatatgtatcttactgtaggttacagtaaaaaatagtttgaccacattgcatatacgaaagtactctaggtgctaacacaagtcagctcttacatttatggaattaactttctagtgaaaaatgttccataaccagcaatggccatttcctataaatgtgatttttattcttgtatctcactaaacattaacagaggttttcattcactgccttcatttagtctctccagaaacacggtttgcaacataagcttgataaacccactctgaactgaactacctgcctgaaggggactcaaatggtttgacatacaacacatacacacaaagcatttgggggaagtttagctactcttaacacagacatggcagcaaaaaaagaaagaaaaaaatctgtttgagaagaagatgagcacttttagtcagagccttcataacctgaaaacactggctttctttatctggtctctttgaagctctatggtaaagagctaaggaggggaggaagaatggcaaacattcagtttaactaacaggctgagtacagagtcctcacattttgaaagtgtgtccttctaaagggcaattacagagtcatccaatttcagagccatgaaggactttatacattgataccccagccctttccatagagggcctgaaggagctcatggtatgttactacggatttactcaattccctactgatgactcaccatggacatccttctcccaacctgacaactgttggctcaacctctgcctaaaaatcttcagtgactggggatctgatttcttcactggtcagtgggccacacccaaccagtgaatctagcttctaactaatctgtgatcaatctctgcatcttgaattaaagacagacaaaaggtaaggcccaacctaagctgcatatcactgccaccctggaattagagcagggcttagtctatgcagtgctcaaaaattagttaccatggaatgaaaatgatttttccagtcccagttccagtaagcaatttggaatgtctgaatgtccattaaatcacttatccattactcccacctgcttggtaaacaagcctcagacatcaccttagacactatcccacggtccatcttggggccaatggacagtagggttgccctgcattagaaatctctttttttggctgctacctaaaatacaaacaatcacatctgccctcctggtaagatatcaggaggagcaagcccaatgccgggatatgaaagggaagaaaaatcatttctgagaaatctgtacactcacctgcatggaaaaggtgagagaggtcccatggaaatgtttttccaccactgtcccgactctctgggtcgtctgaaacaaatcggccacttcatcaggacgcaggtcatggaagcgctccactggccgcagcgggcacacaaggacatctgtagcaaggtctgttaaggcccatgctgctggctttgggtagtgttcttaccaagcagttcatacccacaggattgaatcctctcggaccagggcctgaactctcaaagactaaggaatgaagaaacagatatttaccatccactgaactccagagagttgaaagagagctcccatacatggataattacactttgaaggagaagctgtggtatgcagaagaatttcttgcaaaagaaagggacattcgtgtacagacagactcaagtgtatggtgagataattatgcgaggaggcaagatctattctagatcattctctcttgacccctattctaaagctgtgtccgcttcagcagccaaaggcactaggttgaaaaagcaactggaatatctacttggtttctctaggtagaacatggggataaatttttaatttaaattatctctttagagaaataagaaaattatgcaatgaacatacaaaagtagatgtttattttatttttaaaagagtatagacattctgaaaatgtacagtgaactttatccataactaagagaggtgccatgtggttaagcaatttatgacaagagttcctcagactaattttttttttagaatccaaaagaagacatttgaaggtaaatcatgaacgaaaggttgtctgtttattcaaataaagcattcttaatgcattctacaagttagacaaggcaacgtatttacactattggtctcagcaacatataagatctgagaaaaaaggatagaaatttgattacttcttgataggaaattaatattcactgttacaccatcaataacatttcagtcactatacacacatgtatgcacacatgtgtatatacacacactatatatataaatatttgtttagtttttagatactaacaagagaaacaaactcttgtacgtttttctgtttcttttttcttgttgttttaagacagcatgctcctgcctggagctaagcagctgaggggcataataaaaccataattctgcaattgctagtctcactagaatatcaaccccattccgctattggtagaactcagagcccaaggggaaacacaactgagctcagctggtcaggcctgatttccataagagagaggggaagagaaagaagaaactgattaattttgctcataatcaggaaattcatgtcaatggtaaactaggaaaagaagcatttttaaaatcagagttcatttttcaagagaggagaagggaggcgttcacccacagggcatctgatacttaaaaagataattatccatctttggcaggcccgctttattatcatgggtcaatgaaccatttagaaatgaagaatttcctttcatttcctttgagcagattgccagcctccactcccacgaagctgctttttctgtgttaaaagggacccttccccatattcctcctccctgatttgaattacaccctcacttaggcctgacttcaccaaaccacagcaagggtgacaaccatgcaagcttccaacgaagtccataagtgctatgttaggctatgttcacacacagcaactcggtgggggaggaagacatttcacttcaacaatggcttactgtgaaaactggtggaataaatcagacaacctatgtatctaatgtaaatttagtaatatcaatgacatccaaaaatgttttttttcaacaccataaaaaaacttattgtttgtcaattttgcttgtttgcatgttgctcctagaaaaacaactcagggaaagcaaattaattagaagaacagcagatagcttttgtaattctaatgccactttttatatgccaattgttttaaaataatatcacagatgcaatataatttaatttggagcctcttaggccttgttaatgggtaaattccatattatacataggctatgaagacacatttacttctggatcctgtttgcttgggattatctcctctgtcaagatttcttagccaacatgtaggataacctttaaagaattaaagttactatattgaattgaataaatgttttatccagtacatatcatgtgtgaaaacttgtggaactggttaccacttctccctataatctagagtatagagtttttttagcaataatattttttaaaggaagcgaaggtcaatagttataatttaggttgtatagctgacaaggagatttctcacagtagatgaaaaccaaaggcgacttcttagagcagatgagatttaaactggactttaaaaattggggagtgatttaaccagtggattgggctggcaacctactcactcatccatcccaacactgcagtctcctctcagtccagggtctatgctggaacttaggatgctaagatgaccaggacagagtagctgaccttgaagagttcacattctaatgtccgcaactgtcatgcagtgtaaacagatcattacaacacagagagatgaatgctattggtagaaatcagtatagaaagctgtgggagcacaggggaggtcagatctaattctgcctcagggtgttagataaacttttccatctcattttacatttcaccttttaaagtagaacaatttctccacacctagaccaaaatctgtccttaaaaatggtccagaaacttaaggttagcttcaaagaaagttgttaagcgttcctcctttggcccaaatcaccatttcacttttgtacgtactcttacttactcaatctttccaacaaacccataaactattaatactattataattcccatgttgaagatgaattataagcaataatttcttatagaaaattagaaacttgccacaccagcacactcaaaatgagattaaaactagaattcaacccgtctgtccgattctaaagttcatgttattaatgacagtgctgtgatgtcatgcttgttagagctttcatgactccatttttgcctagcctcttattaaaactgtgccctgcattccctagtcactctgttcatagaagggaaccactgttttcattaaatagaaggctatgatgcaaacatgctgaacgcttaagaaacacctaaccttggaaaaagaaagcagacgagacctacaatcccacaatgaaaggaggcctcagcactgggcagtgagtatgccttcatcctaacagagaatcgtaagatcaaaaaggggggagagtaccagcttgcctgaactggaggaagtaaagagggatacaaagctggcattttgccccttctcatcctgactttgggttgcttcaaggtgacttgggctccatcatgggccagactcctgagaaagtttagatactgcagcctctatcactgggtcaggttgtcagacacactgaatccattgcttgttggacagtctaattactgagaattatggaccttctcacaacacatgattcatatcacaagagactaccagaaacttggcaatcctttctttttgttttcccttttcgtctcctcctcttcatgctcaccaccagcccagaactgactatctctctttttgaacatgaacactttaggtgtttttgctgcattaaagtggtgtgaccacatgccaagccctatgctgaactcttgctgacacactgccaactcagaatacacacaatgaaagaaagacatattcgcattagtcaggtgcctagagctggtgtggtttgctatttgcaaatgtgaccacaagaatccctcccatcctacacatgctgttttgctctctggctttcccccactttccatcaagagttgcagtctatttcccctccccttgagtgtctatcttactttgtgtttgtgttgttataaaagaacacctgaagctgggtcgtttacaaagaaaagaggtttatctggctcacagttctgaaggctgtccaagaagcacgatgctggcttctgaatttggtggaggcctcaagatgcttccattcatggcagaagtggaagggaaaacagtttgcagagatcatatggtgagaaaggaggcaagagagacaggagggaggtgccagacccttttcaacaaccagctcttctgggaactaatagagcagtagagagctcactggttaccacaaagatgacatcaagtgattcatgaaggatctgcccccaaacacttcccattagaccctaccgccaacatcagggatcaaatttcaacatgaggtttggagggtcaaatatccaatctatagcagtgttgctgtgtgactttccaaggttaggccttaagtgaccttgaaacctctgattattgctctcttggaagcctgagaccaacatgctataaaaaatcccagctagcctgttaagtggcaacatgaagaaagaactaaggcacctcagctgatagtcagcaataactgtcagagatcatctcagaccttctagagtcaggagagccactgacttccagtttctatatcacttatctactgctgcataataaactaccccaaatcatagagccttaaaacaacattgatcggccgggcgcagtggctcacgcctgtaatcccagcactttgggaggccaaagcgcgcgaatcacctgaggtcagcagttcaagaccagcctggccaacgtggtgaaaccccatctctactaaaaatacaaaaaaaacagctgggcatggtggcgggcatctgtaatcccagctactcaggaggcagagacagaagaatcccttgaatccgggaggtggaggttgcagtgagccaaggtcacgccattgcactccagcctgggctacaagagcaaaactctgtctcaaaacaacaacaacaacaacaaaccaacattgataggttttactaccataagtctgtggatggtttttgctgagggtctcacctggactcactcatgcaactgctttcagatggaaggtaggctggagtctgggctcagctgcatccactaggcccttcactctacatgctcttccatcccaatagatgcagaatctctgaatttgcttaaggcttacattgtcccacattctatcggtcaaagaaaatcacaagccaacccagattcaaggtagagatattctgtcttctaaaaggaggagtggaaagatgacagtcaaaagggatatggacactaggaagttccagggatgtttaaaaattaacaggggcccaaggtatcttggctgtcctagtgagtaaatacaggatggcattttagagttgagatgctcctttttttttttttttttcctgagatggagtttcgctctcgttgcccaggctggagagcaatggcacaatctcagctcagtgcaacctctgcttcctgggttcaagtgattctcctgcctcagcctcccaagtagctgggaatacaggcatgcaccaccatgcccagctaattttgtatttttagtagagatggggtttctccacgttggtcaggctggtcgtaaactcccgaccttaggtgatccacctgccttcacctcccaaagtgctggggttacaggcatgagccgccgtgcccagccgagatggatcttaaacatcaactactccaataccttcactgtcagattttaaaaatagggagagaaaggttacttaacttgttcaaagtcacacagttaggagcacagttgggattggagctcaactggtgagcttccccaaccaaagctctttctgttacactgagatggcaaaacattgcacatctgccactattttccaatggtaaacttatggcagaataatcgaccacagaattctctcctttaaccaaagtgtccccaaatacttgccaatataacctctgagcagtcaacaccagtgagaatgggcacgcgacatgagatgcatgtgccatttctgtggcctcccacactgcctcatgaaacacagaaccaactgcaaaggactggtggagtcagaacaaagggggatgctgcaaaagggagaatcttcccaactacataaaatttccattatgttgccacatttttattcaaaataaatttgataagttcaaaatttgctcatcaaggataataattgattaaaaatatttttaggaggatttccatgacaaatacgaaatatttaaacatggagcactgacagataaatggaaatgtactgattcagatgattaattaaagatgacagcagaatattatgatcggagttgctcagactcgcccccatttagttttctatatctgatctattctagggattcagaatatagaagtcaccaaaataaagcaaatcatcaaaatatcactgattttgattaggctgattagcctgtgtatatattaatatgaagtaaggcagtatcagataatacaacacagaattaatcattcttctgaactaataaaaaagagtctgtattcatctcgactgcagatctgtgtgtagtttagtgataagcaaggaacattccagcttgcaatgcagacctcagcagaccctgtataattcattatttgctctaacaaacactcctaggccttgtaaatgtttaaaataattcttaatgtcacttcacaaaacaatagcaggatggactgtcagctacttttcaagaaaatattcaatttatttgatttaaatagcacaattacagagctttgagtcaaagtaggcggcatctcaaaaagtaatctattcacaacgtaagcactttgatggattttcatatcagaaaggcagaaatatcacccttaaatattaataaatacaattctgaagaagcatcttgctttgtttgggccacaccttttttcagtggggattaacatactcatttcagtaactcaataaagggttcatgggatattcatcaaccataaccataaatgacacagatgtaattttaagcaaatgtgatttccagaatatgataaattccagagcagtgtgattaagataatgataacactctgctcagagctggttctcaaggcaagcatctcacaaatatccactatctcatgttttgccctgggatatgctttgggtcagagatatgatgagaccttgttcatctggaggaagagaacccaggtatccttgtctaggcaacatgccctgagctgccctcaaaactccggtaccgatctggatgctcaaaagtaagaatcactttcatcgagagaagcaaacagttgcctttcaaagaaagtaaattgacaggggagtccgcagcccgatagcattctggtacagattctttggttgaatttcacatatttttctgtgaacttttcaatgcaaagtaatcttatactgattgagggaagagcatcatatctggaaaaaaatatgctcatataaactaagtatgtgggaaagaagtaaatgatatcattaaaggaaagaaacaatatataacatttgtttgctgcctagtatggtctagtgataatcaataaccctttgagttaggataatatcacctcccaatgtccagattcagaagttgaggccaaaaaagtttaactgcataaccaaggtcacgtagctattaagtgaaaatcccagccaggggcatgtgctacaacactgttacaatgtccatgctgtttcaatgcctctcaaggttataaaaacctccatgtataatacctactgcagtgtttactagagtgggatagcagagccctgcttccacgggatgctgttatacattatacagaaaaaaaactgtgcggtcaaagaagattgagaaacactgcatgaaatgaagtaaaatagctctctttaccgcagtattcatcagcatatttactgtactactatgcattctggcttctcaaaaataagaaatagtatgcagcactgctcaaatttgcttatctacaaaataataatgattattaattattagtaatattgtagaacactacacaggacacatgtttcagaggatgttctttggaaaccttgagcatcatttcccaaaacacagagaggcctgagtaatttttctgttttttcaaacaaaaagttgagtacatgtcctattaatcacatgggcaaagaaagagagcattctgtgaaatgaaatatgctgagaagttgagcattaaaatacatcaaatgggatatggcagtcattagtgctgtttgccaaacagttcaggttactgccatgtctgggcatatggtaggccttctggacccttgcagttgggtgaagctcaaggaatacaggtcaaagagttgtgagcgaaaatgatatacgtcacttctgggctaaagcccttaacttctagtatgtgaccgacagctttatttccttcaccaagacaggcagcaatgctttgcaatggtagctgctctggcagtgagaccccgaattataggtcagcaggggcctctgagcatcgtggtcacagtgactagggcaagtttgttcttaaataggttttacctcttttgctaaccccaaccaacttgtagtagctatttacagcagcatgttgaagaggattctgaagctctgataaggagcaggaggaaagaactgaggaatttattagttttggctgccaccagggaggaaaaaaatattagcgtgtataccaagtacctgccattcttcaattagacggcaataaaaatgttttttcaagaattctctctcccccattcttaatgatatagaagtcatttctgggacttgcaatgtctctcagtaaccgttatgaaaatctattattattgttattgtcctagagatatacagaagtgtctagaatttagataattctggttaggagagtactgaaaaggaaaattaactgtcactcgaaagagtctgtccacaatgtgtaaacatgagaatgggaacacaccaatatgaaaatgagcatgttgtaaaaatgctcttaggagttaagacttgaaggagtatggcaatagaagaaataaattgcactcagcagctgaagaaatatttaaagataactccaatgagagattattttaaacttcagatacactttgctatgagaatcatttcaaaaactctgtaaaaagctttttagtgaagtagagatgagaaagtaatactaaaaatctgcaattcattgcagatctagaaaaccacatgcaacataaataatttaatagcaccctcaccatatacacagtttcatttcaccagtatgtgaatgaggggagtgccctgagcacatacctccatagggtggctagagtgaaacctggggcccaaactcccacatagacaggattcttccagtgcaagctctatcaggttttgaaattatggattccaaatttaggtttgcttatgtcatttaagagactaaaaattccagtttccctcagatcttccatatagctggccaagccaatggagcaaccagacaacacagttcagatgccatctgaaggcaaaaagtagccaaactataaatatgaaaggaaagaaataggaaatgagagaaagggagagaggagattaaaggtaggggtggtatttagcagatgaagcctccttagaagagaggaaatactcctttatagataggctcaactaggattcctggtgctacacacagagcttaacatagcattggcctttaataaatacttggtgaaaaaataaatgtcatgtaggcttattcattgtttaatctgggaaacaattctttctaatgaataatttcttcaaaatgctccccaaactgtgggttcttaaaagaccagtgaaccagtccagactcaacttacttaaatgtaaaccattaagaaaaatatacttcatggtaaaaaaaaaaagaattatgaattcctaatacaaatgtaacatacccagctaaagggatagaaaaataaatacaaactggtctttccttcacacatcaaaagtagtgcatgtgttttaaatggaaaacttcagaactattaactcagtgaagcttggaaaagttcaaagataacagtgttctatgctttttaataacaatgaggaaccctcttctatgacagatactaatgttaatagaaacatcctttatttcaaataaatgaaagagagtcacacttaacactaatttggcattctcacagaatatgaatcaacgtctttctctcttaaaatcagtcctccatgagctagcaacctaaaataaatgtgaagatttcgtagtgagaggtattcatcatgtgttcagtgaatgaacttctgaatgaattagtgaaagatcacaaagttgaatattagagaaaaggataaagccaaaagactttcaagaactctgtatttttttgtatattcattcagtaaatatttgtgaattaagagccgactacctggcaagtactatataagacactgaggatacagcacaaccaggtacagtcatcctctcccttccaaagatgtgaaatctagagggtgagcagacaaaggcaactgacatagtaactactgtgaaaatataaggggtgagatgagaaagaaaaggtgcaagaatgcaagggcaagaccgtaacaagccaaaccagctaaggtggctgtgaactaggcccagttcacttggtctaactggatcttcaggaaagagtgcaggcccttgatagccttggtcagcagtctgtatttattcgccatgcatggagaagccactgaagcatttcggagagtggagatgtatgacagattctgggttctctttgcaaagctgaaggccactgggaatatctttattgcagactaggtaaaagattcaaagcaggcctggcctgtggtggtggcagtagagatgcagagaatttgagatgtatgtttgaggtaggagcaacaagacttaactaatgggggcaaaaaggaagagaaggatcaaagaggattccaaggttctggcttgggtagtaggtgaagagtgatgtaattttgagatacggtgggtgggacagtgtcatgtagctcaccatttggagacttttctttcttgaatttatagaattctccagaaataactagagcagagtttcctaacctgggtctacagataggctccagggcttctatgaatctcctgaaattgtttgcaaaatggtgcatatgtgcacgcacacacattgttttcctctggtataaaattcttaaatagtctcctgaccccaactaagataagaaatctagatttaaatcagaagaattctttgaagattagtccccaagagaatgattagaaacaggctcagacttttgctcactttggcttagaatctaatatacccagtactaaagagtaagaaaagaagttcactctgtctgagcaatgtgccataattcacaagcatgaagcctccataaaagacaaacaaaagattttttaatgccataacaccgaagtcattttaatctgattcagcagtgaacaatttaagacatgtctcctccaacaaaggcagctggacacataaagatgattgtgtgatccattcaaaattaaagaataagctaaatcatttacaacaataaaaatgcagaaaattctaccagaaaaaaaaaaaaaaagagagagtgaaaactttcagcagcaagtgatttccaaatgtttccaaaacaggaagcaaaagacattttaatgtcactgtggcagcttccagaatagagtaagttaatcaggcagcctctaaaaacaaagcagcaattcattaaaaacaacaactgctactcagcaatgaactgtactgccagagtgtcaagaaagcaaactttttcaagatagtgatttgtatgcaaatatagctcagcatttatcactaaacctccaaggcctgtaaagggggggaaagaaaagttctttccatctgcttacacctgtctcctaataaaatcaactgccaatcacaggggaggctggggcattttaaaaacagtcaaagaaatacattcacaaatccagggtttcaaacaaaaaactcctgtctactctttcttcttcaaatctcctagcctactgtcctcttcctaaattggagttaatatctgtacctacttcattgggatgttaaaagtgttttttcaaaataatagcatatttcacaccaacaaataaaagctgaacgaatggttggtttagaaaaaaaaaaaatagtcaatggaaatgaaatccttcaaagcttccctcaatccagcaatggtaatgcggttatgtgattgaaacagtgtctcactagcaccagtgttatcgtttggaacccagatcttcattcatctcatgtttaaaatgtctgtacttttctacattccactcacccacccatctccattttctcatttgatctctgttttttatttccccctcataatgtaagcatcactggtagcagagtctaggaattaatcatcttataatcatttagtcttcctctccagttctaacttacgactttttcaaaatatggttgctaacaataaaaaaaatctcaaaatgtgaaaacaaacaatggaaaaatattgtaaatatttaaacgcatttagaatttgcaagtttttttcactctaatgtcatttttcaagctatgtttagacagcacagaacactatatggtttacctaatgtttaaattagtagatctggccaggtgtggtggctcacgcctgtaatcccagcactttgggaggccaaggtgggtgggtcacttgagatcaggagtttgagagcagtctagccaacatggtgcaatcctgtctctactaaaaatacaaaaatcagctaggcatggtggcacacacctgtaatcccagctactcggaaagctgaggcaggagaatttcttgaacccaggaagcagagcttgcagtgagccaagataacgccactgcactctagcctgggtgacagagtgagtaagactgtttcacacacagacacacacacacacacacacacacacacacacacacacacaaaattagtaaacccaataatccacaaagatctataaaaatatgaacttacaagatttctatatatttgaatttcattttgtatataactgaaaaaaaatatttaagcatgcctaaggaaaaagaaaactgtggaaacaaaacaaatgttctggcaattctgcaacagtttcacatttgtatattgttattcctcctgaagaatcctaaaattcactctcattttctttatatgcttagatattaaaaacatgtctttgacaaccaacagtcttctgtcatggggaatcagacatcggccccataatctctcattaccaacatcaccattgtcactgtctttaccatcatcacttaaaagaaaatagaaactgcttaaataaccacagctaaaataagtgtcacaagtttcttactgattaaatgctcctccgcgagactgcaacctcgaatactacgccatagagttcagattccaacacctttaatgtttctataaggaaaaaaaaccacaagcgttctccctgaaaacgtactcttaactcagaatctcttctggttccatttagtttataaaaaaaaaaaaaagaataattcagattgaaggatagtattttggattttcagtgttattgatattcctcgatccatcataatttagctaacatagatcactgcctatagagcagtgctgtctagtggaactttctatatcctatactgttcaatatagtagccactagccatatgtggctactgagcacttgaaatatggctgatgtaatcaaccatatttaattgcattttgttttaattttaattttacatttaaaaattaaatttaaactttacattttaaataccaccctgtagctagtaatcacttgtagctagtagctattacattgtacagttcatcaggagaggccacaaatttatggtaacaaggagtggtggaactggcacaactggaaaacacatgccccaaggtgggtggccaccacctagagatttttttgttcctgaagaaactagaaatttgaattgctatgtgtaattctcttctatttaacttttggcaactataggcagtccttctcatggttccaatatgcacatatttcagttactccagtttaaacaacaccaattccccaacaacacggtttaaatttcagttaccatgtcacattaactctgggtcattgggtaaagtacaagctccactactagctcttcaattcacaaattaccatgtagatcatagatgtgcatgatgatcagagaccagtcacatcacttcttccaaagtctgtcagtgactgatcactgcacatctggtattcagtcagaggcagccagcaaagtatgtagttttgtatcccactgatcttccagtgatgaacccacatatttcaccaaaatggataatcgaaagagggaactggccaagaaatatgaaacacaagtgaccaaaaacaaaaacaaaaaaccaaatgtgacaaccccagaagtgcactttgaatcaaatgtaaataaaattatagaacaaataactgactttgggaatgccaattgcgctgatgttcaggagattctagatatgtaacccaaggaatttagtaaagacaaacttattaacataaattaccaaagaatttatgatgcagaagaaaaagatgtaccagaggaagtgacatcaaaaaagtcacattttaaaaaacgtcctatttcatgacattgaaaacacaaaggatgaaatattggaaggagatccacactttaggagggattatgacaatcagccaaagcacagaaaagatgccccatctgtactgttagttgcaggataagaaaaacaaggcaagaattgttcaagagactctcaataagtgattttcaaagaaataaagcacttcaattcttagtgtttctaatgttttaaattacagtgtactaaattagtattagttcgttttttacttctttcattatatttttctatttctttatactctgataacttatagagggtttttaatgattagagaaaaacgttaaaggtcatagaacagtcatacgttttcccattgattactaagtggacattgcatggtttccgcttgcgtggtcatttttatagtcccacactgctgtataagatgaggggtacttgtacttccaatgtgttaaaaaatattgggtggggcaaataaaacatataggtaacaggccacaaatttaaaacctgtgccaagaactagtgtcatatgtgatgtgcatcttaatattaggagagagcagatgaaggaaaatcaaggactgtgactttaaaaagacatatatatgcagtctctctccagaaagagcagacccgtcgtcatatgctcctgaattctcccaccacactgcctggcaaaattaaagtcaaagttctcttttgtttcccaagtagcctgagaactgcatgttactgtctacctaaataacagaggctctctaaaagaaaatgatatttattgagaaatgggccttgtcttgggaatacatgtgccacagtaaattatgagtattcagccaggtgaaggaagacaaaggtttttaaagggcaagtgaggagaattacctaattgttttgaggtaattatccttggttactaggatcaataacattgtagcaccagaaagaggttggacaggcagttgttgggcagatgtcctcatagaagcattgtgtgtgtgtgtgtgtctgtgtgtgtgtgtgtgtgtgtgtgtgtgtgtacaaatgtgatggccttggtgcagcgtggctttttgcagagtcttttatgatagtttttgttatcaggcatttgtacatgagaacgctcccgtcatggcctttcctagctctatttgtcagggttttgtttgtgactccatttgattctgacaacttttatattatcaaacctcctgaactctgaatgcatcattaaacctggctgttagcattaaggtttccccaccaaatgttctcttgtacatcacaatatgactgaagggagattacataatgagtaacatcaataccatgcatgttctatattccatatggataatgcgcaacaagcaaaattcctgccaaaatccttattttgacacaaaaaacagaatgcagctatagctgtatgttttccttcacaatgttccactataggccctttctgtagtgcattatctgccgctggtccagaagctctttaaaaacagaggccacttatttttcatccttggatccaaagaccagcatatggagcccaggttaggacagatgtcacctcttagtagacttatcaatcccatcccatgaaggtatccctccttccttttcttcccatttgtttgtatccctcatagcttatatcaatcttgaaattttagtactcatttatgattacttgttttctattgagaatgcaaactgaaatgagggcagaaatcaggaatgtctgcttctcagctgtattctacctggatacagtatactgcccatagagcacttgctaaacactgaattggtgggtcaatggatggatggatggctgggatgcatggacggatggtagatgactgggtgggtggtttgaaaaaatgtctaagggaatgactattagaacgaatgactgttgaatgaattactgtttcattaataaataaaaataaataaataaaagctaaaactattattttagtaagtagagagtagaaaaaataactgttattttcttaatgttttataaccataaacataacattctctgggttgtcttccttttcccaagttatgtcctcagataaatctaaaaatgagaattcttccaatgggtgatctcccctggtccagtccactatttgctgaactacaagatggagaagtttcactttgcagcagcatgtgtgaaaacagcttggaaatttttgtagagaataagctcaagaagagtcaacagagaaatgttgtttctacaaaacacgttttatctcagattgtgaatgcaagtctggtgttgagttgagggaggtgatttctcactctgatcttattgacagggatagtcatggagttttctgtcaacctgggagccaccaggaacagcctatagcacattcacaaaagagatcagtatggctgaagaaaatcaaagaaaagagaaatgaggaaacaagggtcaacctttgactatagcattgcaaaggcagtcattctaggaaggaggaaagatgcaggtgaaccaactagtaaatggtagaacagaatctgaatccagcatatgacctgtggagtgactcagatctggattccaattccatttttgccactttttagccatttgactctgggcaaataaactcttatcagtaacctcacctgcaaaatggggcttatttattctcatggaactgcatttcagagtaaccaaacagcaccaatgatggacaattcttcaaagaattctagcattaaaagcaaaaggacccccaccattttaaatccctaaaaatataactgactcatgcaaaattatcaacaggtaatttggggcttaggtcaggagttcttaacctgggggtcccacagaggcttagcagagggtgcatggataaaaggaaggaaacacatgaacatgaatgaaaaaaatgacacacagttatttttactaatttttaactaaaattttgtatcttattaaatcacagatgtaggcaatgaaccactgtagtaacagcagtacctatgagttgtgtcacagtataaatcacaggtatttaaaaaatatgtaaagtaataacttgatagttattgcagttaccttgaaatatcatttattctagaagtacttatcattacaattactatcacacaattatgatggtcattatagctgctaccacttctcattatttaatatgtaataaagaaatgcataattcactgtatcacaaatttgctgttaatactgtgttaactggtattaaataacatgaatttccttggtacttctctatacttaactgtccttaattaaaatcattattgggtgggagggttgctcgaggctaggagtttcaatccagcctgggcaaagtagtgagaccccatatctaaaaaaaattagctgggcatagtggcgtgcacgtgtggtctcagctactcaggagactgagatgggaggactgcttgagcctaggagttcaaagttgcagtaagctatgatcatactactgcactccagcctaggtgaaggagcaagaccgtaccttgaaaaaaataataaaaataaaaaataaaaacattattgggggaaaaggtatacaagcgtcaccaacagccaaaaaggtgactgaaccaaaaaggttaagaactcctgctttggatgaaagtgtgacgggaaactttataatggagaaccaggctgtcactacctaaatctgctgatcaatttcaggattctaagagcaggacatccagacattatgcctccctatacactgtgatttgaagcacataatactactactacaaatgcttatatctgaaaataatccatagacccgcagctgtctaatagaactttttgcgattgtttacactatgcaacacagcagacactagctgcatttgaaatgtggctagagcaaagaagcaacctgaatttctaattttacttaagtgtataatcagccacctatagctagcatctaccctggagcccaccttagagctaacttactttacaccaaacacaagatagagaaacaagttaagtaacactaaagggaagcaaacagacaaatccgtactatagaacagtctacaggacaactgactcagttaaaaaaaaattcaatggcataacaatattggattaaaacagcactaaaacaaataataacctaatataaggtgtggatcttttttggatcctgatccaaccaagcaatgataaaaagacattttaaaacagtcaaagaacttgactactgcattaagaaattcctattaattttgtgaaatatgataatggggccaggtgcagtggctcatgcctgtaatgagcactttgagaggctgaggcggggggatcacctgaggccaggagttcaagacaagcctgaccaacatggagaaaccccgtctctactaaaaatacaaatcagccgggcgtggtggcgcatgcctgtaatctcagctactcaggaggttgaggcaggagaatcgcttgaacctgggaggcagaggctgcggtgagccaagatcgcgccattgcactccagcctaggcaacaagaacgaaactccatcccaaaaaaaaaagagagaaagaaagaaaagaaagaaagaaaaagaaatatgataataatattgccaattagggaattttcgtagtctttaaagatacatgctgatgtgtgtagagctaagaaaatacttctagcaattgccttaaaatatttcagcaaaaactcaagtggataaatgaagcaagtgtggcaaaatccgaatgacatttgaatctggttgaaggtaaacaggccatcctttgtattgtttttggtgctttttctgagtatgtctgaaacatttcaaaattaattttaaatgggataatgcattgggtacagtgaccaacacatagtaaacattcagtaaatgttaattagcaagtattagcatcatcaacattatcatttatgttctcaaaagtcaaaactaagatcaatcagtaaaaaatacaaagaggtagctttcagcttcatctaagaacaggctctgggaagatgaaaatacaccgtctcgtgagggagtagccaacagcatattcaagataacaataacagcagtgacttacatgattgagtacttataatggggcagatgtggttctaagcactttccatataacccctcactcaatcttcacaacaatttcataaggtaggtactctaactgtccctgctggagcagagattgatcacttggtgaggatgctgcagaagagggtcaaggtgaatggctttgctagttgccctttaacatccctgataaccctgaactcctctgattcaatgaacatgtcattcagatgaattgtgcaggttggccagctggctggctcacacacacatacagggcaattcttgcttttacttactgaaaggtctttaaacaccacctttccctttcaagtaggagactaaaacgtcacaggaatttaattatctgtaggcaagaagatgatatgatcaagaaaatgctacatttaaactactccatttacccactttcaaatttcccatcaattagaggggaacatcttccctaggcagccatttgaccaagaaatgtccgtggtatatcttcgtcaacatgtttcagaatataaatccagattacacaaactaaagttggtataaaggctgtcatcatatattatatcatttggaaagaaatattggtgaccttatccagtatgactgttataatggtaataaaattgaatctttgaagattacacttctggtcaaagtagtaaaatgtgaccttattctattcaacattgacatttattatattaatttacatgtaaaaaactgcattagaatgatattaaagccctggttagaaatgttagaaatgggaatgttcaagaacttcagaaataagatttcactttaccagccattcacagcattgagtttgtttgatgcaaattaaactaaatttccttcaccaatctctgattcggttctaattttattattatcactatctcattcatacaggagatatttttcccaatgcctctttaaacattttataaaccttaactcattttcatcatgctctggataaaaagataacacagagcactgaatatataaacctgagtcagaggatcaagccatctgcttatgacggggagagtctcctcagcccagtaaaaatgagcttagcgatgagtatacatcagatagtgcactaggtcctagaaggataccaaggtccagaggtgagaaaagagagtcagaccgccacgtgggtttcacagaatggccaccatgcagcaaaaagatcgctcttgttgcccaggctggagtgcaatggcacagtctctgctcactgcaacccctgcctcctgggttcaagcaattttcctgcctcagcctcccgagtagctgggattacaggtgcctgccaccatgcccagctaattttttgtatttttagtagagaagaggtttcaccttgttggccaggctagtctcgaactccttgccttggcctcccaaagtgttgggattacaggcgtgagccaccacacccagccaaaaacatttttttatactggtcaaaattttatagggaggtccctcccttaaatataagttttgcaaactttcagtttgggggtagaacatggaatcatgcaatgaattaaggacaagattcagccacacctcaacagattattctattttcaccattagcccaaagtccaggcttgctaggatgggtcccaactgtccttccaattttgtttctcactattctcgccagcacttcaaggttccaaccaaaattaactttttgctatgtatttcctcatatgccttagttaatattgtcttctactctgaatatcttttgactttctatcaataggttaagctaggtgttgctatgataacaagcagtcccagcatttcagaagcttgtaacaaaaaaggtttacttcttgcctgctatttgtccatggtgggccagcagatcagctctgcccatctctggcactctgatatccaggctaagagagcaaaaaccagctcaaatactgttaggaaccatcccaaggggaagagaaaactgcagggtcttacaccagaagttaggtgcttagtccaaagtgacacaattcactgccataactagtcatgtggttccaccaaaccacaagaagcataatgctaccatacacctggaagaaagaagaactaaaaatatttggtcaataccatcaatgactccctatctccatgtgtcccaaatctgataatttttccagatctaagttagattccacctcctcctaaaagaaaaccacagtccttcctgctaaaaggaaaccgttcatatggttaatatacagagcatgttattttacctcataagactctcatgactctctgagaaccgtgtctctattggaattccgtgtttcccataatgccttgctagataaatactgcttgaatgattgaacaaggctgtctgtataatgagagtttcatctccaaagacttcgaataccctggaggctagtaatacgtggtaagcaataaaactttattttttcttatttatatcataaagatacttaaaacaatattaaaatgatcataaagatgaaataaaaatgagcccatagtcccgccaccctaaaccaacaaatgttttcatttcttttcctcctggtcctattcaaagggcatccatttcctttacatagctgtattcagggtgcatacaaagagagaattctaaatagaacagaagtaactgcccagtcaacaggttttgtttgtttgtttgtttgtttttgctcttccccaagatagagacacattgggccatatcctaatactgagacttattttctgcaataaaatttccgttaatttaaagcttctaagctgtttaatacagtcaccatcattaggaaatatcagtgtagtcttcaccactacttcctctccttggctcaacactggaagaaattgcctctagtgaaaggagattgacttccaacatgagaagaaggaagaaaaggagaagtgtgtgctaaatcttggacagttctggggaacatcgtagaccaacgtcaccttgtcacggtccgacgttaagacatcattaacaagagctaacaaccaacattgaagttttaacctcattcgtgaatttatctgattattattttgctccatttagctcatccaattcttttcattttatcatgcactctttttatttgtgtagtctgagttgaaccttttctaaaacaaggtagaaaatacatacataatgcttcaaaaaaatgttttccatactgccaaataggcactaggaagtctcaccagagttgataaacaatctagatggccatttaacccactcagcttacttaaaaccaagtctttcttttttttttttttttgagacggagtcttgctctgtcgcccgagtgcagtggcgaaatcttggctcactgcaacctccgcctcccaggttcaagcaattctcatgcttcagcctcctgagtagctgggactacaggcacgcaccaccgcactggctaatttttgtatttttagtagagacagggtttcaccatgatggccagcctggtctcgaactcctaacctcaggtgatccgcccgacttggcctctcaaagtgctgggattacaggcatgagccactgcacccggcctaaaaccaagtaagtcttaaaatttgtactcagaactactttttttttttgagatggagtcttgctctgtcacccaggctggagtgcagtgacatgatctcggctcactgcaacctctgcctcccgggttcaagcaattctcccgcctcagcctcccaagtagctgggactacaggtgcatactgccatgcccggctaattttttgtattttagtagagacagggtttcattgtattgcccaggctggtcttgaactcctgagctcaggcaatctgcccgcctcggcctcccaaagtgttgggattacaggtgtgaggcactgtaccttgcctcagagctacttctatactgagaataaataaacacccaaacacctttcaatgttattaaatttcagagtaatgactttttgtctattttctattttaatagctgatagattagtaggttttcaagctatattttaaaattttatgttcagtttcctaaccactgccacatgtacacataatttatactcttacatttttgaaagggtttattattttatgtgctatagttattgatctgaatcaaatctttcttacttgattcaacagactatagtgggaataaaatgtgactatttacgaatgttaaccactgctgtaattcatatgaaatctgccaagcctattatattaggaataatgttatatattttatctaagagtctgataacacctacctcaagtctaaatattctctgaaaaatttgtcagaataaaacaagtgcccttaaataatattttcaggtataactgcagacagttgcttgtacgtttgtctttaactttaatactgtctcaatatgcatgaaacgcttgatagttcaatagttgttttcatgagttgtgccttcattaaggtacaaaacattaaacacctggaatgctgctcgaactattcctaagggagaaattttggtgacaaatgaaagggatacatttttaagctgaaaaagttgctcgctactgataaaagaatttatatcagaatattccaatagagcagaagaaagcaacatgaaaagaaaattaacattcattaagaaacagctaccatggtgcgaaacaaagatcacaaagccaaaactgaacaacaatcaaatttctacacaaaaaataagacacatacaatgcctacagttccgattgtctaatgctgtgtaacaaactaccctaaaactaagtgacttaaataacggtcattatgtactgcctcttatggtttctggagggggtggtcaggaattttggatcatctcagtcagaaggtctggctctgaactttcatgacactccagtcataccgtggctgagactagggccatctcagtggcttctatatgtatgcctgaaacctaagctaggatttgaatagttaggggcatccctctctggctccttaaggtgtttccatgtgctctctcccatacggtggcttcaaggtagccagacttatcatatattgccttgaggttcccaagacatatatctcaagctagaaagaaaaccaagaaaagccaaagttcctttaaggacctagtcttaaaactcatttggccttacttctcccatcatctgagcagctccacttttatctgtttcatacatggggctttggcataagagcatgttgaccaaaggctgtcaaagtaaccaaacataaaaagtttaaaagctagtggctgggatgaagtctaatgccccaaacttcaacaaagctaggtgatggaaaaatactgctgaggggaaggctgcttaggtgatgggcaagagagtccttggagaatgcagataatcaaaacagcacctaattaaggtacagataattgagagctggattatcactaagattgtatgtataaagatgcactaaatatcttattttcaatttctcttatttttctatactgttataatagaaataatgtaataacagcaaaagcaaaaaatagtcctataaagtgttcacatggtgaattcaatactttcacactgggaagatgatggtggaagatagtatctcaggcagtgcagtccaatggaagatcttagaaccaaatgtattgagttgaaaacattaatgctgtcatttctgagccatcttaactttggcaaagtaattaacctgtcagagtctaaatgtcctcatctgtgaaatggaagaaattatgagttcacaaatttacactgaagagtcactgatccaccattctttaattcagtcataaaatatttatggagagccaaatatatgccaggtatgatatggtatggaaatacaataatgagccaaatgcctacaataatcaatcaccaaacaaatgtttatcttaagatgacacccataaacatgtccaacaaagatagtgtcaaaaaattgatgtcacctaatgaataatttccttctttctttttatttatttatttatttttttgagacagagtcttgctctgtctccaggctggagtacaatgatgtgatctcggctcactgcaacctccgcctcccaggctcaagcaattctcctgcttcagcctcccgagtagctgggattacaggcatgtaccaccatgcccagctaatttttctatttttagtagagacggggtttcaccatgttggtcaggatggtctcgatctcttgacctggtgatccacccacctcggcctcccaaagtgctgggattacaggcatgagccaccgcgcctggcctttccttctttcttgaccttcctttcttcataccataactcagtgataattagtagggggtgaaacagagccataatacattcatttgtgaatctcccctgtcctcctcacacttaccttttctctattcccttctcccaagcctggttctggctctctcatgcttcagaatctgtgaaattggttcggagggcttcaagagaactgcggaggctaagcctgtatcataaagatttaggactaggggagaggaagcgaacacaaagaaaagttggaccatgtaagaactagaaggagagactggggagctggtcctggagtgactccagggcaccaacatgtaggggagaaatactgctgaggggaatgacatgatttctgtttctttgagagattcaagactggatttccttttaattaacatggggtggctgatctatacttcttgaaggcaactctaggtgggggtaaaccacctggggcctcaagatttattaggacctcacaatagcaaacctgttgctcccctaaaagctagaaaggggggtttacaaaggagataaaccacaggtgtcagatatgtatccaaaacatctctctgaaggacttttctcaataaaaaaaagctactgatgcatttaaaattaagtaataaaacaagaagtacctgtgcatgaaatatttttacatctcccacctccaaccctgaagccatcctattagcaacctaccctatgatcctgacatgacccgacagaaggagacttgcagatccaactgctcctcagactctcacttgcacagggggcattttcaacatgtccagggagcatttgctgccttgataatgacctttgaggagaggaaaccaactcagaagtaccttcatcctccttttagtttgtcttttatgtttttttcttgagccaatgacttctttcagacagcaataatttacacttcaggaaaatgtcaaagtatagcaatgccctgaataataattaccgccaaggttggaatgaagcctttcgaagaaatgctaagttaattagccacacacttgtttaccattaggccagtggagaaaacaaggagcacaggatcagaacatgcctgcaacatatggtctttattaatggcggcatctcaattagtctatgggaccccacttctgtcaacccagagatgatctgaataaagaaggagaagaaatgttcacaaagctgtcatggggagaagatgctacctgagaccactcaggacacccacaaaagaaacttggatttctgttgttttctgtcataccttcatacatgaaattgcctcttttaatctttccacaatgcatttgttttgggacaaaggtcaagagaagggcagattaggaaataaggaggtttacccattattaccaaaaatctatttaaaaaatcatgtttccatgaatatctcaatttatcccttctaattcttattctcatttctgaaatatatactttgtttagctttttggaaaaatccacattttaaagaagtatacaataaaaaaataatactccttatttacatgcttctgcaatcatggccgcctttccacagaacactctcagacgaaggcccttttgtgccggcctacttagatgttaccaaaggtgtacaaaaacgcatctcttgcagatggctggaagatagctctgagctctttgtgttcaatcaatcccccaggaaaaggcattagaaatttattagaagcagctccctgttctcctcagtttctgagcttggaaaaagcacactacactgaaaaagcattttgaatggaaaatgtaacctgaagtatcttacttttttctttcctccatagtcctaccatcgatatatcctttgtaggactctattagtttgctaggacgagcataacaaaataccaagtaccacaaactggctggcttagaaaagagacatgtacgatcccacagttctgaggacaggggcctaaaccaatgggtcaccagggttggttccttctgaggactgtgaaggaggatgtgttccaggactctctccttggcttgtggatggctgtcttcttgatggatttcctcacactgtcttccctctttgcttgtctgttgctatgtctaaatttccctttctttaagaatacaagtcatattgcactagggcccaccccagtgacctcatcttaacctgattacctctgtaaaggccgtctccagatacactcacattcagaggcactagggattaggacttcaacttatctttctttgcaagggatacaattcaacccataacagagatgagtaaaaaaaaaagatattaatgttcaaaaaattaagtaaccaaacataaaaactttaaaagctagtggctgggataatgtctaatgccccaaagtggaaaggtaccattgtcacatatttcaaagaggaaaggtaccattgccacctatttccctggctgtttgttaccttgatgaagtgtctactgtggcaaggcattatgcatggcactgggcaacagagggaaaaaaacatggagcctctatgctcatgaatttaccctctccttttatgccagccttttcaacctgggggaaagtggactggctagagtactaatcaagctgtgaaggactttgggcttctacttcattctcccttgcattgacagctggacagttaaaagcagcaacaccaacagctgcacagcacccaactcatcaacccacaacaacggtgacatcacctaagttagcatggaagtggccagtctgcttttgccaattctttgggacattaaacccatgataatacttttaatataattctgtgtgaaccaataatgatgacaaactattcttcttgcctggttggagataataagtaacaatacctcctattttctacgaactgtactttttttctagcaccgtgccaggcacttaccatgataattttatgccattttcacaaggtgagactgatattactagctccattttacagatggagagattacatgtcttgctaaagctaccagctaatacagagtaaaggttaaatctgaaatcaaggtgtctagaaaatcaaccccatgctcttgagccttacacaatagtgtctctttcaaccttttgaacctgagcacttatgacaactgcccagtatatgtgtacacatattctgtgcatgttatagatagacagatagatagatagataaaatatctattttctccccccaaaatctatgactaatgcaataaacctcccactgattagacagttatggctttttctcacatctccatcagtgacataacatattaagcaaaaaagtccgacccagctgattagtatttgatgtgctgaagagcctaatgtttctttatatgaaacatcagacagtggcagcctacttaattactaggttgactttatgtcttcaaaataataaaacagaataatccaaacgacaggccaacgtggtgagtgatatttgaacatctactcgaccctaaaactgttaaagcaaaagtacttatccaaaatccaatactttccatttttcttttaaatgttgtaagtcaaaaccagctaaattgattttttgcctttgacttctgctgaaaagttcattcctaagcagattacatgtgtggctttgcagctcagaggaaattttacagccaagtaaaaccctaaaatcaggaaaacatgggtttgctgaatacagtagaaagacgtgacagatcttaattataaaagaacaaatatatcttgatagatgaactgtcttttgtgaattaagactcaaaagttttaactccttgattaaccgttacccattagtaatatagaaagttgtgaggcaacgtcttcaaacttctaagtagaacagagcactcccaaagcatgcagaaccccctgtaacatcactcaacgcattttcagcatgagtgcccagggtaagccttcctcacaatgttgcaaagcaaatcgtgtccctcattcccttttctactcccagcactccttggttaagtgttttaacagggtaagtgatgacggtacaggaagagaagaaggaagaggaggagaaagaacaacaatgatatcatggtaaaggcctgtagaaattgatctaccagacaaaactcaagagctcatatgatacaggattttgcttgcacatggtcacaattaaataaatgatgaaaatgagactcaaatatagattgtatacctcattccactgttacaagctttcttctaaatgaggaatcatcaaaaccaaacagaagtgtctatcttaggtcaccttaccctcttttctgattgttgaaattaaggcagtgcaagaaacctggggagacactggaaagtgtccccatgccaagccctgtgagcacaatgagctcatgaaagaaaagcccagagccaacaactaataatcgtgcttaaaactcatcatttaagaatttcaaaataaacactgatcaattgaagttattttgacccaaagtcttacgtaccttcttttgcttgtccatattggccatcataaaaaacagcaaaaaaaagaaagaaagaaacaaagatggggagttgttgcttaatgggtatacagtttcagtttcgtaagatgagtgagttctgaagatctgttgcacagtaatgtgagtatgtttaacactacagaactgtacacttaaaatggttaaaatgatgtattattccattaacttaaaatggttaaaatgatgtattattctcaggtatgataaagacatacctgagactgggcaatttacaaaagaaagaggtttaatggacttacagttccacatggctggggaggcctcacaatcatggcagaagacaaggaggagcaagtcacttcttacatggatggcagcaggcaaagagagagtttgtgcagggaaactcccccttacaaaaccatcagatcttatgagactcacccaccatcatgagaacagcttgggaaagacctgcccccatgattcaattacctcccactgtatccctcccacaacacgtgagatttgggtggggacacagccaaacaatatcaaatgataaattttatgtttttttaatggaaaataaaatttaaaagaaggaaaaagaattctctccccttccctctctccctacctccctaccttgctttctcccctccagggaagacatgtgcctccaggatggaaacaaatggattgatctggaaaatacttaggaggcagaactgaaaaaatttgaatgtgaggatgagaaacagggagatcatgggtgatttccaagtctctggatcaactgaaatggagaatggataaggaggaacacctggaggagagcacgcttggaaaggcatggtgagtttcatctaactagagatcaccagcaggagtctgccctgtccatctggagcccaggaaggagggttagggtggagattctgtacatttctacagccaactctaatttttggttacaatcaaagcctatgcccttctaaaacctttttcttccatcactaatgatcagctgtgtttccagaagtatgaatggatttatcctatatttctgcctaatatttcatatatgaatacttctaggcaggcattgggtcatatgtgtaaaacgaaagcaagtacttaacacaatagaccattcaataaagctgcttttcacatgcttcatttactactttccattgcctttttcgcaagcaattaccatctcacacatgcccagtttcaccattctgcagaaccaaatgttgaatttaggcaaacatagggtgttcaataaacaggtggattttgaacagaacaccaatgaattcaggaagcacggtcaaccagctgcgtctgtcaatggaataatcagtagctggctgcatctgtgctggctgggctgccatcggtgtttacaagctggaattgaagagggctcggccagctgacagcagaagtttgcgcagcacctgtctaaagtatatatgactgcctccaggcaatcccattagttctccactttcatggacactaggacttgttcacaaatttagggggaaaaataaaaaagacaaacagagctagcctctgactgagaaaggacacctgaaagagaaacaatcccatatggagaaacagaacaagggggtgagaatgagaaagacaagaaatcactcaagaaagccagtaatgtttacagatagtagaaaaattttgtctgtaaacagtgggcttggtagcatttttttaaatcagagatgttctggagaaatatgtaaagaactcagcccaagctttctgatgccaggcagggcataagtagtttacatggaaccttctgacttgtttatctgacatagtaaacagctttctctgatcccactgtcccttttacgcattacaagataacaaaaagttatgcgattttaggaaatcaagtatataaacagggctattctcagcacatccactgaatattaagtgcccacttttatctgctagaacttgatgtgtgaaggtaaccaacttaaatgcactgaagagattgcattcacacagtgaatagtgacattttgctaggaatttgttaaattttataatgcaagcatactgccgtaatgttccacaaaacgtaacagtcggtgcacagcaatactgccctctggtttgtgagggctatttccatcctcaattcattctagcaggaaaaagaaattaaagatatgatagaatgctatccacattgttataatgctggttctttctgaggttagtggtcacacacagtgctatagaggcggttgttctttcttgtgcctgtaactgctgaggttaatctctcagtgcttccaaatgcatatggacatttacacatatggacactgaccaatcctaaaagaaaactcaggataaatcatgttcaacttcaaaagtccagcagctaattcaaagccatgctcttgtagaaggagccattgaaaacaacagagaaaccagacaacagtctttaacgtcttatctttgtttatgattcttaagaccacacctggcgtgaaccgatatgctaggtcaccctggttcctcaggtgcattaggcatatgtgagcagtgaaactatgacaaccagaatgcaacatccaattataatgattagaataacaacaaacacttaggcaataattatttccattcattcacttcatctccccaataactctacgaggtaagtacaattattattccccacttcatggaccactcagtgccatactaagagtcccagagccagtaacgagcagactagatttaagatcaaccccatctgacttaggggttctgctcttactgttgttctgtacctaaagctatctgatgtattttaaaatgtaggtgtatcagtttggtggggttgccataaccgtgagttgggtggcttaaacagcagaaatttttcttacagttctagaaactgaaagtccaagatcaaggcatgggcaggtttggtttctcctgaggcctctctctccccttggcttgcagatggtcttcaccgtgtgtgcaccttcctggtatgcctttgtgtgtcctaatctcctccacgtataagaacatcagccagaccagattgggacccaccgtaatggtttcattttaagttctctctttctttgttttcttcttttgagacagagtctcactctgctgtccaggctggagtgcagtggcgtgatctcagatcactgcaccttctgcctcctgggttcaagctattctcctgcctcagcctcccgagtagctgggactacggacatgtgccaccacgcttccctaattttttgtatttttagtagagatggggtttcactatgttagccaggatgggctcgatctcctgacctcgtgatccacctgcctcggcctcccagagtgctgggattacaggcgtgagtctctacgaccggccttaagttctcttttcaaaggccttagctacaaatgcggtcacattctgaggtactgtgggttagggcttcggtgtgaatttttggggaaaccacaacgcaccccataacagcaggtgtgttaacgttctacaaaacgcaacggtgggtgaattgtaggacttccctctgctttatgagggcttaattgtatagggccttattttggatctttccacattcaacaagttctgagaatgtgatacttggaaaccatgttcatcagaagagtgaaaggctttcaggtaaacgtcctttgatctttttcaccgtgatgccctccgatgacattaactgtggtagtaaccagcatcattcagttgctgttttagaaggaacttaaaaatggaagatttgaaaacatgattgtgaaaccataattttgcactgagtccagtattaacagtttttcaacagagttaactcttgctgctttttgttttaaccctgagtgtctagaactgagttgggcaagctccttaacccacagcacaccagcagcctagaactctccaagatgtcacttggattttccttctgacctgcctttcctgatcccttgctacctcaccctatagacataggcttacttttccctaatattttcctgtactttaacgcatagctgtgtttttatgaaaaataaaatactggggttttatgctcaacttatttaaatgatatttcactacaaattatgttcttcttctatttgtttacatcattatgcttttgaaaaccaccagaatatgtatgtgtacctctggatctaagctgttaaacatagtagccactagccacatgcagctaccgggcatttgaaatacggctcatgcaagtggaaaactaaatttgtaattttaatttatctttaatttaaatttgaaaacctgtatcttaattatgagaatacttttaaatatttttggaatatcttgatgaatcttcttttttcagttgtacattttataaaacttaaatatgaatcaatcagttccaatgaaaatttagcctctgatttaagatgtactataaaatacacatcagatactgaaaatagtacaaaataggaatgtaaaacatatcagtaagttttatgttgatgatatactgaaatactactttacatatattaaataaaatacagcattaacatgatcacctaattctttaaatttaaaaaagtaaaaataaattttcttggtacttttttgtgtggctactaaaaatctttaaattacacatgtggttcacattatacttctaccagacaggggtgatctaggttttaattcctctaactactacaagtattctataataagcataaataataattttacttcattctcttatcagcaggcaaatagattgtttctaattctttaccatatcaaacaaccctccaaattcctgtttttatgcatcctcactaatacttattatgatctttcttgttgcttttggtcaacttggtggttatagagcagtgtttcttatttaaatattcatgtctcagaatactgaaagtgtacatattagccattcaaagttcccctttcgtaaactgcccatttatatctttgcttattaaaaattttgaattcacatcttttatttaccaattagtagaagtaaaaagatatattcccagtataaatctcttgtccactgttagacgtaatttttcagctattatacgtatctccaatattttcttagcttgtactttgttcatttttcccatagtttatttcattgaacacaaatctttaattataattaaattccttaaattttacctttattatttcaagaaattctaccctagtaagaaattgtgaagaaatttcatcttttctactcttggtttatagtttcgccttccatatttggatcttcagtccatcatgaagccctatagcacttagagcagcagatggttgccaacatcctaggcttaggtacttgccatttgagaatctgaacaaaactgaagactttcttactgaaagaatgtatgtgcataaaatactatatatataatttcaggctgttcccagacctctactgcaagccctttcatgtatccttatgcagtccacagaatccaggcgcaggatccccgagtctcacagattctactctctattcaaaaacttcattgtatttttcatggctttgctcaccatctttttctgggttatctcatattctcaactagtttatgagctccttacggacagagacctagatccaggcatctccaagatttttcatggcacctgagagctgggagtgctcaataaatacgccccttagcaagtgatattccagaaatcagactcagagaagagaatgtggtgtaaggcccaggggattactctaaagaggcctccattaattcatgcattcaatcaacagtcattgagcttgtccactgtttcaggtcctgggctacatggaagataatcaagggaaaggccacagtttgtgtcctcagagggttcctattctagaggggacagcaaaggagaagtaattataacacggggcatcaatgctctgctaaagtaaggaagtagggagcttctggtctgcataacaggagggtacctaatggggcctttgaggtaggggaaggttgggcctctcagcaggagtcatgtttaggcggagactcacaaaaatgcatagtgttaaaaaaattaaatttagcctgaggctgtctccgtaatttgagtccctacctaaggaactgcagcctaacctaacttagtctattaaacacaccgaaagcctaatttaggatgctttttttttttttttttgtaacagcagctgagcttcagccaatcacaggctgccaactgatcagaccatgaccaaataaggtgaacacctagacataacttaaggaggaggcaggatttgactgaggaggcagggctcggacaccagatcaaatcaaagactacctagaacagggacagagtggaagtacatttccgtaagatatgcccaccactggtgccatgccactttatctctccagcacttaatagattctacctgaacccctcaccctcaactgctattaactgaacctggaaatctgagtatctatatctgtagtgcattaatgattctatattttgcacccactgtgtattaatgacacaaaagtggaggtttcccttcaatgctttgatccaactctaagctgccaagtccccaaggctgtaacagtgtatacaggattctacttgtgagcaaggaaacaaaccatatatggtgacttctctcagataacaacatacaggaaaaaaataaaacaaacaaacaaaacaactgcctaatctgggaaggtaggagtactgacccactctgtgaaacaaagattggttgggtatctccattggaacagggcaagaatatctctacagacccaatttggcagcaatggatagatatcagatgttgtggagcctctatttgcaccccaactggactaatttttgtttgtggccattaatggggaaaagtcataccccatattcactcttgactaccccatgagccacttgtttttaggagtggctttcccttgtatataaaaaacttggaacagaggtgaatgtaggatggccactcttgcttctctaggggtcacagtctataatcccataagaaccaagaacaccagaaataaacaagcaacagcattaattctagcaggaatcagagcagcaatagaacgagtggcatcctggggcagctttgcctatcacgagtacaccctgaaaaactagactcaaactctagaatccctagccaccaacacaggtcatgtactaaagggaatcctagagtccttagaatctttggcaaatgtacttcttggtaactcattctgagggctgcccgattagttgactgctctttggtcaaactctgttaaattaaacttgtctacagtttttcttttaccagtaggcagctcatctgaaaacagtaggagggaaaagagggaatcctagaaatcgatctgtcataaacattgtgaactggctagagtgctcctgccttttcctgggaatcagaaagtagcagccagacaggaaaccaaaccacctgatcttttacaaacaggaatcagatcactgtactgccacatttaaagccaccaggggcatcccatctaggatgggatgggaaaaagtatgtctaaaatatatatacatagtgtatataaatatatattatatataatataaatagtatataaaatatataagtatatattacacatataattttttcttagtataagtatgtcccgcgtaatatttgcaatgtaacttacactaacaaagtatgtgttatttatcagaaagtcaaatttatggcagttaaacctgccagcccaaagcacttaaaatataaaattacacttaaaatagagtcttcagtattatattttctctggctttcatcttagtgtgagctctgcattgttccccatgcttcaggcatgctgaccagtgagaatgagaataagaatgccaagctccatcccatcttagcaccttggcttctgtatcttctttccatttagaatgtgttttccctctttcttagcgtggttggtttcttctcttctttcaaataccagtttagatgtcacctccatagagaggccttccctaaccacaccacctaaagtaggctatcccaattattttctctctagatacatatatatatgtcagtccataaacattttattctttcacttctaaactgttgccctcaccattatgtcagagacttctgccttttgcatctttgtgtccctagcccttagcaaaatgtctgtcacatacgagatactcaacaaatttttatcatataatggaaatcttaagttagtattttctctggtgcttccaagacatgcattttgcctagacatgttattgttcgtcatgtgaactggctatggcaaaacacattgccttcagagagaaagagccacacaagttggaaaggaaaggtcacaaggatgaaagaactctatcaacattaatgccttataaaaaaatctcttaagagataccaaaagatggaaagaaattgagtctatcatttgaagacatcccccacccccgcttttttgctttcctgcaagtcatatctgagtcatacctaaggcactttggctgtgcctccttgtggtcctctccatttcttactacttcatctcatcactttaccaccttcaaagagtcctttcctcatataacctcacatgatgttcacaggattaaaaaactccaaacgttcaatagagaaacaacattttcttaaaaatatacagacagacatatgcgaattctttcaacatgcttataaatctatccacaaccctactcagagtatgcttcaaatgtaaatcagaagccatatatattgtattcttccaagtgattactctggaaaagaaaaatcacacatatttattgagaggagaacaaatttaataattttgctcaatcatcaaaaacatttctaaatatgagctatgataggaaaaaaatcagtttaactttacatatgaattattttcctgttttaatcatagaattttttaaagttttggattagattcaaatttcttcagagaactaaatgataagtttgcaaacaattactggaaagaaataaggacaggtgagagcaaaagaaagaaaaacggttacagagtgtaaaactattttcaagcacaaagttaaaaacttctaatacagaacctggaaaacactttatgtgtgtgagataaatgaaagcgttgaggtcagattagaaaaacaaaacaaaacaaaacatagcttctactgacaaatgtaaatgcaccctgtgatcctgttgccaatgaagtggcattgctctgatgtaccactcccatcccaacccaagcacacacttgtcaatgagcaccagggttttcaaattatccagaactctatcataatgatggagctaggaagttctttcagcctcttaacagcagcgcattattttccctatagataatactgagaacatggcaacacttctgcctgatctgcttattaataatacccaacacagcatttattagatagagaactactagatgttaggtgctgggttaagcacaggaaaagaatcaacaaattctacatcattttctttgttgtgttggtggtggtggttactgttgtttataccttcagatctctttctacactaaatttttgggtagaaatgtttaaatatcatccttagcctccgcaataataatagcatttcatcactatcactggtgagaaatttgtgttttatttttgtttacattttacattaagaaattaatgaagtgggaatggctacctttgctgtatactccaaactcccactgatctgtgtgtgggttgcgtgtttgtctagagaggacagttgcccaacacaggaaaaaaaataccctgtcattatatgatttttcacagaactaaaaagaaataaactacccccattccaaagcgtggcctcctatctttttgctacacctcatatacttttctcacatggcaagaagggtacccttgactgctcagtgcctctccctcctcttgatgctgagatgctccaaaacaccactggggttcttcaggagggatttcattgtcaactccagcttgcagtacagggaagtgacatctagagtgggcctctttttgtcactttccccatactaccacacacataaaaatgcctgtcaaacactgtcctacatacatggatgagaaaaagaaataagcactctactatgaaagactctaactagaaaaagcaaggagatgccaactgacaaatgtatggtgatggactttctttttttttttttttccaattctcagatttatttctgaggctctcagccaatttctgtgtcataaagatggtgcagttcagagcttaattgctttagcacttgcaccaagaaaaactgtattgcaaacaatgaagaaagaagagaggaaaccaacattttctaggcactggccacgtggcaaccagtgtacaaggcatttagagaaagctttttgattccattcaatcctggaaaccaacatgttgaagggccagatttttcaccattttatagggatgcaaactttagctcagagaggttaaatgacttgccaacagtcacacaactagcacttagaggaacgggaaggctaactcggagctgatgctgcagcttacactcactccccactcccacgcaacacaaactctttctaggcagcttcgaaggtaccaaacaagtggctcctaaggactcagtaaacattcctgtcagctggccaagatgaatattttggataatgtccagacacgtgaaataccagctttaagttgtggaagtgcttcaggcacaaccaagtctcatttacgtcctttaaaaaatagtcatgacctgcccccttcacacactgtcattcttctggaaggtatctgagagcacagctctgcaaatgccaagagcattatgcagtttccatacatagggcttcctgagtcaggtttggcagggcaggggttcagtgtacaatatttctgccttatttctttaagtttctcttggctacagctcttaagagacacacagagggaatggattctgtagaagatttctcccagaaattttggtgtagattagaaagcttggtttgcttctggttctattacttgagatttatttggaactaaaaggttttctgcctgagagtaaccatttaatatattggggaggggggaagaataaaatgctccttttgttttgctatttgcaccaccctgtcccgattctattgtttgcagtaagttttgtaagagaaactcttctgcactccttattgtgttacaagtttagatgtacccaaaccatcagcagttagattccaagtatacgcttttgattgattcaagtgcattacccgggagggtgtgtgctttgctctgttgttcttccagccaactcccttgccagctgctgaaatgatgccaccaccggtctccatgtcatgcagattttacaccctgataccaggaaagcagaagcatttctcaaaagactttttgctggcttggcaggaaaacagaaattgctttttatcaaaatgaaaaaggttttcttcatgggaaacagcaaaagcagtttgaaagaggggccaatacttttatcctagataaggtgttttcagcagagcagacagaaaaacatgttttccttcctttcatgacatcaatcagatccccaaagccagctacctttattcacagaacagatggagcggtaatggtcccagaggccactcttcctggtctggggatcttgccatccctgcctgaaagttctcaaatccaagctctgggaacttgggatgcttttttctgcctctcccacactccaagaggaacacatccactattatgcatgtcttcattctttgtcctgggtggaacttctgggggtgggagaatgggtgataaagggggaagtgggattcactttgtgaacacctactagaagccaagccaggtacatcctatgcattatttcatataaaccttaccacaaaactttgagtggtattattatgtccatatgacagacgccaaagaagtagactaggggagttaaatgaaatcccaaaagtcatatactaatatgtggaatactagtaaaatctggaatgtgaaccctgcctggtctgttgcttcagagctttgatgtgccaccaacaaacacttccatgcctctctgcttagaggcccagtttaaaatgctatcctctggataaatatgtggtaggtccatacaatggaatattactcagccatgaaaatgaaattctgacacgttacaacatgaatgaaccttgaaaacataagctaagtgaaataagccagtcacaaaggatgatattgtgattctgaaaccaacccaataatcccatagatagttttttggatagacgtagaaattgacctttgtggtcttaatgcttgaagtttatatttgttttaactgagttccttcctcaggaaatgaccttcaggcctctcgaaaaaaaaaaaaaagtattggcaaactgaaactcaccagatcaccacattttgacaatgagatgctggacccctcattctcaggattgcttccttgcctctccctagttcctgttttcttatacattattacatttcttcctggctatataaacccctggttttacatagtctggttttggtcagggaaatggatttgagactgaactcccttcttcttggcaatactcatcatctcagtgactggttttctgcacggcaaacagcaggacctagaccgaacccctagtgttttggtaacaattccacttctgtgaggtacctagaataggcaagcttacagagacagaaaagtagaacacagattaccaggggctgggggagggagaaagtagtccggggaatagggagttattgtataatgagtacagagttgtgttttttttttttttttttttttttttttgagacagagtctcgctctgtcaccaggctggagtgcagtggctcgactcgatctcggctcactgcaatctccgcctcctgggttcaagcaattctcctgcctcagcctcctgagtagctgggattacatgcccagctaatttttgtatttttagtagagatggggtttcaccatgttgggcaggatggtctggatctcttgacctcatgatctgcccgcctcagcctcccacactgttgggattacaggcgtgagccaccgtgctgaccgtgtacagagtttctatttgagatgacagaaacttctggagttggatagtgtgatgactgcacaacattgtgaatgtactcagtaccactgaatgacacagttagaaatggttaacatgctaaattttatgttatgtgtagtttgccatcacacaaaaatgttccctgcttttccctttgaaagatgccacatctgccctgattccaaagctctttcttagaattgactcccactagctgtaaagtgacacaaaagatgatctactccaggcatgccaactcaaatccactgatagtgacagctagcaacactgtgttaagaaagattatgaggatgttttcagggccaaaaaagataaataacatgatcgatttgtaaaaatcccctcacaatgagacatcgaaatgttggataaaatacaacaaaatattaattgttctgggaaatgtgaattgggaaacacagaccaagtggcaaaagcttgggcagagagtcatggtattcagaggccatgatggtcaaatacaggttgatcttctaaaaacataggaaccgagtgagtaagaaaatcaaggcaactaaaacgaagaaaatgttacagtaggtaggtagtcaggcgtgatggggcaggagagggccctcccaacacccccaccaggaaagccacgctaccatcaggtgatggtcaggtggttgttaactctctttaaaataataatttgtcacagccagcaccagggaaagaccgtcttcctatattgataggaaacacctgtaactggtaatcagcagttttcaggagttgggcgagtgagcacaagcatgcgcattaagagacaaaatggcagaatatggttttctggggcattccactggaaaagggaagaaagcctcaggtgggcatacatacaacttcttaaacacactcacatgctcacctcccacatgttagcaggccacacacatgtgggtggcccaccttaagagaagaaccatgggaaaagggacacaaggcccagaagtacaacaacatataaaacccacgtcaaaaggtcaaacgttacatgtgaccttcacagtgcctgcttgggtctcttccagatatactttcctttctttcctgtgctaaagctttttaataaacttccactcctgctctaaaacttgtctcagtctcttttcctgccttatgcccctcagctgaattctttctcaggaggcaagaactgaggttgctgcaggcccatatcgattagccgccagtaacccaaatattcattgcccccaacaaaaagagcagaggttttctgtgcctacgaggttcatgaatgagggctgcctagagctccccccattcttgttgggtctccccttctagtacaagactccttgtagctttgcaataagtttaccttttccttataaaactttactagctattcttcaaatcgacaatggtttgacttcaacaggtcttcatggggtgatcacatcatgtgtcatccatagagggtaatttgaacttataagcattaaccgtgctccatgagttgttgttttttgttttgttttgttttccttttgctttgataaacaacatacccagatacatgggggaaaaatggtagtcatccaatttcttcatattgccagactcacagcaacaggaaagtgacgttattaaccctggggagcctctataacttcttaaaccataaacaaaaataaagaacataatggaaggtataattggtgttaaaaaaaaaaacccaaatgttttctgaattccatcctcatgttacacactcaaaaagtttctctgtaaagaaagaaaatctttgactcaagaatcaactttctagctatctcaaaaccaaattataatgaatttagaccgtagaatcaatactgggggactaactaaggatcactaaatcctgtgttattgattgcttggagaaaactatctttttaaatatgcatcacataacaaagttctttatttctaagaactttctccaaatcctcccatcacatggtttatgtaatgattaatcctttgtattaactactttatgtgtcagaaatattaaaatgcatattaactgttcctgggaaatggttctgcagtttctcctaaaagtatactacctactttgaataagttacatgaaaactgtggcacatttgggaagaaagcagcttagtaggagaaaaatgagatttgcaattataagaactcaatacatgggtgtcttaggcatttccagattttaaaaaagtataatgacttttctcccccagtgtgataccaaaatcaatggaatggttttggtttgttttctactggagtgtaccagttagatttaatcacagagggaaaaatcttgttttgatttctcttattaattacttcttggaaaaatgcactgtagcattcttattcagaatttcaggaacaaaaacttttcacttttcaaactgcaaatgaaggtggggtaaatgtgtgaaggagctaagatctagatatattagagtttctatctctgaatccaggaaggactttgtttatagtggtggaaatcaagcaaggagctattggttggtccacacaatgcctaggtgttggctgtcatgctccattcagacccacaatcccaatgaaacctgtcactttcaagagtgcaaataataggatggggaaagagtgttagagtaggacgttttctaacaagagcccagtggattcctacctttcatctaataaatttcaatggtttaagagagcagatccataggtgccacacagcgaaaggacctgtgtaaaaatcacagtgagactctggagtaagagatggaatgtgatggcccgaggccctgccctccaaccttgagtccacaacatacgacctctttaaaaaactccctccagaagccctacagtttcctctctggtttgcgtcttactgctgaagagtctgtttgtagagatggatatctgactaagctagctttccttttttatgctctttccctcaagaaccaagggtttttcacattccaaaataaaatgcaaactgagagcattttgtatttttgcatttcgattccctgttttgtcagtgagtaattatagcaaataaaatattgcagctgaatgtaaattgttaggcaaccagatcacagcaggatatttttcttccacaagttttacatcatagagtgttaaatattaaaatattgcaagtcaagtaaacagagagggttctttgctcaaaacattaattttaaacaaacatttcactgttattcagatcggatgctaggaaacaaatgacattttctttcaaataaggtgaatagatcatatgaaaggaaagcagacaagggaatcatacagaaggaagggcatttatgacacgagagatgaatttcagccagaagaacaggagagaattcacatgtaggagagaaagcaaaagaaagagaaattggcaaaacaacatggaaaagagcaagaaatgagaaagactgacttactgctagaaggggaaaaaatgaagatacgtctcatgtcagagtacagagacctgactcaaaataaggcagctggggaagaaatgaaattctttctaacatcatgaatttctgtttccttaggttattaccagaaaggtagaaaggagatgaattttcagacctccaaaagatcaccaatcaataaaataccaatcaataagcattgattgagtacctaatgtgtgctcaacaaccaagtacaaaattagacatggccttcttctgaggtaccttactatggagttgagatgaggagatgctgaaacaatgaatgagagtggaaatgtattctatgctgtggagtgaagaaaacacacagctcaggattcaatgataatgacaatgagggtggttgagagtaactgtcgtaacactcttattttctaagcacctcctacattccaagtactgtgctggatgcttaatattttcatttccaacatttaaaacaatccattaagaattatctcctctagtgaagaaaataaagcttcaaaacttaagttgcttgtattacacaatgagtaaatggtagggcctgaatttaaccccaggtctcccaacccaaagatcacgatctttcttctactgaagtgctggatttatcctaagaaggcattcttctgttaatccttacaccagaatgccagctaattaaaacagaaacaaaaacaaacagaaacgctgtttgagaaatgttctttgtaagggagatgacctaacatgaatttttggatgaaattataatggatatggaggagttttgtttttttggtttgagaaagaatcttcaggaaaacatatagaatttgcaggagagtcatgttcattaaaccatctcagagttaaagactggagggaatagatgttaatagccataaaggccttgcagaaaaaggcaaaccttcttttccagtaggagagaagaagtgaaaagggatggaggaggagaagagtcaactgaggagcaagaaatgttccacaatgagaccgcttcacaatatctcccagttcacaactaaattaaaataatgcctggggagaagactgttacagatacatgcaaacaaattgcacatcctgttaagtagggcaaaacagacacttggacagagaaaccagaggaagacaaaattcacagagaaggtggagagaactttaacttctcatgaactgtggaattggtagtttgagtacattatagttagatctccattgagcaacaaggtcccgactgacatctggtctacaagatcaactttctggcaatacggtaaattttttgacagttactaaatgagactgaatataagcaaaataaaaatcatcttgtgtttcaagaaactgatatactccagatacatcaccatagcatatggagatttctttaactagaaaaaatagtccatccaaattcacattggttgaggaagccagaacactgacttatccatgtttaccacagctcatctgccttccctcccttaataaaagcagaggcccagagtgactgccaaacaaaatctacctaaaaaacatgccattcaatttttttagaaggccattgaaagataagcaaattaaattaaaagaaaggaatgaagagattttccttctgtctggttgttgagagagaacatttcttgcatatccagcatttggcaatctcttagcaaaatggcaaattcacaaaccctttaacccagcaaatgcattgctaagaatttgccctacagatatacttccaaatagtatgccagaatttgtgcaagaatgtcctttgtagtattgcccataaaaacaaacaaaaaaatggagaagaaaacccatataccatccattgggttaaacgcgttttgatttatcaatacaaaacaatatgtacagctattaagaataatgaggtaggtctgctcttcaagatatactatgctttgaaacaagctaagtgtgaagaatgtatataatatgccatttaagtaaagattttaaaggctccgtgtcgttttgtttagatgtcaacatgtgcataatttctttttctgaaaagctacagaagaaacttcacaatggtaatatttggaggacaagaggccagcatgtcagagaagagaaggaaaggaaagttttcattttcctcttatacctttccttcctgcctgaagttataggtatggctaatttgatttaaatcaataatattaatgaaacataaaagtaaaataattacctagtaataataaaactatgttgtttataactcttatttgatgtttggattctcagaatttacttcactgaactccgaaatgggtggtatttttgaaatttttagctgcaatgaaagaacacagtataactgatgcaccccacccccaaccaaaccaccctcataccttgtccaccactgccatctctatcttgcatttgaaaatatgcagagaagactctgtttccatgctacagacagtacttctagaattttgaccgcatagtaaacagtcattgtatcatccacaccctgaatgatgagggacagggacagacagaacctacctaccatgtgagcagctctagagctgtcatagctatagctgactctagctcacaaagcagacatgaggaaaagcaaagtttgcatgtgcacatacacacaacacaagcacactgagaatgaaggagaacaatgtgagactatactggtcaaagagtatttaggatctgccaaataatccagttttgtttgtattttcatttacatccctttcaccttaaccattttcacagttatcaactctctaatacactgacacatgctgtgttaggcacttcgcaagtattatctcatttacttctcatttaaaatgccattggttaatatcataatcttcccattgcatatgaagaaattgacacttaaagatataacacttaccctactcaaagtcacacatctacatctagcaagtgggaggtggcattcaaacataaacacagctggcctcaaaggcactatgactcactgtattcattcctgattcaagtctcatgccttgccctgagactgttctttaggacataaattgggcaaagagcaatcaactcacaaaaagagaagaccttccagaccaaaactaggaagtttggaaaaatgagaatcatgaaaatatgcgtattacacatacagccaggttgaagaagacagaaagcattagaatgtggaggaaccttatgagctagaatgcttagtacttaaagaaatgtctttgggatcagccatgctcctgggatgaatcctgacctggccatgatctaactgtcaccttaaccatgtcaccgagaggcttaacctgcacttacttctttcatctgtaaaatggatggcataatagtgcctgcttcacagaggcatggtgagggttgaataagatcatgcacattaagtacctaggacccagtaactctctgtaattatgctgtgtttgagatcataaagctcttaatcattataaaagtacctgagaaattctggaatgctataacaggaaaacttctgaaaatatagactacccctaggcaagccctttgttttacacagcaagaaagtgagacctaatcagttagaggcaagatgcttctcaagtcagtctattgagtttttattttgcactgaattacacatctacagagcttcctgtagcaggaaactctgctcagtttgcccattgctcattcctaacacctttttctcctgcctgttcccatcccatggccaactactcattctctcagaccatcttgaagccagtgaaaatctgctggggaatactcgggggaagcatatgattttccagtagcaacactgctgctgccacctctctccctttcttcctaccgtgaatttgatcatggttccaggaaatagggtggccatcttgcaaataggcagattaaaacaatcactaagacactgcctacctccaggaggtcttcttgttaccaaagaaaatacacccctatttttttaagcaactgttaaaggcagggtttctgttacatgcagctgaactcattcccagaaaatgatagaagtcctttttccatggacattgacacagtctaggatgggatggtggggatagtacagggtactcaccagctgttggagggaaatccccaggttgtgagagctcttttatttaaaaaaaaattaaaatgtaagtcaaactcaggcttagttttgaagttcatttctcaccttgttctcatttttatcttgatactccgaatgaatttcccaacgatatctaagagcttcccattcccaggctggtccagtgatttttagtgaaattaggttttattgaaagtgagttgatttttacttattaatgttctgctaattagagcactttgtcaatatctccatgcatgcattatattctcatgtccacagcatgtgtttagaaatatgtggataacaagatggagagttagactgttctggccctaatgacctcccgccctctcaaaacgccaacataacttctggtcacgtaatcatgggccaccttgtactgttcactgactatttgttataggttgattttaatccctgacaaattttttttttttttttttttttttttttttttttttttttttttgagatggagtcttgctctgtcacccaggctggagtgcagaggcacgatctcggctcactgcaagctccgcctcgcgggttcacgccattctcctgcctcagcctcccgagtagctggaacaacaggcacccaccaccatgcccggctaattttttatatttttagtagagacggggtttcaccgtggtctcgatctcctgaccttgtgatccgcccacctcggcctcccaaagtgctgggattacaggcgtgagccactgcgcctgacagacaaaatttttaaacctgtgaatactgacacagcgcttcatgttttgctagtcactctcagtgcctatcacagaggtaggcaaatcaaaaattctcatgaagtactagaaaatagatgcacctgtcccccaaatgcacagcataagaagatacccagggactaaaagctcccaactccaaaataaacctattcatgaacatgagtctctattcctttgctcagggaattcagtgctaaagtagatagcaaatatatttatattaggggaaatatctaaaaaatggcacttatagatacatttgctaaatagatatggaagtctatctgaagacctagcactatgccagccatacaacaatctcttcacaaatatgtattgaatgaatgaatgaatgaatgaatgaatgaataagcacacatacacagcagaaaaacagactatgaatgaatatatatcctttcccctaaagaaagatactctaaaacaaatgggcagtcaaaactacaatctctcatttaactgggaaaagtaaagaaccctctatttcatctttgatttcctccttacatgatgtacaatgcaaagggcttgctagtcatatttgtcaagagagcccacaggtactatctggctcatcacagcttaacttatcaattgccattgttgtttggtggatattgatctgggaagaccttgtatcttgcgaaagtcacttctacagcaactcatcactttttctttttagtcgacatgaaggctcaagtgttgtggtatactgggaatttccacgcgacagccccattccatcattaaatacccagtgagagcttgttaactagatgaatgtcccaattaaaccagcacgttcttgtcgctgcctaacagtgatggtgggttcagactaacagtttgaagggcaataactaaaatggtttgaggagcctcaagtgtagtttcaatggtttcacacttatccattcatttgttcattcaacaaatcactcaggggcccagcatggtggctcacacctgtaatcccagcactttgggaggccaaggtgggtggatcatatgaggccaggagtttgagaccagcctggtcaacgtggtgaaaccccgtctctactaaaaaaacaaaaattagccaagtgtgatggcacacacctgtaaccccagctactctggaggctgaggcaggagaattctttgaaccaggaggcagaggttgcagtgagctgagatcgcaccactgcactccagcctgggcaacagagcgagactctgcctcaaaaaaaacaaaacaaaacaaaacaaaaagcatttttttggcaggtcccaatgtctatttccaagctgaaaatgtttgctttcccaaaggggcataaaactgtgatttttcttaacagcacagtttaagtggtcttgactctgcatcttaagttcccagggttaagctggagatcttgagaacaagaaaagagtaaaaatagcaacagtgcaaaactccagacatcatgttggctccatacggctgtgtgggttgtgcactgtgcaagttcagtgtgttccattactaggaccatgatacaaatggcagggaagtggtagaaaccccacccaaggggtatcctaggcccatagtgctccctagtacaagggccacaaactactaaatgtccaaaatcacaagtaaaaactgttcattttggtagaggaaatacttgatttcatacacatctaaatttcacaattaaagtctcaaataaaaagctgccaagtaaaaatgctcaatgaaacataattttttcctctacctgatttttaagtaaaacaggcaaagaagaaacaaggcaatgattgaatagaaatgctattcttgttttaaaaaaaattagacggtcctaagaatctatgctaaatgattacattaatatgcataaaatacataaaacatatgtacaaggatgtttattgtaagactgtttctctattactaaaatacagaagtggttatataaattatggtacttccatacatgaaatgctattaagtcaataaaaagaatgagtaaacttgtaattgctatcctaaggacaaagctccaaaacatactctgaaagacaaaaaggtaatcatagaaaaatataatatgatcctgtttataatcaaatctagataatgtacataaagggatattaagtcatgaaacagtgcttggaaagatacacaccagtcatctgacagtaataacctatgaagatgaacgaggaagtagagaaatttcatattttatatattgtaatttgaactacttttttttaaataatgaaaagtgtttgtgtattaagtgtattataaaaaatatccaaatagttcaaaatgacagtaaattacaggttatgtatagtttaatcccaacctgttacaattcatgacaaaacaaatggtttaaagttaaaatttctaatgtaacctatgtcaattacacattctgacaacatatattcattgagcacatacattacataaaacactgctccaggggctgcaggtccagcaaagagacaggtaaggcccctgcttgtatagcgcttttgtccaagacagtaaaagagactcatatattttaaagagattttcagttaaccatcattttcatagtaaataattcaactaactatgacattttgggcactgtggctgagaggtttgctgtgactctagtaaagtttcttcttggaaagacattctgtgccataaagagcattccctgcctatcaaatattcatccttctcagccatcaatcaactgaagttccctcaaacagaatccataaaacagtcatactttccatccttagaggggtttacacctttccaagcactttcacacatctacggtgtcctaagagatgggtgactaagatgcaggagcaaaataatataaatttaccatataaaaactttcttctgtctagcacacttttctcctcgctctttactcgctcaagttttgctggtccttcagtttgcaacttagaagtcacctcttccaggtggcattccaggctggtatagggatcccccctacatgcttttattgctccctattgcctccattccctcacaaggtgtggaccatgctgctttgcaatgaccaacttggtggccacatccaagtcacagggctcaggatcacctggagtgccctgggtccaaactcaccctcaagaactgactcaccaggtaggtgagtatctgacagtcatatttacagaagctctccaggtgttctgaagcagttaatcccaagatatgatgatggaggtgtggaccatgtctgtctctacatcaccatcattgaagccacggcttctgacagtgcctgatatattgctggtgcccaataaggagctgctcctttatctactggttctttcaaaaaatatttactgagcacctcagcatgccagacttctggtgaatgacaaaatgaaccaatcatgcatcatgacgatgatacagctttcattaataagactttttgagttatctgatacctgaagcaactacaggaacccaatccacacctgtccctctgtcccctgctgggtagattagggaagacaaacaaagatttgggagcttttgtcacattctttaggtgcttccgggatgccaccagtgggttccaactgctcagctatgtttagaggtcacaggcaaacagagtgggcccattgcagactgcgaggcagggtgcctctgttcaatataaggatatagtccatgagacagaaggttattacaatgaggttgcctgggttttcctccccagttttattctgtacgccttttaggtaaattccttaatatctttcttcaaaatagttggatggcatttgtcttacctttaagggattcggctaaaatccacttgagtgctggcgcctaggcagggaacaggcagcaattcctacaggtccatctacctgatgacatgaagactagtttatggttaacaaactgtttttcactctctttagaagagaaatctctgtcaaaggtcacataaactttaccgtagtcagcaaagccccttcttataggatcctccctctatatttccaccctcatctagcactgtcttccttgcttgccatgccctagtcctgctgtatcaatagagtagagccaccagccacatgcggctcctgagcacctgaattgtggctagcccaaactgagatgtaccagaagtgtaaaatacaacccagatttcaaacacttagtacaagggaaacagaaggtgaaagaatcctattcataattttctacacagcttatatgttgaaatcatactattttagatatatcgagttttaacaacatattattaatttcttttactttttatggtgactaccggaaaaactaaaattacacaagtggcttgcatcatatttctaccgggcactgcaaccgtgtctgtattggcctcttgatttctgtactataacaagcatttcccccacttctgaggctgtgtgtttttttgtcttcacatgaatgactctctttccatgtctggcatgcctgactgctgttcacccttctaaatgcagcttgtatagcatctctggaataagacttgttgaatgtctatctgtttatgacctgcagcaaagttagccaaaatgctcaaaagggggacagaattgtctgcccagacttaaggctggggctccccgaagctgactttccagtgataataaaatgtccccacccaaatctcatcttgaattgtagctcccataattcccgtatgttatgagatggacccggtgagaggtaattgacccatgggggcagttctttcccatgctgttctcatgatagtgaataagtctaatgagatctgatggttttataaagcggagttcccctctacacaagccctcttgcctgccaccatgtaagacgttcctttgcttctcttttgccttccaccatgattatgaggcttcctcagccacgtggaactgtgagtccgttaaacctcttccctttatgatttaccaagtctcaggtttgtctttactaacagagtgagaacagactaatacaggtaataaagacttgaaggacatgaggtaggaaggaaagacaaaggtagaggaggagaaaccaagagtgttaccaagccttagcctgatgacaacaggcagttgcttgaagagagacaaacactcttgctttaagaggaataaatcaaagtggcttcggatacattaaccctagcttgtcatttgagaagacagccctttatatttagaatggctaggaaagactccttctagatgatttggtgctaatgttaagaacatcacgcaaggtgtccagttcgatggctgtcaacaccttctctaaaccttgtggcccataccatatcaacaacaaaataaagaaaccaaccaagtcaacaacaacaaaacatcgtcaacaacaacaaaacatcaccaacaacaataaaaattagaatatttaagagcctgtgcatgcttacttatgtgctgggcactgttttacacattccatatattaacttagtctttccaattaagtcttcaaggtagccaccgttattgttcccattctatagatggagactgaaacctaaaaaagtcaaggacttgcccagcatcactgagctggtaagtggacgatcaaagatttaaacataggcagtgtggatcccaagcctgtgctcttaacccttgcagcatataccactctacatcttctgtactattctctattgacagtatctatgaagctagcgcttcatggtatcaggatatgatactttcttaattattcattattttgtctatgtatgccttcttttcccagctacagcattcactgtttgaagggagagattcaaccatctccttctctggaccccacacccaacttatcctgttataggctcatggtcaacagatgactgcactgtgttactaaatgccagggaatacacagaagttgtgactgcttacatattcatggaagaaaaccccaactcctatcatccaagtttgaaactaggtcttctttcctattgggggaaatttctgcaggtgtgagtaattagaaaattaaacattaattaacaattcaagtgactgattgtgttagcaagttgcttgctaaccatacaggtaaatattgtgcccccatatgatgtttaaaaataaggtcccttgagcatattaagtagtagagatggttgactcaagattcaagagtttcctgacccctttaatatgtcacattttaagtctgtatataacaaaactattgggaaaggggattgccttactcactcaccttgccttatcatcttacaaaatatcttatattaaaagagagaaaaggatgacagctctgtatctatcacctattactcattatcctgggacaacaaacagccccagaatctttctttaatgaatataggctctcatagtacatgcttatgttcgtctcacgtttgctctctctcatttcaaaaccctatttctcttctgccctttatgtcttcaaaagagacgctgatattaattaccttgcttctctaacccctcatcgttttcagccccaaacaatcagcttcctgcttttaatcttctaccaaatctattttctcatgatctaccgaagtcaccctactaagtaagtgtttctggaaaggtattttcagtgcccatttcccttgaccaacctgtggcccttgactcactggaaaaaatcactccactcctgccctttgtaatattattctcagctggaattctagcctctgtcctgcaacctccagcttgattttacaatataaacactgctacttcctaacaagttcaccagatatacgaaataaccctgtatttcccactgaagtaaattagattgttgttcagtaaatattcactctctctttacttcttattcctgagaggagtatactgtcacattcctttgatatcagacttgatttggcttaagacatgtgaatggagcaggggcttaaaatgtcatgtgcattcctgtctttcactatgagaagcagatgtcttagttttttgctgggtcttggagggtgacagacacatggacttaactcacaccctatagtcaaaacaagccaagctggcccacagacacaagaatcagagtaaatgactcttatttcaatccaccaagtactggggacagtttggtacacatgagttttatgaaacagttaactgatgcacccatacaaatgttaaacctttgttcactggaacaaaggttggaagttttctccaacctttgttggatggaaattttctcttgttcctctacttctatggtattacctctcccatgccacttctctaacttcatgtcctgtattctctcccttattatgttttaaactcctttgaagagcaaagcatcaaaagttcttatccctagacagacacaaattaaaatttgcttattcattcattcattcattcattcagcaaatgtgtggattttagaaatgagtttctgtctcaaaggtatttaatacaacacctggctcagcttcatggactagagacacattatcactgaggtcacgttgttactgtttttgctactcctgctaactgttccaaaggggaaaaaaaaacaacatgcactttaaaagcatgatgttcttgttggcagaaattacaatagtttcttctcttggtgtttactcccccaacactttcctcagctctttatttctgatattcaattaccctttttctgcctggcttttctcactttcccagaagacttaccctgggaaactttactgttttcactggtgtacatttgcactagttggtttaattaccaagtgaatctacagcctctcagaacatttgacacgtctccctttcactggatccaagacatgaagcaatgaaaacgaatgggtgaatgttacagcaaactcaaccaaaatttattttgcctggattcaaggattaggctaacatgctagccagtttctgcccccctaaaatgtcaccctctggaatgacaaaaaccttaataagatttggaaccaaagttcctatgaccagaaactgctcaacatatatgcgtcacacacaggaaataaaggcacattttaaactagagctgctgggtcatctttaaaatagcagactgcctgtcaggagaaccaatggaataatcaatcactcaatttaaagtggggagctcctttaaaatgctagggtgatggggtatgggcacaaagtgaatagctgtgacagtacagttcctcagccaagatccacgaatgtaagcaccagtgggaagagcactagaccaagaggctcaaaaatatactgtgaccttcaactagtcacttaacaagtgctcattgtatcatttaaaaaataatacaatagaactccatgaatccaattaaatttaattccatattattcgagtgtttgtttaaaatgatatttctcaaagcaatggtcaaatgagtttggaaatcagtagattaaagaaggttaagcaggtttctgttccatgcaacttctcagtaactttaatagtctactgtgcaccgtgaagctctcagacctggtggatgtggtatggaacattccccagactaataggaatcaaagatcctgtttgtttaccatggacagccttgtagaactcctattctctataatacatggccatcaattatagaagacacagagatactaaagagaatagttttcttgggtcctggtcctgaggcctggcattctcatgaagctgagtttatgccctcccctgtgatttatgccatacctctgaatccttataatgatgtccctttttgatcttaagatggctttaactggtaactatcatttgtaagcaaaagtaccttattaaacaagaaaaacagctacgtgtgagttctgagtaaatattgctaatttatgtctatctgcaattgttacttgggctgaaacaaaagttccaggtaagtatgatagtcattttgccagaggagcctcaataatccctgagctgaaatactttcatacatcaagacgtaatcatctaatattaggaaagccattaagaaatacaattactactggaaatgaagaccttttacaggagaacagacatgatggttttccttaaaagctcttcccttttccacatccactttcttctactttaaaatgaaagtgacttcattttcaagtgaccttttataaagtccaaacatcaagtgtcgtaaatattctaagtattcagaatgaggtccagtactgtaatattaagttggatatgccagaaactcagaaaagcctatttctctttaaatagccaacttataaaattattcatattgtcttcctggattcccattatgttcctcgtgcaagaaagtgaaagtgttttatacaagccacactgtggggtaatatggccaaactaagagctttcagaaggattcttctcttattctctacttctgcttctgctgctgctgctttttttaaacaaatgagatcagaggcatactgtgattagcaatgcatgtttatgtagtgagacaccagattagaaatgattattatcatgtcacctaacagagtgataataatggtactctgagatggtacagctcagctgttgaggattcctactacaataattattttaaaattaattttgaagagaaaaaggaaagaaagaaagatgattgaaaccattaaagcaatcctgataaataagaaaaaaaaacccaaacactatgttttattcctaaggcaagcacaaaaaataaaataatcaccaaagtgagacacgactgactgaaaggtaaaaggaacattcattttccccatccaaggaaaacaataactgaaaacaatttaaggcaaaaagttaagcttctattctgagcaaaggagagttggactgtatttatgtgctaataatctatttataagaaataactgattaaataagatagataaaacttagtagacagaaatatatttttttcatagcaaacaaagcaatcaaaagagaagtgttgctgaaaatattgacaattaaaaatcattcaaggactctgaagtatatttcaggcagaaagagagcagcctaaggaggacttattacaggattgaaagcatcaccgtgaattcataatttttaatatataaactgagagatatggaaatatatatatagtatgtgtataagtacacatgcatataaatacacacgcatgtattgcctacctctactcacagagaggctgaagcaatgataccccactataaattagcatacctgatgtccagatcttggtttctaaataccattctccaaaaaataaaaataaaaaaggaaccagacctccttggagaagtggttggctccattaatgggacaggacaggaacaagatgagattagaatatcctgtggtgccacaaagttacaaatggctaaaaaaaaacaaagaaaaaccaaaattgtggggacaggtcaaaagaacacatgaaccagaatgaagggattcccctggctaaatagggacataaaataaaataaaaactgataatatcccagagactacagaattaaaaaaaatctacgattttacttcacacacacacacacacacacacacacacacacacacacacacatatatagaggggggggggaggatacaaagtaacatgtaggatgaacaagtctagagatctaatatacaatatgatgactacagtcaataaaattgaattagagttttttgttaaataagtagattttagctgctctcttcacaaaaaaagtaactctgagataacagacgttgatttgctttatgtagtaaccatcttattgtatatatgtatcccatatcatactttaaacctcaaatacacaaaataaaatttatttttaaaaaaatgggaggtgggggagaaaagcccttccttacagaatttcaagtcataaataaggagtaattaaattagaaagttaccatttaacaatcatcacaaaagtaactgtttcaggtaagaatcagtagtagtgaatgcaaaaaaagaatgggtaaaagtataagaaaaaacatactacattttctacaagtatattcctataagatacttattgattacaaaaggaaaaatagcaattttccaatggagaaacctggtagacaccacaccaaccaagtgatcaaagttaataccaagaatgggagaaaggagcatcagtgtctcctgatataatgcactaagaaggatataatactacctctgtaggattctggccaatatgcaaaatctgattctaaccatgaagaaatgccacatcagacaaactcaaattaagaaacattctgaaaagcaataggctgtgcttttcaaaaatgtcaaggtcatgaaagacaaagtctggggaattgtttgagattaaagaacactaaaagacaggacaactaaacacaatgtgtgatcctggaatggatcctggacccaaataaaagacaatggcagcatttccataaggtctgcagaccagaaatagctttatatcaaggttaatttcctggttcagtaattacactatgtttttctaagaaaatgtcttgtttaaatacactaaaggagcaaagaggcatcatgtaacttgctttcaaatatttcactaaaaattatatatacatttatacacatataacatatatggtacacacactcatatataggtgagagagagaaaatataatggaagtaagtaaagtattaatatctggggatctgagggaggagggtagagggattctttacattatgcttgcaactttttttttttgcaactctaaaattatttcagaattaaaagttaaaaaagaaaagagagggagcttgacttaatattgcagctgtaccataaagtgttcttgaacaagtgacttgtcttcattgaggctcggctccccctttgcaaaatagagacaacatgacttcacagggtgatcggggtggacaaacaagatggtgctgcaaagctccaacccaagagctggcccctgaagcacacagtaagtatagcttgtttttggtaaatccaaaatacaacaacccattagagggcgttactgtctgaaagcagtttgggggcacccgaggtgatgtgcaggccgcagagacaatgctgttctaggtcaggagcagaaacacaggctcctcacacatgcttttaaatggggctttttactttctaaaatgtgtttctacacaattgaaaacaacattactttttccagagtgggaggatgaaagcaatcgtgggtgggggcttcttgagaagaggggttattttttttacttttaaaaaggtctcagaacagttaaaaatagtttttccttaagcagcctccctctgctccctgctcccaccagctgctccttctctcagcctgcccttctctttgtcccttcaccattttcccctctctcctttttgcttccagtcactcatatgccacccactcctgagaaccctaccttctcttatttttttgtttggctttgttttgaaaaaaatattaatcccaaatgaacaaagaagatacgtgggaaggaaataaatggtgagctcttccttacttcaccacctgtcaagttttaagtttttcctccaactcacactaacctcctgcgcaaccataaacttcagtgcttgccaaagcccagaaaattctaagtaaaaagcagaaaatgaatgcagggaagggggtgcattcttattgttcatcagatctgaaaaaaataatgcccagaatgtcaaatgatattacactattaaaaaggtacagtaaagatgtgctaatgatagattttttttctactccaatatgttgtaaatattataaactatcatttactgtcattactttaatgatgtagaatgttgaaaactcaatctgggttaatttacaaataagtaattttgaaaggagaaaaaaatatcttttctatttccgtgtaatgtcccattacttgacagtcaaaatgtggatacagccaaaagaaaaataatgaaggtcaaggaggatcaaaatttacctgatagagtacctatctgttagaaatcactttcctgaaataccttctctgattttagaaaactgaaaaaacagaaaatacactacctttgacaatgcttgcgattcagggttgtgcttgtgtatgggggtgggagaacctctgctaggataggagaaagctgccagacacaagttcagatttaatagaaatagctttcaaatcaggagtctagccatcaaccagttttagatggacagtcccagtttcaagtaaataaaatatttgcatattagagcctcgtagccctacttagctgcaagtaaattttctgagatttactctgccttgcttcatttcatccaggcactgattattttttcattctttattcaccaaacatttactaagcacttctttatacaataaattctgagcaaggtactaagacatgaagaataaaacaggtctggctggagactgcacgaaattgccagtctgtctgagcctgtttgaattcataaagtccccgagaaagaagaaataggtgaggattagcaaccctgtaagagcatttacaaagaagggagtgcaaaagaagaaaatagcaccacagctcaggagggcaatggtattacttaccaagggtgcagtttgtttgatgacaaatctcaaaactgaatgcagtgattgtgttagatgcaaacacttggatgaaatagatgactgttcttgtgaccttgccaggaaagaggaggagtgaaagagagggctagagttctagtctcctttctgagttttgcattcattggcaaccatgtacctctagacatgggagtgcaggcatctatctctatcaaggtacatgacatgtaatgaaaggaagggatagagaccaggcaagagaaagcaaagagagagaaatagacagggagatggaatgaggtagacaaatcttagaggaatgcagtgcttctccaagtttggtgcaggaatgttcccattagaatcacctgagggggttatttaaaatgcagattcctgggctctgacccaggtctggtgagcctgaatgtctgtggctgggactctaagatttgcattttatatacgttttggggggtggttctgcatattaaaatttaagatcagaccactccctaaatccaagggtgctattttactgtttacttgaccaacagtataaatgggtgtcttcaaagccttgtcaccacaaccccatgcagcctgatccacttacttctctgtatcacactccctcctctcccaccaaggaaaacagagtgatcctgaagttccttaaaactcaactcaatctactgctcctcattagtaataaggttctgttcaaggaactattggctaatcattcatatcctgattgagataccagcatatcctacccaattattaactatggatggactccaaccaggaaatccaaaactatatgctgcttactgaatgacaataataaatgtaggctcttatttaattatgctgcggtttattaactatccgataataaggaaaacccctagtttattatagatctgtggggtgtgtgaatatgtgtgtgtgttttgagagatatatacaggaccctaatcagagagagtgccaggaataacagccatgcatgccaggcatcttttcctgtttctttttcagttacttgaatccacctgtgataaacttgccaaaagaaagaggaagtacaataaccacaaacgttaagtgatttttttttttgttctacaaactcgatgagttcactgcattgtctacttatctgtttttgtaatttcaacttttatttttgatttcggggtgcacatgtgggtttgttccataggtatattgcatgatgctcatgtttggggtatgattaataccatcacccaggtagtgagcatagtacccaatagctctttttcaatccttgaccccctccttccctcccactagtccccagtgtttatggctgccattttcatgtccatgtgtaccatgtttgtctgtttaactctcacttataagagagaacatgtagtatttggttttctgttcctgtgttaatttgcttaggataatgacctgcagctgcattcatggtgctgcaacagacatgatttcattctttttttatggccatgtagtattccactgtgtatgtgtaccgtatttcctttatctaatccaccattgatgggcacctaagttgatttcatgtctttgctattgtaaatagtgctacaataaacatacaggtagatgtatcagtttggtggaacagtttcttttcttttgaatatatatccagtaatggaattactgggttgaacagtagctctgttttaagttcactgaaaaacctcccaactgctttccacagaggctaaactaatttacattcccaccaacagtgtataagcatccccctttctccacggtttcaccagcatctgtgtctttttggctttttattaataactattctgaatggtgtgaaatggtctctcaccgtggtttggatttgtatttctctgatgattagtgaggttgagcattttttcatgtttgtttgctgcttgtatgtgttgttttgagaagtgtctgttcatgtattttgtccactttgtaatagggctgttttttgcttgttgaattgttgaagttccatatagattctgggtattagacctttgtcagatgcatagtttgcaaatattttctcccatcctgtaggttgtctgtttctctgttggtagtttcttttgctgtgctcaagctcttcgattaggccctacttgttaaattgtgtttatgttacattgcttttgaagactttgtcataaattatttcccaaggctgatgtccagaaagacatttcctaacttttcttctaggatttttatagtttaaggtcttacatttaaatatttagtcaattttgaggtaatttttgtatatggtgaaaggtaggggtccagtttctttcttgtgcatatagttagccagctatcccagcaataacaatagggtgtcctttttccattgcttaatttgttgactttgtcaagatcaggcagttggaggtgtgaggttttatttctgggttttttattctgttccattggtctttgtctgttttcacgccagtaccatgctgttttggttaatgtagccttatagtacagtttgaagtcagataacatgatacctctggctgtcttctttttgcttaggattgctttggctactcgggctcctttttggttccatgtgaatagtcttttctaattccgtgaaaaatgacattggtagtttgataggaataccactgaaaacctgtatattgctttgggcaacattgccatattaatgatactgattcttccaatccatgagcatactgtgcggtctttgatattgggtcctgactaggccaagaagacagagatagactggtccctcaaaccttttctctaatgtctggagagtacatattttatgcttttcagtatgtatggcctctattgcaacaactcaactctgccattacagcattaaagcagtcatatataatatataaacaaatgggtgtggctgtgttccagtgaaactttatttacaaaaacaaatagtgggccaaatttagcctgcaggctcttgtttgccaaccccagctcaaatcatcctcagacaaaatttagggagctgctaataataacaaggccatgctctgctatagtgctattaagctattgcctcagcatcaaattcaccctttggtattctcttctgtgataactggcacgtttatgtattgacaagaaagatgaccaccacatattaagtggggaaaaaatcacactttttatagcaatatcactttttttaacaaaatatgatcctctatacgtacatacataatgttgtataaggattcataagtctcagaaaggataatactgaaaggttcagaggggtaacctctggaaaatggaatcaggagtaggaagaaaagattactctgattttttgctttacattcttttgtagtctttgaatttatttagagtaagcaaatattaccattgtaagttacaacaataaaaaggaataaatcaaggtggagtcttaacagtgctgaaacacttttgttaatccatttccccagttccaacctaagctttacagaggtgctattgtcaagcaatcactcattcgttcactctacacatataataggcatccactttgggccagaccctacgctatgtgtgaggaattcatgaagtttaggatctaggtggaaaaacataattatataagctaaaattgtaattaaaacaaataatgtacatgaaggagagatggcatcacatttctttattaatatatttattgggtattatatcccattattgctggaggataaaatctatgccagggaatataaaaagatgagacagagaaaatgatacgagtaaacacgctgaggactttagactcagcatataggtgtttggttcctaccatatcatctacataatttccttaaaactgctgtgaatataaaatcacaacagctgttttaaagagactgaaattgaaattcaatgaaacaaggcatttgtaagtcttccttggctttctacattgatagtgacttttttttttctttttcacactcttagaatcagggatgggttagatgttatgatcttgctgttacttcaggcatcttctgttatcattctccctagaggccaaaggcagagaccatgtcttcttttctatatgttggaggcactgtcttttgagttatatgccaaacaccttctctggaattggtttgccacttctagggactggctccctgtcgccatgtttgtgtaatatgacaacagacttaggcaagtgatcctagctgggccagaattccttcctcacacactcaaaacaggaacaaaagagagtggtctagattttacaatgtattaactcaagggatgaagaattccttataaactagacagagacaaagatcttcagagataaaagacgggtacagacaagcagagagaagattaccaagagcagatcattctgtccaggtgcctctgattttttgaggtctaggttcttccaaaggccctactacatcctttgcttgggtttttttccatatgacatcattctacacttacattatatcttcccttttcactgaagcatctatatataaattaaagcatcactaactgatgcatgtgtatatattccaagatgtttaatattgctttcctgacagtagggatttttatctgcagtgcttcagagccaaagcaaattctaatgttatttttttcctccggaatgttctcccagaaagtttctaccagtttgctacaagttgaatgccacttgttgtcatttcagaacctcatatacagtattctttaatagccagaaacacaattataggggaggtcagaagatacatctccaaagtcttctaagtgttctctcctgtgccctacaggccaaaatggtttatatatcaaatgaccttggacaagttgtttatcttttgagtttcagttgtctcatttgtatacaggcaattctgttggctctacagtgctgctggcaggataagtgacaaactctttggaaagtccctcacacacagtcagtgtcatttaaggtggctcctcctgtgagattttgcaattagggatatgatcagtcttagtccattttttgtttttgtgaagaaatacctgaggtggtataatttataaagaaaagaggtttatttggctcatgattctgatggctggaaagttcaagattgggtatctgcatctggtgagggcctcaggcttcttcatcatctcatggcagaaggcaaatggaagccattgtatgcacaaatcacatggtgagagaggaagcaagagagagagtaaaagggtggggggatgccaggctctttttaacaaccatctcttctggaaactaatagagtgagaacttgcttaacccaaaggacaggcatcgatctattcatgaaggatctgccctcctgacccaaacacctcccccaggccccacctcccatcattggggatcaagtttcaacatgtggttttgagaagacaaacatccaaaccatagcattccactcctggattcccaaaacccatgtacttctcacatgtgaaatacaattgtttcatctcaatagtcccaaaagtcttaactcatttcaaaatcaactcaaaagtttaaagtccgaagtctcatctgtgacccaaggtaatttctttccagctatgagcctataggatcaaaaataagatgtttgttttcaacatacaatggtttcatgggcactgggtaaacagtcccattccaaaagggagaaattggccaaaagaaagagaaaacaggccctgtgcaagtctgaaacttagccgggcagacatgatatcttaaagctacaaaataatcttctttgcctccatgccctacatcctaggtactgcaaggggtgggctcctaatgcctcaggcagctctgcccctataacttcagtgggtgcagctcaagtagctgctttccttggttggagttgaatgcctgtggcttttccaggttgaggttacacactgctgctgctgctggtggctgtataatttgggagtccctttggtagctccacttccatagctccactaggaaccctgatagagattctgtggtggctgcacctctgtggaaggtctctgtctatgctttcagagatctatgagtcatctctaaaatcctctgaaatctatgagtcatcaagcctccaccacccttgcattctgggtgcctgcagacgtaacgtcatgcaaaaactgacaaggctcatggcttgcaccctccagagaaggagcctgagctatatctggggccatttgagccatggctggagccagagcagctgggatgcagggagcaacatccagaggcagcccagggcagcaatactttaggcctgtcacctgaaccattctgtccatctacacctctgggcctatgataggaggggtggttgtgaagatctttgaaatgccttaagggcctttttcccattggcttgactactagcacctggctccattttaatcatgctaatctctttagcaatttcactggactgggcaatagcattggattcctcttctgaaaatgtttcctttcccaccaaatggccaggctgcaaattttccaaacttttacactctgcttcgcttttaattataaattacacctttagatctttcctttgctgctttaattcagcataacctgttaaaagtagccatgccactaactgaggtctttgcagcctagcattttcatccaccagataccccaccctcatcacttttaagttcgaccttccacaaagccctaggacatggacacgatgcagccaagttatttgctactatgtaacaagggtgacagttcccagtaagtttttcattttcatctgagaccttgtcagcatggattttacagtctatatttctatcagcattttggtcacaaccacttagccattctctaagaagttcaacactttcccttgtctttttttcttcttctgagacctccaaactcttccgactgctgcccattacccccaaccactgggtactaattttctgtcttagttcattttgtatcgctacaaaggtgtcactgaggctgtgtaatttataaataaaaggatttatgtggatcacaattctaatggctaaaaaattcaagattgaatatctgcatctgctgagggcccctggctgcttacactcatggtggaagatgaaagggagcttatgagcttatgtatggagagatcacatgacagagaggaagcaagatgtcaacaaggtgctagtctcttttcaacaattagttcccttgggaattaacagatggagaactcatcccccaaaggcaggcattaatctattcatgacggatctgccttcatgatccgaacacctcccaccaggccccacctccaatactggggatcaaatttcaacatgtgccttgacagggacaaacaaatcaagcatgatccttagaaacaccacatggtagagtggaaagagtatttaaatgttagtcaggagacctctattctagttccctgttctcactaactagttgcacggccatgctgcttacttctttccaagaaacctgtaccttcatgcataaagtgctattccctatgcccgagtatcatcctacatcatcatgtcatggaaaccccaactctaattcatgattcatcttgagtcctgacttcttcagcaaggtctcctcagtttccacaatcagaggagaacattcctttttttgcataaataaacactgtacttggatctctcttatgggagttattaggctcaaccctactttatagatctagcactactcaattccttcttatttactttctaaagacaattcatcttccaaagttatagaaaaacaaagtttagcatttgctgcatatgtccaacaaacataattaattggataagaaacttggcaggtaattagtactaggcataccatttgcttttttatgcccagaacctagaaaagtgcctgacacatggtaggtactcaataaatatttattaaatgaaaaaatacccagacttggttaggaaagactatgtaaggcaacaatttcaagggtatatgcttttaggccaattcagtttgccaaaatctagcccttgatgttaaaaggaagctggggcttacagaaatggaggaccccaacgctaatggcaagggcagaaatcatcatttatgagacatagtctcttgtttggtggggaatgtttgacagctagctgcataattccacacggttccacaggagatgattttggatgtggagggaacactccaagcacacttcttatgaagacctataatcagaggtcttaacaaacacaagtgattaatatttgttgacttcatgacacatttattttctttagagcacttaccacagcttactctaactttattaaactttttagtatatttttgggttttttttgttgttggtggtatcctcaataaactatgagttctgtgggggaaggaaccatgattccctgtccattgttgtacatccactacacagcacagagtagatgaagctcaacaaatgttggatgaataaatatgcatatagtatgatggatggatggttgagtggataaatggacggaaagaggccagctagtcacccatacaagcttctgggttatgaacctaaataataacacaagttcaacagcaacaaaaataatcccattccattataggctggatgaaaggcttacccactgtcttacaccattagcgctgctctaacaaaatacctgacaatgggtgatttataaagaacagaaaattatttctcacagatctgggaaatccaagatcaaggtcctagcatcttgtttctgatgagggtagtcttctgcttccaaaatggtaacttgttggcagctccttcggaggaaacaagtgatcacctcccaatggcaacatctcgtaatattgttgaattggggattaagttttaacatgcaatttggaggagacacaaatattcaaaccatagaacccacttagagatgacagaataacgaatatatatgaattaaaatgaatggaacaacaacaataacaacagccatcacttatgtagtgcttactgtgttccaggcattgatctaaatgctttacatatatgaattcttaattcctaatacaaaaaagtgagtgttccttcttgatctggagccaagactgcatctatcaaaatgggaatctgatcatctctcccatctgccccccaccccacgtacatcaatggtctacatgacaatgctacaattaattccagaagtaaacttaacctctcactaagtgcccaaccaaagagactgcatggtttcccagtatgaaaatgtgaaggatcaattcacaatttgtttcctgcaaaactgtcattcctctcttcatacccatcactggagaaattacttttcagaccattctacagcttgggaatactaaataagccctaatgagttcaaaagtcggtaatgacagtactaattcagtggcctgtttggtagaaagtcagtctcccttcttcaaaagcaaaataggattatcaagtgagctgggagcattttctttacgtgattgatgggtagaaaaagtaatcacctttgaagtgccacaacatataatatatctcctgtgttctctttcttcttctgacacccacaagtaattgaagggaagggagcctcttagaatgaccaacgaagtgaaggtgacaaccctttctctgctatctaccactagagtgacatgctggggtcttgaatagttgagaactgacatgagtgtctttgatgggctgctttgatgcttggttcagagtgtacctgccaccagtcaggccacacagactttgggtgaaacatacatctaaggagacaagtgttactacttcttagaagcaaagggcctgtgcacctgtgaaagaagatctgttgtctgagctctggggtcggggtaaggtccgcaaggtggaagtgaaggaagtcaaggagcaaagcaagttgaagcaggtaagaaacactgaatatgatttcaaaacagtttctcatcatactcatccataatgaccgattaaccacaatgttcagactgacaactaggagatcattagcctcttgacctcagctcactgatgcagaagcagacagtcgtctccttggaaaaggcactgctctacagtagcttactttgtaaggggatttttgcaactacaagtaattcaactgaaacagagttgacactcaaaaaccttaagaagcagggattatcaggcaggtgaacagttttattcttaagagctcactctttctgaactctcctaaagcccatccaggcaaggacatatgagtttgttatctgaaggaagaaaaatgctttgaagaagatttataaagaggaagggtctttggtttattgacaagaaagtaaaagactttctagagttgtaagcgaaatgtcgctgttcaggttctagaacttgctggctagagaacagatggctgccacttgttggcacctggagtgacaaggagttgaggaaggaagagagtgtcatccatgtgatctggcacagaacattcttctctggagccactcttataaagaagagactggcatgtttggtgggtttactgtatgatatggtttgaatctgtgtccctgcccaaatttcacgtgggattgtaatccttaatgttggaagtggggcacggtgagaggtgatttgatcatgggggcggtttctcacgaatggtttcgcaccatccccttggtgctgttctcatgatagtaagttaccatgagatctggctgtttaaaagtgtgcggcacctcccaccttgcctttcttctcctgctcccaccacatgagatgcctcactccccctttccctttgccatgactggaagcttgctgagacctccctagaagccgaagctgctatgcttcctgtatggcatacagaactgtgagccaattaaacctcttttctttataaattacccagtctcagatatttctttacagcaatgtgagaacagacaaatacaccatagtacctccaacctgctaattaagtcaggagtctccccctggttggctgctacccacaggctccactactggtgagtcgtagaagacaaataaaggcattttaaggaatagtacgacaataatctctagatacatctgcaatcaagtaacagtaacccctctcagaagctatgccagtatgttgcagatactgaacacacatctgttaaatgaatgaaaatgaatgaaagaataaatgattatacagtgtacttgtttcataattgtaactggtttatattgatttggttatatctgcttggtaccatgtgagttttgattacataaagatctacagtctttgtatgacatggcctcagaacacaagtcaacttcttcatctggttctcaacctaagaaataatgatctgttgcaaggacaggctggccatggtagaagtacgaagcaacattttatctacatagtactttagaggtaatgtaagagattttcaaaatcatgcttttacaatgtctacattaaggtctggcttttaactaaaaagtatgtgaaacatgatagcatttctagattgattccattcagaggtgcttttatttcacacatatatctcagaccaagggtaagtatggtaagaacaagtcactaggaggccagcaagagaggattaatgaatggaagaaatggaaaggagagtgaaacactggtaaactcatcccagctccagcaagaggggccaagatatctgagctagctggaacagcacaataataaaaataataacaataatgacattcactgtgagcaaaagaactctgtaagcaaatcaaaaatatcagtgctaagggtcttaatagctgattataatgaacttcctcatgtaatctcagggagcagaaaagagaaaatagattgtgcatctgttcaaactaaacatatttcaagctggaaccagcttggtgccaaagacatctctgtcacagagaagaaaaaattccaaatggaagaaaaattccacttcatgctcaaacaccatgaacttcgacaggaaaattaggtaaccactgcctcacttacaaggcaacgcatcagtttcctatggctgcagtaacagattaacacaaacttagtggcttcaaaccacaccactttcttatcttgctcttctggaagttgggggtctgacacaggtctccaggtgtgggcagagctgacaccttgagcctgacgcaggtctaaaatcaagttgtgcgcagaggtgacttcctttccagaggcttcttttccagtttctagagtccaactacattccttggctcgtggcctcttccttcatctttaaagtcagcaataatgggacgaaaccatctcacatcacatcactctgacctgcttttctgcctcccacctccacttctaagaatccttgagattacactgagcccacctggacagtctaggataatcttcctattttaacatcagctattgagcaacctcaattccatctgcaaccttaattccccactgcatataaggtaacacagccacagtttctggggattacgacatggaggtctttggtaggaggggggtattctatccagggatccccaaccgccgtgccacacagcaggaggtgagtggcgggtgagcaagcattactgcctgaggttagcttcctatcagatcagcagcagcattcatttctcacaggagcaagaaccctactatgaactgcacatgcgaaggatttagaatgcgggctccttatgagaatttaatgcctaatgatatagggtggaacagtttcatcccgaaaccactccctccaccaccgggtctgtgggaaaattgtcttccatgaaacaaggtccctggtgtcctaaaggttggggactgctgttctatattgcctactacaggcatcaatgtttcaaatttacttaaaaatctgttcaggtccagctaccacaaatacaagtgagtgcctctcatttgtgaaaaactgtgtatgtgtaaggtgtgagaatcctatcttattttgctaggcagagctgactatatgtgctctcagagcccccagaattccagaaaaccaaaatttaaaaaaaaatattgaagattaaaaaacagagagacagtgttacccagtgaagtttctaagagaatctacccactaacagacttttccccatctcaagttctcaatcattcattttgttacatttttttatatttgacaaatgatatctaatgcatttcattgctgttagcagtttagacacttatgagaaattaaaaccccattaagtgtgaaggcatctaaacaataccagatctgccttccactgaatatattttgggatgacaggtctgcttcatctgactcctcaacaagaacagcttatgaaactcacagttttagtgacagggcccaaccggcacctatttttgtatcacctggaaaaaaaaaatgcccacataggcaatacatctgatacagaaatgaaattaaatagaacaatactgaggcatcaaccactcagatccatttcactgtttcctattctgagacaacctaattgaaggtggcattccaaggttaaatcctagctctgacagcatctcctgtcagacacctgtcaaaatgtaataagacacctgtgaaagggaagtgatgccaaagccacatcattttcccctacaccttgattcctaacttgcaggattcatgtcacccagcaaacagagtggtagctgggtgctgctggcactgtgccaccatttgcaggtgagggagggaagggaagggaacacaaggggtgggggagagagagagagagaagaagagagagagagaaggagagagggagagaaaaaaaaagacaacactgcaaaaggaagcacccaagcgttttaagtttagcaaatgattatgagcataaaaggacaactctgaacggacttgaattttaggattcatccctagagtcttgatcatgatcagaagcagggaattattttttaatatctgttttacataattaaggggtggtagctttcatgcaaatgaacgctttgaatgctcacaacaccaaatgggcttcattagcttagctgggcaattatgaagcaggaagtaaaaagctgagataaagacttatctcaaaaaggtctgaagcagggcgtgttgatagccaagaggcacaacgatgcattttgtacatttattacctcggaggcaaaacttctaggattctagatagctttgaaagcagtgcatacattccatttaacacccaaatgaaacaggtggaatgtttaaagatctgtagaaagtcttgaaatcgttcccacacattggaaggttttaccaaaccttctctatttattctaagtgctttttctattgtttttcaattgcttctctcatttccctcccgtgtacatttcagagaaaattggagagcttaaaatgcgactaaatataacccctgcactaagcaaacagtgaataaatccttaagaaattatttttgaagcatattctttctgatttgatttaaaaactgcaatatcacatgtgagtcttgctcaggagaaaggctatttgttcacaagacgaccaagcatgtagagggaaagctgagggtgaagggactgaatccggttctcagctatttcaatacagatgtttttctagataatcggcctcattgtaagttaaagaatcaaacataaatcagatctctcacaggctgagaaaaggcaaaacaacagcctgttcgttctgtaaaaggaccattctagttggcctatctggtacaaccaccttgtttaaaagacagtaaactgaatccagcaaaagtttattgacttggtccagaatattactgagccaccaccacagccaggcttacatcccagagctcctgtttcccatcctgggctgtgtatattcttccacgtcacctccccaggtggctggctttgagaagaagggaatcataaaaagaccagaaataacatatacaccttgaaggagttgacacaggattttttcttgatcactttgcaagccagggacctctggccagtgacaccctgcccaggcctcactcggccatgctacttgctataggagatggcccgcccacttagcccgctcaggccgagtctgacttgcacactagttcccaagttcttgtcctgcgccccagcagaatgaggatacactgacaatcaaagaaaaagtcagggagttttattgagtgatgaaaacagctttcagcagagtggggatgcaggggtggtccccctatctgaaggcaggaaagtccacccaatttgtctgagtctggggcttttataggctcagaataggggaggggcaggcagtaggtagtactcgaaaaagcaacattagattggttcaacggcattattcagaaagaatcaaccaagaaaggtcaggcaaacagaaacgcaagttctcactctgggtcgcaggtttcatccaggaccagcagtctggtctttcagccttcaggctgtttctgttggttcggaggtgggatttcactggggactcacctctatctgactaggtatttggctgcctcctactgtcctcagagtcatctgttcatcagtttgttttccctgtaccttcctttctcacaaacattccattggcagatttctgttttgttctgtgtgtttcctttccttctccccagttcaagctgaggcagacgcatggacaaagaaaaacaaactgctggctaaatacagagcagagagtgtcatggaatgtttacagaggaaatggttttaggaaccagagagtaggaaaagctcaggctggggaaggggcaggaggatgcaagagggaatgactttagggtataaaaggaatggaaacggccaggcacagtggcttgtgcctataatcctagcaccttgggagactggggcaggaggattccttcaggctaggagttcaaggccaacctggccaacacagtgagaccctatctctgttattattaaaaaaaaaaaaaaaaaggaatagaagaactcgagtccttaaagaattagggtctccatgtagagtaccaggtggccaggtgaaaacatacccaaatatcaagtaaggacacccattggccagcacccccaaattttagtccagttattacacccaacttggactggcaatttatcccctacaggtaactgaacatcttatggtctgggaaatctaccagcccctccaaacagaagatgaggagcttaaatggaatagtaggaagggggagctttaccccttgaccatgatgggtctaaataaaatgagctgggaatttccctaggagcccagggtagtgctacaaagaggacacactgcccctgaggtatactgtgttcatttgggagctatctagtcccagttttccaagacagactccagggaaaacaggtctaccttgaacaacatgagtttgaactgtgtgagcccacttacacatggattttctttcaccttcacaacctctgagacagcaacaccaacccctcctcttcctcctcctttacagcctacttaatgtgaagacgataaggatgaaaagtctttacaatgatccatttccacttaatagtaattataattcctctttctgattttctttttttaatcttttcttaattctaccaattaattttttcttttttttaaaattttattattattatactttaagttttagggtacatgtgcacaatgtgcaggtttgttacatatgtatacatgtgccatgttggtgtgctgcacccattaactcatcatttagcattaggtatatctcctaatgctatccctccccccgccccccaccccacaacaggccccggtgtgtgatgttccccttcctgtgtccatgtgttctcattgttcaattcccacctatgagtgagaacatgcagtgtttggtttttttgtccttgccatagtttgctgagaatgatggtttccagtttcatccatgtccctgcaaaggacatgaactgattattttttatggctgcatagtattccatggtgtatatgtgccacgttttcttaatccagtctatccttgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgacatggtatctcattgtggttttgatttgcatttctctgatggccagtgatgatgagcattttttcatgtgttttttggctgcataaatgtcttcttttgagaaatgtctgttcatatcctttgcccactttttgatggggttgtttgtttttttcttgtaaatttgtttgagttcattgcagattctggatattagccctttgtcagatgaatagattgcaaaaattttctcccattttgtaggttgcctgttcactctgatggtagtttcttttgctgtgcagaagctctttagttcttactaatattttcttttctctagcaaactttattgtaagaaaacagtatataatacatacaacatacaaaatgtgttaactgattgtgttatcagtaaggcttctggtaaacagtagtcaaattttgggagagtcaaaagttatatgtagacttttgactgcctgggagtcagcacccctaacccctgtgatgttcaagggtcagttgtattctgttagctcaccaatgtttacctgatcttacacttgtcctaacttctaatatggaaaggataggccaatgatatagtagagtgcttagatttgactgttgaccactggctctcaaagcctctccagtataactgcctctgcctcttcaccccatctcccactgtgcctaaaacccaacactccagccaaagagtaatcatgcgctgttgcctgaacataccccatacttgtctcctactagtctttgctcatgccagtcttcctacctcaaaggctctccctttgctctgtttacctcttgataacttatccatctaccaaccaagaatttttaacatctgaaatgattcacaaatggaatgggatgggctcaaacgataaaaataataatggctaatttggtgtcaggaactgtgctaagcatgtggaatacattattctcataattacctaagagggagctataataatcctcatttcatagatgaggcccaggagggtcaaagaacatttccaaggtcactcagctgggattctgacccaatcagtaggactttagagctgggctgttaacctgtaccctctatgcctctaatggtccttctaacactgtgaccctggcattttataatgtaactgtttctccccagatccctttctgaatgcccccaatgaggtgtaagccctccttactctggaagttatctcactggcctcacccgacatatttacatacttttttcatctcaccaaatacagatggtccctaacttcaatggttcatctcaaatttttttgactttttaatggtttactgggagtattaaatgcattttaactcatgataagtttattgggacacagctccatcatatgtcatagagcatgtatactgggtaagcttcatgaaagcggaaactctggctgatttacccacaatcagactgtctgagctgcagcagatattaaagtatttttcgtgaatgaacatctttcatgcttcacacagtagaagtgctccgtaaatggttgtggtgtgtgttgaattctgttcaaacaattatcaggaacaacagtcacagtttttcacagtagcacactggaaccccctttcttcactgtgagtgctgccctgaccctgacaatcaggtcaactggacagtctgttctcaccagtctcaatataggactgaaaagctatcttctccaaccaagttgtttggatcacctgaggtcaggagttcgagaccagcctgacccccgtcaatatggtaaaaccccgtctctactaaaaataaaaaattagccaggcatggtggtggacgcctgtagtcccagctactcgggaggctgagacaagagaatcgcttgaacccgggaggtggaggttgcactgagctgagattgtgccactgtactccatcctgggcaacagagcaagactctgcctcaaaaaaaaaaattgtgattttttgaaaccattaaattcttcactggtgtcatggtacaaacaaaatcacttgctttgactcttggccaagtccagaattgtgtcattttaaaaaactggtttttaaaaatcctaagttgtttccacctgcaggcataggcagaggagccttcgtccctcactacgctgaccccgagtggttccagtcccatcattccagaaacccctctctggtcttgtatcaaaaacaccacaaatcactgggattgctctgtcatggggtagaaggggctcgaggacaaagtttagcttaaaaccagagtgaatttatttctattacatatggttaaatcatgacttcttttctaatccctaaagctaaacagtagagtcatgctggagacacaccatcatctatgtcaatcagacaaaattaaaacagagaccaacatctccttgtttcatttaattttgttctcttgttactgcatgtgtgacaccaagaaccacttgacctttggacaaaaaagtagttatatataagccatgtatggctaaggtcctgttttcacaggccaggaacatgtaacagctctaattcttgttgactctatttctgaaatagagtctgaatatgtacacttctttctgtctcaaagtctaccccctaggccagaccaccattgcttcttacctggggaacagggcagtatctgctcttaactgacctgccggcccccgctccctattctaatcctttctgtatacagccgccagaagggcttgacacaaatgtaaagcagggaaccctgaccctgtgcttcaatgacttttcaatgcatggagaataaccaagcacattacctggcctgcaaggccctgcataatgtgatgtggcactgtacagatggccatgtccacctcgggccactctccctcacacctcctgcaccctgggctcactggcttcctctcacacctgagcacttgctgctcctttgacctggagctctcttctttcagctccccaggactggctcttgctcatccgttaagtttcagctaagtgtcaccttcagaaagtcctctctacctatgctttctacaaaggtctctgccttccctcacccaccccatgctattttctattacattacgtatttttttcttcctgctcctttttacacaaactgcaatgattgtctttacgtattgacttacttatcttcaattttccctattggaatgtaattccatgagggcacagcccttgtttatcttctttggcattgtaccccctattaacctgcaacacatcacatggatgtaaacagtatctgtgcaatgaataaattaacgaatgccaagttccatcacattccaaggtctgtcattacctgggcccctgccatcctttccagccttatcaaccagcgctctcccacatggacaattacgcaaggcacactgagccacttccttcaggaataggtcactttttcttgcctctgaaattttataccagctgttgcctctcgctaggatgtctttcttcccttcctcactcaagtctaattctgctcaaggatcagtttaattgttacttcctctaggatttcaaaagaatttttgaatgcaccaaggcaaagttaaatgtggcaacaatctgtcagaaaagctgccttttggtgggtgagtcccagaagtacagaaatcatggctaaatcgtacctttatcttcaatacaatacctggcacacaataggtgttcaataagtgttaggcaaatgagtgagtttaactaaattataacttcctgagaactaacaacatctcaatcactacgctcagtatagattgaggctgagggccgccaatgttggcagcagcaaagcctgcttaaatataataactacagctgcattgcacagaagtccagttagtgcagaagcataaagttttgagggtgtgtgaaaggaacaaagacaaagttcaggtgagacatggaagcaacgagaaatgcaacatggggcgagtaagccagcactttctgctttcacttctatcactttggaaacatttagtccagaatgatctgggggttcttacttatggttctaagacagcctccacattcctcagcatgtccagtcacaatcaccatctccccaagaaggcacaaagtaagcatctgtaaatccatagttggctattttggaaaattagtgttaaataagaataaaaaaaaaaaacccttcacctttatgtgtaataaagcactgcttaacaatcaaggtcacccatgtcaataacactccccaagcaaagcttcatatctttttaattcctaggctcataaagaccattgtcacttacatcattacaggattcaagggagaataacataaagagaatgtgcaggataattttcaaaataaaagagaaaaaaatgacacatctacatatcaaaccacacaagtcccgtgtctgataaaatcacaattatagatttggtgcatttaaccagtcatacatgccatgcatttgcgaaggtgccatatgggggagttgtggaaagtcaaataattcctagactttttctttctgagcacatgtgacaatgaatattatttacccctgtagtatagaaattatgaagcttaagaccccattgcttctttttaataaaagctaacacatcacagcttactgcttgacccagctccttggtctttgcacgttctcctctctgggcagctctctctcagttttaccccctaccacaggaaaggagacagctgtgtttctagacttgacagacttgtttttacttgataaacacattgtatattgtaggggagaaaacgatcacccctattcccctccttagttcttatgtgggctctttggcccgatctaggaaccaaattgacacaacacagattaacaaagaaaggcgtacacattttattaattttacacatacatgggaatcttcacaagacagtgaagttcaaagaagtgaccaaagcaacatgcttttacacgttttagacaaaaacaaacaaacaccacgataaatttgtgaagaaatgacaggataaaaagggatctggctagggaaaataatttctatgggagtgaccaggagctatatgaatgtaaaacaagtagaaggtaaggattatttcaggaagtttatttgctcagacacattgcagcacctaatcacagtctccactgataaggaatattctcttacccttgtacggagaaggcagccctcccaaaagaatctttatggcttgctacgtgtagaaaaagactggtcagttagccctctgcaattatactttttccaacgttttcagctcgaaataatcaacataccaattcgcatattctgggatggcatgtccttcactgcttcaggaatatgttttcctttgtgctttacttggatattaagttccaaccaattttaattacatgtcgcttgtgcataatattgccacttctaaaaagcagatcactttctgagttagaaagcttatctgctttccctccttatagacacttctgaagcagaaaggaagtaattcctatgctcctatcagatatgggctcatatttctgtttcaaatttaagtctgtgacccctacatgaggccaggattttgagaagagtgaggaaggtagactctttttaaaccatgccacaggcaaaaactcagaactcattttggggaggaaaaaaagtcctatcaaaccagtatactataaattaaacaatgtagcatcaaagataacttttcctttagttgttacccctgagtggtcacgtagccataagaaaatcacctccttgtcaacacatcatcaatcaaccagtgttcattaaataccaactctgtgctagaacctgcttggtataaagaattctattttgtgttcaatgtgtgcattcagtgctttgattgtaattatctttgaaatgacccaaatcattccaaacaactataagtgactttatattcagaatagcaaaaagctgacttgaacacacaatgtaaaagtcttgaagagagagtgaattaaacttttttttttttttacaacaatcagtgggcttatagaatagaaagagaaagagggggagaggtttttatcttttagaattgcaatgcagtgaatagtgatactagaagaacaatcaccaaaagattacagatgagaacttcagatgaaaataacaatgaaacaaagcaaaattcaattaatggccttagagaaggtgagatcagaaagagaaactgaaagttttttagacttctctttaagacagataaaatttagaatttttaaaaatccataataaaaaccagaacaatgctacctcgccaaagttgagttcaaatttagtcacttcagtcaccaagaatccaggaaacttagttactatgggaacagaggtcctcctcttcagaaaggagggcagtgtttctttcaaattccaccagctaaattcaagatcaatgatggttgtttaatatcctctcttgaagctcttactgtctttagtatactttaaaataaaataaaaactcaacaataatggagctcaattaagcataatttgtgtgcttcaacctttggctgggtgactgctctgtaccgttcacacttgtactgtagagcattgcaatttttaattaagatcactcattctatttcccctgaaccaaccaatgttgaggttattgtttggatacaaaactctccaggatacggcttcacttaacaaggactttgtttctttcaagtaccaggcactcactggttctgagtataggctgcctgccctactttaaaatgcatctcaactttatttcagagacagtaagatttcattgttactctacaggacttagaaataaatgcatgcatgtactcacacacaaaatctctcgataattttgcatataatacagtttttgtgctctatgccaacaaagaacagaatgtttagtaaatcacagagaaacacttttatttcttgagactgagatatgtgtggcttctctacttttctaggaattacatttaaaatgtaagaggacaagacctcattcaaccttttatgcctactttagtgatcagggtgaaacatataagaatattgcaacaccaaagctgtgtgtcactactcagctaatggtacctataaagaaacttctcttaattagctttaccctgaactaacttcctttgctctgccatgtataattaaatatgttagcaagacagaaatgtgagatgtagcagctttcacacccaaatttccgactccaaatttataaaaagtgtggatttttttttagttgaaagcccatcatgaagtattttacttttactctaaaaactttcaaaattacattaaaagaagaaaaagaaaatgggcaggaaaattagtaatgagagatgaattttcagagaaaagaattctacagtagtccctcctgatctgcagtttcccattcagtgctttcagttacccttggttaaccatggtccaaaaatattaaatggaaaatcccagaaataaacaattcataagttttcaactgcaagcagttctgagtagtgtgatgaaatctcattgtctctcactctgtctcttctggagcgggaatctttcctttgtccagcatattctggctgtatatgccactcacctgttagatacttagtagctatctctgttaccagatcaactgttgtggtatggcagtgcttatgtttaagtaactcttctcttacttaacgatagccccacagaagagtagtgatgctgtaaatttggatatgccaaggaaaagtcccaaagtatctcttttaagtgaaaagtcaaaagttcctgatttagtaaagagaagtcatatgctaagggtggcaacacctataggaagaataaatcttctatccatgaaactgggaaaaaaagaaaaattcatgctagttttgctctcacacctcaaaccgcaaaagtttcaaccacagttcatgataagtgcttaattaagatggaaaaggcattaaatctgtgaaaggaagacatgaacagaaatgtgttcgttcctactgatggcaattaggttcggtaccatctgtgatttcaggcacccactgggggtctttgattgtatcccctgtggataagggggtactgttgtatatcaaacaaaatctgaggtgcccagccaaggacagtgctgcttcccagaagagatgagactcccctatcctttctatcttcccaaagggtgcatgtagtgtacgcccattggtctctccctttcaggagtgaatccaaaagccacaatattgatggacggcaggaaacgtccagtatctgggctctgaagaaccttgaggatagaatccagctccaatcatacagttcctctgtatggataccttaaacaaaagtgtattttatcctttttaatttggcatcccttagaaatgtgaaacttccttgtgaaaactgctctttaaggaaacgaaacttttttattgtaagccttcccattgtctgtatataattaagaaaagatcagtgatagttcacggtggttttataataggtgaattaatcagttttaaaaagctgaattttacatgcatttgacaaccaatctgggcactattttcctaggaaaaggctcatttgattaaataaattttaacctttaaaagctttaattcttttttttttttttttttttttgtacacaaaggactcttttgtgatggttggatcaacttacacatccagagcacatgtgcatagataaaactttgcagtaaactatcctgttacagatagcttttcttacacataaaaatacattctgatgagcaatctaggggaaacaaaactaaaaaaaattaaaatacagatatacaattcatattctaatcttatcagaataacctactgttaaaacacaaactgaggcaggataaaattttaaagagtttatttgatcgaacaacaattcatgcattgggcagcttctaactggaagtcattcacgagctccacagagggaacatgatgggtggacttttataggaaggtcacaaaagtaaagcaagtcagtatgtgactggttatagctctataattgccttatttgctctatcccattagaaagtcactaaatatatatacataagtttgttggctacttccaactggacaggcttaagttctgttttcctttaatataggcatttgcaaggaatagcttaagtttcacttaagctttgcaagccaagcaaggtttaggtcacttatgaggtctgatatcatctgtttctttcaggcctagtctccattttaatttactttaacactatccataagaatattaaaaacaggcagcagatatgcagatattttatcaatacaaccttttataaatacaggaaagaatagtgttgacagtctaaatttgcttccttgaggcattatctgtttgaccagatttaatcatttaatttgaaacaaagaaacaaatactactctggggttgctgtgaaaggacattcagagtggacaaaacctctttaaacttttcttcaaggtttcatcttcacatatatgttagtttggttactttgacagattggtcaacttaatccaatacagttttatgggtccggaaagtgctttgcttgactttgaccgtatgtgtcatgtcagttaagttaaaagctaattcaatgtgtccacttcggggttatttccatcataaggcattatgtttttacttgggttgtatgggggagttcctctgaattgactagacagatgggaggtttagacacagtttaatattctgtacttgcagaagcaactattgagagctttgattacaactaaattcaagctagctcaaaagttggttctcagccatttaagtcaaaaggttaggtaatgtcactccctccaggggttcattgtccagtttttctgtgtattcattttgtttttatttcatgcctatctagtacccacccctgtgtcccacctatgcctgaattcttactgtgtaaactcttttggatgggaaatgaccagctcctgctactgaccacagccctccctcttgccagagcctgaaggacaggggactcctagctcgacagatcatgctaaaattataccttgtgcttagcatttcttggcctttaatcctgtcccagttacttctctttttttttttttttgagacagagtctcgcttttgtcgtccaggcaggagtccaatggcttgacctcagctcaccacaacctccacctcctgggttcaagtgattctcctacctcagcctccccagtagctgggatcacaggtgtgcgccaccaagcccagctaattttacatttgtagtagagacggggtttctccatgttggtcaggctggtctcgtactcccgacctcaagtgatctgcccacttcaacctcccaaagtgccaggattacaggcgtgagccaccatgcccagccattccttctcttttctaagatttgagttctcattgttaatctggtaattttctttttcacaccagataagcagagctggtttctgcattgctaactgggagcttcctaactaaaagagcctcacaaacagttaattctgctctagatgctgtaaaagagggggacgggggtaggggcagggagagagagagattacagtgataaaatgaaaatgctgtttcagccaggaagttttttctcccccatctcatatattaaaatgggcctgattttctaacttcagcataaaagcccagtaagaaatattagctcttcagttaatgtcattcacacaaggaatttatcagcagagtttgtgtttgaacttttcatgtcatctcacgcatctcagagggtattaaactccataaaacacaatcccaaaagtgaaatatttcccacttttactctataagtgagtcttagggaacggaaaaaaaaattccatgtctggcttattcctaaagagagagtaaatagagatatttcttgggccaaataatgagaagaatcacaacccttagggtttatgttccaaaggcctccaaatcccaacaggtccagcaaagcagaacagagaaaggggctgaatatacatgaagagaataacagaagcaagtggttaatggtttccttaaatgcggcagaaaatggcttatgtgtacctaagtatcctatagtactgagacttaccaagaagaaaaggtgaaaatggaacttgaggcccctggaagacatgttcttagctttgcctgctggctttctgcataaatctgacctttctgcaggtgaagttcttctttacagcccagtttctcctcttagttggctactgacccacagtagcagccaaaattaaaccaatgatgtatttctcgtacttccccaaatcacttttctttaaataagttaataataatccaaacttgcatttttcagctgagtgctttgatacttgcttctcaaaaaactacttggaaggtaaaggagttttcttttcgagacctcgatcagaaatactccatgattcacgcactcagttaggcctaaattagcccaatgttatggctataaaggaaacaggaaacctgtgttccagggacaatcttcttcatcactctattcccagcgtcctctcatatgaggacacggggggttgggctacctccatagaatgataataaaagtttgcctccaaaataatttggaatttttgggttaagcatcaggacatttcatatcatgtaatatactaacattcagtataaatctctaagcagggtaagtgggctcagaataagtcacaatctctcaactcatttcaccatcttgaaaatttcttccatggagcacaaagatgaactaagtaatcaccacattcctcgcaacatttatactttctgatcaggacaaaatgattctaaggagtgattaaagcagggtaagagagtcttctcaccctaatgaatccaaagatcaccaaatagacacccagtttatggcttagtgatgtaaaacaggtgtgattcagagccaagtttacgtaagttcaaattctgtttccatctttggtagctgtgcattcttggataagttacatcacctccgagcctcagtttcttaatctgtaaaacagacatactaacatgacttcatagaggtgtttgaaatagattatctaaaataagcaccaagtgttacatataatggttatttcagttattcattgatttaattcaattaccattaaggttgagacctggtcatcattacccagttaaggaaggggtttgacataaaaaccactcaagatttcttcccactttaggactttatgattgcctttaatttttcatgtttcaattatgtaactaaaatcttctattccatatatatcagaacacaccccatctaatctctgctaagtgtttctctactctgcctgtcccatgaaacaattcccaaagcctaggagagtctcctgtgatacagataccaaaatgacgtgggtcagaagtaactcatacatccatattgtcagaggtgaactatacaaaatactgagtacactacagagtgatctgataggccaagaagaaaaaaaagtaatctgatagaccgagaagaaaaaaaaagtatatgttgtttctctactaaagaatgtcaccgcatattgatttttctagtcttttacaaagactgtgttcagaatttagatcagtgttagagaaattcacttataaattcacatatacccgtatataaggatacagtcctgtatctaaggataaagtcctagcttaaatctggaatgagtaaaaacaaagtgtaaagttaaaaatgcccctctggtaagacaaacatatgcttttcacccaaaggtgcagttaaagaataacaacaaaagttggtagtgagatccctctaaaaccactgatatataatagactcctactgacaccctagaaaaatgatgccaacccatgcagattagtttcttccagcaatgtaattacccatttctttggggctatctttccttcaatggtgatttgagaaatacctttcatttatactccattttgcacaaataaactacatttaaagctctataattagctgtcctttgctactgtaaaattcagtgtttttgtccaaaaggaacagactattgatttacaaagaagctgaaatgctgtcaaactacccactgaagaagtaagaaaaaagtggtccctatcttggctctgcctctagactagctcttgtcctacctcagctttgtatccacataccgagccttctgttaaggtttagacttgcacagccaaggcctcccaggcatctccccattgacatctaagagacacctcaaattaaacatccaactctttgcctgaaacaccgttccttaagggctttccagattagcccttttttgcctctattatttgtatctcttaaatgcttactattgcaagatgtagaaaatcccaactaaaacgggcataaaccataagagaaattattgtctcacacactaagataagtggctcagtgaagctaagtatgggattatttctctttgctcatgaaagcatcaatgtgtcagttgggttcaagtacaagaatcagaacccattctagatattttaagcaggggagatttaatacagcaaagttggtgctggagaaataacttggagggctgaaagtacaactctaggtagagccttcagtaaggactcccagaacaatatcccattgacctcatggaacttgtaaggagccactcctcctgaagctgtcttggagccatagtaaaatcaagaacttgtcaccattacaactgactctactaatgcaagaaaccatagaatgcttatctgtagctgtggtcccgagtttcagaagcctgatcatagcgctgccactgctgcttctgccatcccaaccatttcgtaaaactcagaaagctggagagtgggcagaaaaacacgactgcagggaacctggacattgccacagctacgtttaccagcagaaacagccaaaggagggctgaaatatggcctccacatggctttcaccttccacacatcacatatacacatctaattggagaagactttttttgaagctggctaaaagagaatctgagaaatgatgcttttagttttgcaacaactttaacttgaatgaggatagaatggaaactacataaattcatctagagcatacgaaaataccagcttcctgggtgagtctttacataggagcatgatggaagcaagcagcaatcaaggctgccacagcctttgatatgttctaacagtagagaagaaaaaaatctctttcctggctatggcatagaaggccttcctttactccttatggaaccactttaagccatttgctgactcacagtcgaataccactgaccatggaatgctatgggctgattggctcagatggacaatctgttgagtgtcaaccacagtgtagtctatagtgtgcctgcttacataacatctaatcattgagggctttcctgaccatccaatctcaagtagcctcttctcctgacccatgaattctgtgtctgcttaccaataggtaagtcttcatggcacttaatgcactctgaaattatcttgccaatttacttatttgcctgctccttatctcctttccctactaagacgcaagctctgtgaaggtaaggatcctgtctttttcacgtctgtatccccaacacttacagcagcatgaaacacataccaagcattcaataaattgtttaatgcataaatgaataggctataatccatgtactacagaaaccttaccaataaaatgcttatgttcttcccagttaggccagcttagcagtttatttaaaaggggatgagaaagagagagctgttcaacgtgtgtgtggccatacacagtgaatctactaactggttagtcttttgggattcagtgttacatctactatgcgccagtcactgtaccctactattagcgatgcataaatcagaaatcttggcccaaaggaggactactggtacatgaagattaagattctacgatgacagctgcattggaaaacagtatcatgaaaagtgttttggagacgggtgcacaacaatgtgaatgtacttaacacttctcaactgtacacttaaacatgatcaatgataaattttatcattgggccgggcgcggtggctcacacctgttatcccagcactttgggaggccgaggcgagcggatcacgaggtgaggagatcgagaccatcctggttaacatggtgaaaccccgtctctactaaaaatacaaaaaaattagctgggcgtggtggcgggcgcctgtagtcccagctactggggtggctgaggcaggagaatggcgtgaacccgggaggcggagcttgcagtgagccgacatcgcgccacagcactccagcctgggcaatagaacaagaccccgtctccaaaaaaaaaaaaaaaaaaaaaaaaaaaaaaaaaaatatatatatatatatatatatatatatatatatataatgttatatgtatcttaccacaattaagaaacaaaaataaaaataaaaaatacattataaaacaagcacaaccttttatgtaaattacttacttaatcctcataatcagacaaggtaaacagtatgaatattcctattttaaaaattctgacccagtaaggttaattagcttgatcaagtttatatagctacttaggagcagggctgcgactagaatttaaaaatctccaactcctaagatcatgagcacacagatacacaaataagcaatagcatcatgttttcaaacagtctggtctcttccctggctctgtctgaatgacagactctcccattgtttcttgtaaacaggcaattaattgtacacactaatacacagaaatggcccttaaaataaggaagaacaagagaaatccttttttttttttttttttttttttgagacaaggtctcagtctgtttcccaggcctgagtgaaggtgcaatctcagctcactgcactcttcacctcctggactcaagtcatcctcccgcctcagcctcctgagcagctgggactacaggttcatgccaccaagtccagctaatttttgtattttttctaaagatgaggtgtcaccgtctttgccaggctggtctcaaattcttgggctcaagcaatgcacctgtctcagcctcatgggaaatcttgcactgatgggctaaacttattcaaaaagaaaaatcttccttaaaattaaaaatgaagagtaatagcaattgttggaagtgtactgattcaagggtatccaggtcaactgacagaagagagaggccagaaaggaatcatagtatactgaaaagccgctgtctgataaaagttggcaaggcagattctaggaagaaagagctcttcaacaaacaatggctaactatttaaggaaaatatgttacattgttttctcatctcatgtcaaatattaaaattaatcacatgcttattaataaaataagagcagaaaattgagccatattatacacagaagaaacttttatctggattaaaatagattttaagtataaagatcttaaaacaaaatgacaaaggaaaaaatgaaacataacgccccagaaaattaaaactttcagctccccaaagccattatcaataaaatgaagtgaaagaatagggagaatatgtattgaaaaaagtattaaagacgaagagctaacatcttcagacagagtgctattcaaatcaatatggtacaaatcctttattagaaaactaaatttaaagcatgagtagttcacagaataagaaatatatgtggttaactaccatatgataaaatactcaacttcactatattcaattaactacgattttaaataataaaacggtaattttgttggaaaaataggcagagtattttcatttatattcaagtcttcagaggccacaggtatatgtcactataagggaaaattggcctacatatcaaaatatttattcatagcgttctggcaacttatgccaatgtaatgatcagagacccacacaaagattagttgtaaaacatttgtcacagttttatgtataaccataacaaaactgtaaaaaactaaatgagagaacaaattctgatacacaaaggtgaatacttgaaagacattaagaaatcaggttttcaatacttcataaaatgaaaaagtattgacatagtaaagtataaaaaagtagaacacaaaatgtacaaacacgaataggtattatgtgcatgtataatacatatatattataaatctacaaagacctatccatatatgcatatatgcatttagataggaattttttaaagcactggaaggaaatttactcaaatgttaatgatggttatagatgagaagttgaattaatgttaactcttctctttatttctctccatttttcaaatattctttaataaattggaagtgtattagaaaacatccaatgatgtcatgaacactcattccctagacatattaaatctgttagcgttaactatagactagtgtactatgctaaggtgttatgacaaagaaaaagaagcagtagacagatacaaagacattcctgacattaggagaacttctggagaaagagacacatgttggtacaaaggctgtaatgtaagtaaagtagaaatataaacaaaaaaagcatgagaattatattgtagttgaaagccagaaaggcttcctggaaaaggtggtgtgtaacttttatatgaaaaagctggagccccatctcatggaacagtggcacaaagtattctcgatagcgggcatcaccatttgaactcgatcctcagccttcaataaaaatcataaagcccatcttcagagcccctcttttcttgcttctccataaattatgtactttcctcttttctcacctccttgagatactgtttacctaggaatgagacaattcattttttacagcccatcatgaacaattctgaaaaagaatcccctcattcattacaagacagtatgaattaaagctcaagaatgaactcttcctggcatttctaattaaatatgtagtctacctatcctctaatggtgaaataaaaagtagccccaatattaaagcaattccaaggatcaagcaagcaggtaaggcagattggccaagaaggaagagcaaggcactgagaaatcacaccatgacgcaaatgactttctctgttgatatgaaaattttttcctgccataggtgatgttgatattctaacaattttaaaacacaaaaaaattaaggggagtaacaaaatttcccttctattttttgagttatttaccgctaacaatctcccctctagaaaaagttacggaaatattgtacaaaatgcaccatgggttaaaaaaatgatttaaatacaggaaataattgttattaaatacatcttctagggagatccactctgtcccaatccttaaattagaaagtcagcaaaaagatgaactgaatccctgatgttaattgtacaggcttactggattagaactagagataattaattgctaaattttaatatgcattggactaaatggctgataagatttccagtagttggcttgaattccagaagggaatgattatttcttccccggcctgggagccctacaagccgaagacatttaaaatgtctgtatttggaatgaaagaagttgggtaaatagtagaataggttacagaatggcaaaaacttctagaaagaaaatatggaagttcaaattgccttttcccatttgaaatttagaatataatactgtatagaaaagaggatttaaatttttttatttttattacagcttcagtgattagcattcctgtactataatgtcaatattaaatccagacagacccaaagtctattacttcctatctaaaaaaaaaaaaaaaaaaaaaaaaagacactgtttatcacctaggtaattatattttttatgttcttaagaatttaggagcttgctatggttaattgggaaaaatgtgaattatggttaagtcgtgcctttttttattaaacttgtaacaaagcaaatgatgaagaaccaacaacttgccaatgctgagggtccagatgaacagacgcgcagagaatgcagatgagctgattccattaaaaagttggctgcaagggtagatgatgaaggttaagaagatgtaggactatagaggccaccagtgaaaaggaaaaaaaaatcccctgcttcctctgtacaaccttcaggatgttcaaggaggaagaaagaccaccaactgcagggtcagtacccagatgccttaggatatccatgaggctgtcaggcaccagtgaaaatcaggtctggttgtgcatcagaatcacctgtggagtttgttaaaagatgggattctgacctccattcttgcaaaatgctgatgatccaagcggtgagtttgagaccaaggatattatttatcttttaacaaacctcacagtaatcgtgaatgtacagcaaggtgttataatgtattttgatatcttattttttagagacagggtcttgttctgttgcccaggctggagtgcagtagtgcaataatgtctcaccgtagcctccagtttctgggttcaagcgatcctcctgcttcagcctcctgagtagctaagaccagaggtgcacaccaccatatccagctcatttttaattttttttttttttttgtagagacagggtcttttccaggatggtcttgaactcctggcctcaaggaatcctcctgcctaagcctcccaaagcgctgggattatacgtgtgagccactgcacccggccctgttttaattttttaaatttaacttttaaaattcaaatataggtagcgttttggtaatctcttattttaatctgaatgatggaatatgtcaaggggtgactgacagtagggaggcataatactgtcaggagcttcctacagtgctttcttcaattactttagaatctttggtctccccagaggtaaagtgactcgcccaaggtcacacagtgaattaacaaaaataagaaacgaatgctaatattagaaagtacatacctcctataattacttgcttgggcaataaactagaagttagtaaatattaagaacttcagggtccgggcctgtaatcccagcatgttgggaggctgaggtgggggcggcgggggggggggggtggtgaatcacctgaagtcaggagtttgagaccagcctgggcaacacggcaaaactccatctctactgataatacaaaaaaaaaatagctgggcgtggtggcgggcacctgtaatcccagctactagggaggctgaggcagaagaatcacttaaacgtgggaggcggaggttgcagtgagctgagatgctgccactgcactccagcctgggcaacagaggaaggctccatctcaaaaacaaaaacaaaaaaaacntcagggtcattaccctatttcttcaatttttaatttattttttatttttgagacagagtctcactctgtcatccaggctggagtgcaatggcacaatctcagctcactgcaatctctccctcccaggttcaagtgattctcctgcctcagcctctcaagtagctgggactacaggtacctgccaccatgcccagctaattttttattttttgtagagacagggtttcaccatgttggccaggctggtctcgaactcctgacctcaagcaatctgcctgccttggcctcccaaagtgctgggattacaggcataagccatcatgcccagcctatatttctttaattttaagatgcctattttatgtttttaacataaataaatgaagatgcatcttgtaattgatatgtttaatatggaagcactcattttttccaaaatatgaaatcagtggtgtacttacaactaacagcattataaaatccaggatatatgggaggggtattgcatatttattgtttctttgaaacaaggttttctatgaattaattttgtccctgtatgggtactgtcatcgtgtcgggtaaggaaatcaagactcacctgtgctagaaacctggaaataaactgttggcatatacttgcctcctatggtcagcatctaaccactcattgagtactggtgactcaatttctacctcttcaggcttttttcccttcccagttttaaaacttcaaccgtccctccagtgtagcactaatcaaatctaccacagagctgtcacatttatcctcattaaacacatacttgattccatgacttcctttttataaaactctactggctccccagtgctttcagaatcaagcccaaataccatcaaatggcatttagggtcctgtgaaatctgtccttaccctgcctttctggtatcacagtcatcagctgcttcttccctgcttaaaaaatcagcctaatcaacattcctgaagcttacggcactgttaccacatttctaatagtttaaactttcaaggcccagcttgaacatcacaccttccaccaaccttttccagtcctctcattaaaatcaatttctcccatctcagcattcccacaatatacagcacaatgagcatgtagtcttgcctgatgtatgcctgtctgtccacccaactggacagtaaactctctggcagcagaaactgggccttaatcatttcagtttcctccacagagatcagcacagtgcctgcacgtagtagttatttgctaagcatgaaatctttaacaaagccagaattgattctgaggcagggttaaagatattataaataaaacttcactgaactgaaattcatagtcccatgcagggcacctgcatatttttattaggtttcaccatggaaggcataattttaggtattattatgctgatgaagcacaatcttcctgctccaacttggccaaacccagggaagcaatttcctatttgattaagagtacgacagcagcgaggactggagtataaaaatttactgtagggttgagaatgtaagcttaattgtggatcaaatgggaaacattctaaacagcattttttaaaggaagtatttgaacagcctattttaaaatattcaatatcatcttcagcaataggcaagttttggaaactagcaagtttcaagacaggtactcactcattctctcttctgcaggatcctaaagatggtcctggggactatcagttacttaaatgtctcaggttattaattcttactttaattatatctcagctaagtgattttttttttccaccatttgctcacatagcagcgaacaactttacactgttatcagtcttcacatagcagttcccaaattttgcctttaggtttatatcatgtgcaatgagttttaaaaggctttctccacaaaatcataagagagccttaagagtttcattctctgcctgacctcctgaaaccctcaaaagataattaaagaatcatgaaatcttcttgtgatttcatttaaaaaactttttttaaatcattgatcatgtcttcattctactaaaccatttaagaagtgggcaatttaaactacccctataatggttcactagcctcagcaatcaaggctgtaagaagacagaagcctatgtccaacattattattagtagtaattatctgttacatattaatgctactaaagtaaaatgtgatctatatataatcgataatatgactataataatgtatataacaatccaatatagtttccccctttatctgctgtttcacttttcatggtttcagttacctgcagtcaactgcagtttgaaaatacatgtgtacaggccgggcacagtggctcatccctgtaatcccaacactttgggaggcagaggtgggtggatcatttgaggtcaggaatttgagaccagcttggccaacatggtgagatcccatctctaccaaacataaaaattagccaggcgtggtggtgcgtgccagtaatcccagctgcttaggaggctgaggcaggaaaatcccttgaaccaaggaggcggaggtggcagtgagctgagatcatgccattgcactccagcctgtgagacaaagcaagactctgtctcaaaaaacaaacaaacaaacaaaacaaacacacacacacacacacacacacacacacacacacattagccctgtgcctaatgtcacagtgccatcccttggtcccactccaacaactatgtatgaaataaacctgtgatcctatcagtcatatcccttctccaagcctccctttctgaaactctatgcctctaattctatgagacatttcacaatgttgtatctacagtcaactaagaaataatatatttgggtttatttcactctttgctcaaaccaaggataatttatcaggcctgctaagtataatctgctttcctaagtattgtgagaaatatgaaacagactacacttgcaaatcttaaattgtgatagaagaaatgagagaatgcacaaaagttttcttttcttcagaagagaaattgcaactaaaaaaaaacgcctagagataataaaagagacgttagaaagcaacacacaactgtcaactcaaatgtactgctaattactctagaaagaagtgttcagcattctaataaaaacattatattagtataatgtttgtcattaacaaagagttgcttacaaccacatcaacagataagatcctatgatacgtgttgtctggggcaaagcagggaattgtgggaaatgtaaaacaaatttgtgttgaatcccggccctcagggaacatttgagttcatgaaataaaactaggaatcagaaagactgggcaagatttgttttgctaggaattcaggatacatgaatccatgaggaaacatgaacgtcttggaactcgaacaggaggtggtggtaaaaatctaggagttaggtaaacagtgtctagccacaagaacagaggaggggtttaaacctctaagagatcattttatgggaaaaagcagcccctcctgaaaacattcaattcaggacacgaaggacagatagacactcagagcctcagagaaaaaagtatctggtgaaatctcttctagaaactttggctggggagagtttggaatgttgacttaaagacccacagtgaagtctagaaaaagatagaggcagcttgttacaatttacaccaacaggaaaccatttagaagggaagaataaatgttagttaaactttaaagattaaattacaaatttactcaagtgattttaacttttactgcacaagtagcaattttaagtcataagggatctgaaatgtttccagagttttaaaatggactgttttacacaagtgaaaaaaagattttggcttctagtgctgagcacagagcaatcctatgccttgtaatgggctggtataattgtgcagtttcattaaaataattttattactgacttcctagttttctgttaattatcatttcagagtaagaaaaactattacttttaaagcctatattaaagtaggcttaagcaagcacggaaaagaaagccagtgagagaaaatataaaaagaagctattaatattaacagttacagttggacacttgttcatttcataaatctttgcagtattagcaagattgatgagaagtagtacaaatgagaagcacatgagataagcgatcatttgttatcattactgaaatataaagtatgattcagtgtttcataatggatgttaaacttgatttaacatatggttggctcatttgctgaaaactatccttaaagacataaactcattctaaagtcaaagacattgtcttaataacagtctctgaattatctttctataagagactgagtaacctcaataaatacaaacttagggagaagttgtgaaaaggctgttccttaaggagaaaaaaagcaaatgtgttatatactctgattcattaaacatattatagagaattctaaaatatcgttgaaagagtaaagaattaatgtgttttaataccaacacagagtcttttgaattgattttcaaatgatgagtagagaaacccaatcactgctgtcagtgcttcagcagctacctaagaaatcctcctttgtcaacttcatttctctaatcatgagagaacgccagtgcccactttaagtttagtggattaagcagaccactgcaagtgctgctaaaataatttataatctatcattatacttcagtagtgatagtatactactgaatgagaatacactggattctcattcaacctggaatgagacacttaaaaatatttgttacatgagtatattcctatccacgacttagttttgtctgaattctcacttccattaacagaaatgcactaaaaatatatatatatatatatatatatatatatatatatatatatagagagagagagagagagagagagagagagagagagagagagagagacagagagagagagagatacaaagtctcactctgttgcccagactggagtgcagtggcatgatcatggctcattgtagctttgaactcctgggttcaagtgatcctcctgcctcaccctcctaaagcactgggattacaggcatgaaccactgcacctggcctacattttttttaaaacaacaatttatgtacctcctagagacaccagaccagtttgaagactagccgtcttcaacagtccctgtagcaattatgctcagaaaggcttatttcttgagctagcaagtatctgccctaaaaccaggttcattaataaaatgtctatctttcaaaaaaaaatacttgaatcttctgttttccctgatgtttgtgtctttcttcatccttggatacctattcttataacacagcccatgctcatctgaaataagtgacttcaagtcagctccattatcctgcatcctgcctgcaaaaatgatctagatatggggagtagtgcttccccttgttctatacactatatcaatataagttgttagactgcatcttctttaatcaaagtgtcatctaattcacatttagccatcagaagcatgtctaccaaagagcaatgcagccaaataagctttatgcacccatccttaggttatactccttagctaatgttactcttatttggcattgatttgatttattgacaacaaaaatacccatgtttgacaccaactagccttgatgtgccactattactgactctctcgactttgctcccccaatttgtaaaatgagaagtccaagctttcagtgattcatgaaagcagagtccactgtcagcctggccacacaactagcccctgaggatcttgctaggggtcaaaacccacatattagatctgatggggccctccaaattctctattttagtaagttcccaaatgcttctcacgcatgtctcttacagaatagatatagctgaaacaatctacaatattatatactgaactcattcaaccattagctcaaaggaaatgcatgctaaaccagctgcacaatccactctgtggagaaatccagcagccactccaagaagctgacctccaaaggtcatggagcaagatggagatgaagagccagccagggtctagagttcccactttgctctcttaccagctgtacaactttggacaagtctgttaacctctcagagattaggatatcttttctgtaaaatggtggtaataaagcctaccttagagggaaattgtgcaaattaatttttaaaatacacatgtaggccaggcgtagtggcttacgcctgtaattccagcactttgggaggctgaggcggtcggatcgcctgaggtcaggagtttgagaccagcctggccaacatggtgaaaccccatctctactaaaaatacagaaataagccaggtgtggtggtgcatgcctgtaatcccagctactcagcaggctgaggcaggagcatcacttgaacccgggaggcggaggttgcagtgagccaagatcatgccattgcgacagaacaagacactgtctcaaaaaaaaaaaaaagtgtatatatacatatgtgtgtatgtgtttgtgtatatatatgtgtgtgcgtgtgtacatatatatatgtacacacacacgtatgtatatgtaatgtacttacaaaatgggaggagtagagacactcgggaggactgcatttggctttattcattgttccttctggtatagcagctaacacacagtgagtacactaaaaaaacaatgctttgaagaaacaatctaatccaactacccatgacacgtgttattcattcagaacagtttattgagaggcctctttgtgtgaaacactgtgacagtccatttgctccttcaaatctcttcctccccttctttctctgttctgtgctgcagaaggctgatctatgtggactacactgacaggccccttggtgttctggcttctcctgcaagttggccagtgagggcttcataaggataccaaatgagaggaaaaacaagaacttggtctgatctagcagaaagatcagaccaaggccccaatcacagagatctcctgtttctcccaaagtactctgttttcccaaacatctctcctactgtgttgcagtaccactccctcaccttatccctttgggcttgagtctttaaaactccactgcttaccatccccaggttcctgtactaaccttgtggttcctctaaaccccaccagtgcctctctatatcgtccctttataaagaagttctctggagcgcagcctcagttgagtgtaccctctcttccagttggaagtctgatataaacaatgtgtttgaagttagggaatacagtaacaaacaaacaagtcatgatctctcatggaattctaactactaccactgtcataacaaacagctaccgtttattggacacatatcccatacaagctctatagaagttgtatacctgaggttgctatcatcatctctgtttttcaaatcaaaaaaccaaaccttggaaatataaaacccacatgagtatcaaccaacagaatttgattcacaacagaactcagattcaagccagagtcaacccaatccacagcacacgctcataaatgctgaagtattaccacatttacctcaacaatgtccctgccaaatggatcttcaatgtgagtcataagaaattttccccaatccttctccccatgccagatctggggattttcagaaagcctagtgtgaaaattcaggagacctgaaatgtgccctcttatcatatctactcaccaactggcttgtgagtttcctcctctttgagctaatacctgcagggaggtgcgcgcttccgtaactagtggcctttgttctaaccaccatctctgccatttttcctgtgaaatttcaagataaatgcaggcaagcaagggagagagcccttggacactcttctctagtattctaggacttttcaggcctgcctggtgagatcaggtaccttatcactagcttctacttgtgcaatctcccaattacacaagcgatcccatctagatttacaagtggccatcctctctgacccacaggccagagaactcagcccacgcaatgtttttaaaatagaccccaacccaggggaggctgacaggcacacagctgcaccaactttattaatgagtacccagacctttagataattgatttccactttgatcccagcctacgcatttctatctctgatatctaaatagcaaatcatgttatcttacaattaagtgataatcttcatggcagaaaagttgacaggtctataaatggcttctgcaagtgattaaaataacttcctccccctttccacccagccctggaaatgttctacaacttcacaaggctattacttgttaataaactccccatgatatgaacctcattcatattcaacaagtttacatactaagttactctccagaaatgatatacatcttattttttatgcttaaataagaacattttatttattttttatatctatttttttggagaaagggtctcactctgtcaccctggctggagtgcagtagcatgatctaggcccactgtagcctccaccttccaggctcaaggatcctcccacctcagcctcctgagtagctagcactattggcgtgctcctccatgtcagctaatatatatatttgtatatatccatggcagccaatatgtatacatttgtagagatgaggccttactatgttgcccagtctggtctcaaactcctgggctcaagtgatcctccagctttggcctctccaagtgctgggattacagtcatgagccatctcatgcagcctgcaagtacattttattagccttagtaagttacacaaagtcagcaaaacctttgactttaatattcaagtaatattaagattgttaaattttgcatgtatatgcatggatatgaagtatatacaagtgcagagtaacttgaagatcagtgttgaaacaacattgagtatttaatatgaaatgagaataaatgactaaaagaagataagttttacttcaataagtgaattgaatattgaaccctgatatggtttggctgtgttcccactgaaatctcatcttgaattgtagttcccataatccccacatgtggtgggaaagacttagtgggaggtaactgaatcatggtggctgttccctcatgctattcttgtgatagtaagttctcacaagacctcatgttttaagggacttgacctttcacttggctctcattcttctccttcctgccatcacgtgaagaaggacatgtttgctttcccttctaccatgactataagtttcctgaggcctctccagccatgctgaactgtgagtcaattaaaactctttcctttataaattgtccagtctcggatatgtctattagcagcatgaaaatggactaatacaaacccttactatgcactgaattctggggcaagtacccaagatattacagcaaacaatacccaccaatctgcttctatggcagaactgggccacatgcccagaaggcaagtaagaattactctgcaaccaactgatcaccatagtaactgagcatcaggtagaaagagtgctgggattgattagcagagtctgtgatttggattggacatagaaatgatatagtccattccatgtatgctcaatgaacactgcacaggtgaacagataaggctgtgacctcctctgaggcaagctccctggttattccatctccatatacctcaagactcctaacacagttctttgcacataatagacattcattttgcaggacagataccaagatgaattgcttcagtttgtttttaacaacgtaattctatttccaatttagataattcattgatttcacacctttccttcctggttactctatacttaattttcccttttcttctttccttttttgtttgtttttttttttttttttgaaacagagtcttgctccattgcccagactggagtgcagtggcgcaatcttggctcactgcaacctccgcctcccgggttcaaacaattcttctgcctcagcctcccaagtagctgggactacaggtgagtgccaccacatccagctaatttttgtctttttagtagaggtggggtttcaccatgttggcagggatggtctttatctcctgaactcatgatccgacctctcaaagtgctgggattacaggcatgagccactgtgcctggcctcttctttctctttctaaaagcacatcaatttacatttctacatctgcttcctacaaagaatttcctctgaatgaattcaacaagtgtcctgtacatgtaaatatatgtatgaatcttttgtacctatccatgtcaaagggtttttgaagccaaactgaaaactttcctagactacatgttgatgttctgaatatccacatttcgaggctcttaacaaagctgtatcaaactccttttcttctgagtaatatattatgtacgtaaagtcctaggagatgccctaagtctactataagtgaatttactttttgttttctgctttgcttcattcatcctgctttgctttttttctcatcccaaatataaacatctgttttgttatcaagttaaagttaaggagatataaaaccctctcagattaatgtacagcccattattgaattctggatcttagtgatatccaatatattatcatgaattttatagaatatactgaacttttaattcttatctgatttatcttcttaatgatgcttagatttccattcaaaaatcctgtctcttctcaccctttccacactgtgtctgtttttgtgcccttttctagagttttacatttctctttaggattatctctctctttctctcgctcacctacatacacacaccacacactccatgtccaaattcacagtctaagcattttggtgatatgccattcctcttctacctttgttagaagttcctctttcccatggaatcaattctaccggaaaaaagtgaaaaggaaccttagagagcaatcattaaaggtgcaaagggaaaggtccccatgtctgggagtgtctctaaccagctgtgtgatacgtgccatgtaatatctggctttggttttctcatctctaaaactggagggtaaaacaagactatgtcttgaaacctttctaattctgaaatgttcactattatcagttaacatttattgtgcttttctgcatggcaggcctcaggctaacggctggctataactagcactatccatgctcacaacaactccataaggaaggtgccacggttatcctcattatgtcactgagaaaactgaggttctgagaggtaaagtcatttcacacctgatgggatatggatgtaagactggaactcagacggcatgactctcaggttacagattctgcatcacatgctcatatcaactgatctgtatttttatacaacttcaaaaatgaaaacactgggcatgtgacctataaataatgaaatcatatacaaaaataaagaaacaccccacattgttgaaaaattatttcctttccaaaaattacttgaaagggcatcagtaagccctggcatatttgttcaaaatacagtcttactgaataggggtgtgtgtgtgtgtgtgtgtttgtgtgtgtgtgtgtgtggtgtgtatatacacacatatatatgtgtgtatgtgtgtataggtgtgtacatacatacacatacatgtgtatacatgtatatagacacgtatacatgtatatacacacatacacatatatacacatatatgtatacatacatatatgtttatatatatacatatgtgacaataaaccagtagaaaggtatatatatacacatatatacacatatatacatatgtgtatatatacacatatatacatatgtgtatatatacacatatatacatacatacacatgtatgtatgtatacacatatatacacatatatacacacaaacccacagtcatcccttggattggtttcaagacccctgcatatacaaaaattagcagttgctcaattccctgatatgaatggtatagtatttgcatataaccttcccacctcctcccattaactttaaatcatctctagattacttataatacctaacacaatgtaatgctatatagttattctaacatattgtttttatttgcattatttttattgttgtattactttttatggtttttttcccaaatattcttgatccacagtggatgaaattcacacacgcagagcccatggatacagaggtccaactccatttttaaccaatactcatattcgcacagattcatataatctcacactttcaagtaacgtaagcactatatgatcccattatattatcagcttgtcaagaaaactgcctatgctctgtgtcctttataaaacaatgttcctacctaataagggcagctacagcctttccccccagttctccctgctataaggtggcacccacagatatgtctccttctcttttgcctaagaaggcccttttgatttctctttcaatcctgtccccaagcctgaactcatcagtatcccctactgctgccagtctaggagagactccaatcatcttcccctactgctgagacagcagccttctacctggtagcctctgccctcctcagtccattctccacactgcttgctttcctatctcttctcaaagccaatcacataggtcccttcctcacttaaaacccctttatgactcctcattgcatcagaaataaaatctgaactcccttccactgtttcagaggcccactctcaagctctccacatctataaagtgccaactagtctttgccagttgtcaaacagactgagcttagctttctctcaacccagaacctttacataccctggctccttgatttggagtgctctctctccatctgccttctacagtcggaccttcacatctttcaggctgagacagaaccctcctccagagagctttccatgtcccccttatttagtctgacccaagcccattattctctcttcactcttcatttgtttccttcataataattctgattgatcattgtgttatccatctccacgtgtgtgtgtgaactatattctctcactatcacacaagcctccggaggatggaaagcagctggccttgctgatagatacatcccatgcatttaactcagagcttggctcaggttagatggtcactagttatgtatttgttaaacgaatgaacatatgacctcagatctttttgccttaagagaaagaaaagtaaaccatttgaaaaggggggaaaaattataaggctagcaaaagttaatggtattggcaaacattactacaggcccttgatagatgttaaaagaatggagaaagccctttaacatatttaatatatcatccctagttggaagatacttttagaattgtgcctatgcccaaaagttaataaatgggtgaggatattctgtgtgactaagaggggctaatgaattgataagtatttctgtgagatttactggatggttgaaaaatctctgtacattttcccctgattgtctctacctttctgctggcttattgtcatgctgatttttatggatctacattcaacagctaaggtaaataaggtaaaatgccagagaataatccaccataatatagtagaaaacttttttaaaatcaaaattcctgttgctaaacccaccatctaacaccttttatcacatttgagtgatctttaaaagaacatcacacttaaattcgcttttgagttagattactgaagacaaatgacatactgaaatagcatctaaaagcgttaatatacaaacatctacccaatacagatttaaatatagcagtgactgtacacctaccgaaacatgaaagactaccaggagacagggatttaatgtggattgatactaaaaagctaatggaaatccggtggtctttatgattgagatggaacatctttcacggctcttaaaaccttaggctggacagtgaagacatgggctggtgctgatgaaggagggctataccccaagcctgggaatctggaaatctgatgtgttcggccagagaaactccaaagttctccgtgtttctgcctttctctacccccacaaacttcaattcttcccttgctaataaaatactggaaactgagtaataaaaggcaaatttcatttcaatcctttgggctcaaagccagctccctgccaaaacttctcctgcctggaggggtagagcagggaatgagttggggcaagcacagatgtcctgcttctactctagagggagagatctgcaaagggtatggctcagcatcttgtctaccagctaatgtgattcataaataaatcacacagggagaagtgtgggaggcccctgtggttcaattctttatctctttttctcttccccagtgtggaagattgtcctgagagtgtggggaccagggggcagagtcacctacatggtctgctgtacagcagctctggcagcttagcacaacccattcacatactgggcagagcccttccaatgttaacctctgccagagctcctcctgacttttttttttttaatcctaaaagaggaagcatttcaaatgacctaaatctaaaaatagagtacttcatgctcatgactattttaaatagcatctaaaataaagaattaaaaaaaaaaacatgtttccatttttgtgacagtttccccttcccttgaaaaaaagaaaatactgtagagcttgtcattcaatctaaaatcagacttcgtgccagctggaatcctaggtttatttattactgtgcacagttcttacattaactgtttgttaaagactgattttaccaccactgagacacaatgtaagtgaaggtctttccatgttttaccaaaaagagtgattcaagcatgacccgtccaggagaaatgatattaaagaaaagggacagaagtactactcagtcactgatccaactatatttctggagaaatcaagtttaaacataagtaattgcctaatggagttgggccaaggtggagataggaaaatatccatgacacttccagtatttgcaaaacaggttcaaaaataaaattgcaacattttatggtctgtaacatacttagtcacttagtcgcagagacatctggaaaaagataatccaatggggcaggtttttattctctactttagaaaattgttcacatttattccctatcatagtttcaagtagaatggttataattcatccaataagcttttttaaaaagcagggaatcacagtttctgggcgtggggcccacaggcctttacaaaacttcataggtttatacctacataggtcatagattgtgaatgacacacaacatgatgactatgttcatgaacacacatgctcatatacatatatacatgcagtcaagctcaacctagattcacaaatcttacaaggttttacttccacaataatgggctcctgttcagtctctcttgccagccaatcctccaagagagacaccgacaaatgtagacacgtaaacatgctcctccaaacatggaatagctatcacttatttcaagtcatcaaacgtatgagtcagctgtatcttgatacaattagttgaggttctctttcaatgtactccttagacactctgtggtgtcaagctgtggtactatggctctttcactagctcattaccacctccagcagagtctgccttggtatagcctcagaggcacagagcaagcactcaataaatatggagtagaggaaagagaaaggtggacaggaaaaaaggggggagggaggaaaggagatgaaaaaggatagaagagaaagggaagccagtgagggagtgaatatctagctgagaatggaggaggaatctcaaataaaaagggcaaagtcagaggacactcagaaaaacagaagtggatggacaacagtgccacaggaactcaaaggtgcaatgttttcaaaagatagatagattccaaagatggcacccactgatgaagcttttctattaccagggtcacatacaaacaaatcaattcggcacccagggctgaggtggtacagcgtcacgtccttaaaatgccttcagggaccaggcaaatagcataaatataagattataggcgagaaaatgcttaagtttcaagcacagcatctgtttcaagcagaaaaactgtgcagatcaaacagctcagcccagactctatccctacaccctggagctaacaaatcaatttgattcaaatatttgtggaatacctacaatggggttttaatcacaaaactttacttgaacagctgcaacctctagcctctccaggcttctttcctcatcatggggagaaaaacacaaacatttcaacatttgttgagaggagaagaggttctacatgaagtaacccgactgacttatttgtactgagaaaggaaaagcaactaaccctgacctaccagaacttctcacctcgggcagtggcagtgagcagaggtctcagcagcaggagcctgcacaaccccaaaggacatagcagagactccaataccatgtctgaagcaacttctttgaaatcaaaatgctgatcttctcacatgctgattacagacacttccattatcaaacagaagaatttggggcaaaatggattcttaatggtgtctgtttcctacattttcttatcagtagagtggctcaaaatctaaatccacctaaactgtccatcatcgccccctccccaccaacaatgctctcattttatcctgtatgtgtttttataaaacgtctcaccatctgtaacaatatatgtatttgagtaattgctggtttactgtccattgcctccactaaactgtaaactccatgaggtcaagtacagagtctagacttgctcatgactaaatcacctgcatctggcacatagtcagcatgggatatatatttatctgttggcccaacaaatatgactcttgctgctatctgattttacacaagcacacctccactggcacaacacaaggagaggagaagagggaggcatctggagagctcaatgtcaaggttacttcccagctgccattccttgtgtttcctgaatgcaagtgtaactagtaactgtactaacagagccaagggctatatattcttcttcatcccataaacagaaaaataaacagttctgtggaactgtgcaaacccaacttaaatttcagattccagacccattatctggcaccctttgctcagaaatactttactaccactagaagacaatctaacccctggtctcacataccacataatgctgaaattcttccccattctgtctcaaacctgcccacaactccgtttcatgagggctgagccactatccaatttctatccttataggggttcggttttagactatgctcacaaatcccaaattcccagtgagttcaggaatgatgcttccttaccttaccttacataggaccttgaagatttctattacccgcagatgtaacatgcagttgttaagaccgcacattgcatcagcccacgaaatgagttgggggctatccagcctggcccctctcacgaggccatgtaccttgtgggggagctgtgtctccacaaaaggagtatctttttctattttatacaaacatgccctatggattagtaacagtctgatactagaaaaaaggaagctcaaaacttcacaggacatggcaaataaaacccagtgacctgataagaggtacaatatctccttggtttaatatttcacctcttctaattagaataaaatattcactaggaaaaatttttatgatagtgtccttttggcattagcatgaatacctccaaggagccgtattattcaaacaattttctatttcaaaatacacaggtagtaagaactaacaaatcattacatttccaccaaatgcacggaaacaacaaacttaactaagaaaatactgaagcagcttttcccaacggtacctcgcctccctagagcggaatggttttcttttaaggaatccctattgatgccagaaccaccttggaagaataattaatgacattttgaaaactgaacttccttctcactgcctttcataatgcaaagtgaaggggaggcggggtgagagtcccccaggaacacacaatgcatttttacaagagcttctaaagcccctcagtgagacagaaacacactttctcatttaagcaaaactttagaaaactaacaattaaaatgtgagttaaactgaggaaacatcttacatctgtgattctccctccagaataatatgactaggtagctagctgccagacactcttgtttcagcaatcatgtgactatgtgatgagggctggcttcatgattcaggtggaactgatcagggcactgacactgatggagacaaagcttgtcaggcatgatgtccttgtaggcaacaatacctgaaactctgttaggaaatctgaggtctttggatagaaggaaggaaataagccaaaggctagagtcacacagtcagtatcacttcagacaagtcagcactggatcaacctcttcacctgtaaaatgagggtaagaatatccactcaataagtatatgataaaaagaaagtgacaacacaaagtgtaaatgaatatttaagcaacatctacacataagagaccctaaatgaatatccgttgaaataaaagcaatggttacatgcttctcatatcctgtggcccactgacctcattagtcattatcttgaccagctccacttgcacagcattatgaattacatgtgtgcagggctattcaattgtctagtttgatgttcttaaccttgtgaggcagtaaatatccattttaaagatgagaagactgaagtttacttcacaatcttagtggctccaatcgaagatcgtccactgtaaaattcagttatctgcctcatgatttcacggcttatggctctatggaagttctattcttaacatgacgcaaaggaagtcagaagttgcaaaactctgagttagataattaagccatgaaaagtgattgatgctaagcatctgtacacaacatgtgaaccaagggaatgagtgactagaacccaaagagagtttggagttatttggctgtgactgagaaatgatgggctaggaatccaggtaacaacaacaacaaaagtaaatacacattgtctctcctctttgagaagatgaaagaaaacatctttttcagttcaatgatgcttcctgtagacagaaattttctcattgaatggacaaaactagcaagtgcacaagttaataataaccttttacccaaggttccatagcaagttccacatgctatgctatcatctaggctccctgcctgcctcttctcattgcatcctcatgacaacctcataagttgtcatgctatctccaagttttggatagagactgagtctcagtagaggtaagtttgtttttcaggcagggttgagcttttcgaagtacagagagaactggggaatggggtgcttcaaagtcactgaaagagctgaagctgtgggctctagaaagacatccaggatgaccacgaggagtaccactacttctgccaccatcagaaaggcagagactcaggaagtcaccaacagaatcattattagaagtagactgtctgaattatgaacatggatcagaaagctgctgtcaccaacacagcctttgactttataggaaagccacactagcaacaaaataaacgctctatccactgcttctcagtggcccttcactgagtggccaggtactgaaagatgagtgcccaaaagcccgatgtctcctccaatgttctagccagcaaagatcacagagaatacagaaagttggcttcagtctcaattctgtcttccaaaactcaaacaagtgcatctaactggcaaacaaggaatcagatccagggccttagctgtaaagcatctggaaatgtaatgtttgaccttcccgcctttcagtacaggaaggcacgtgatgaggaggctagcaaggttcctgagagctcaatcactgtgtctacttcatcagatttgccatcccatagctgattcctaattaaagggagtgagaaccaaaaagggggcaaagccaagtatatgagtaaatgcacagaaacatgacagactaatttaaccagagaactaaaaagggtttagcacccactaagtgaagagtgcatttggaaacaaggtggaggatatagctggagaggcaagaaaaggccagatgatgaaaagtctatcaccccagcttagaagctttctcagcctaagctaggatatcccttctgaacttcttagaagccttgcacaatcctcagctactcattgatcacacagaattgtaaccattcatgttcttgcctgctttactgttccccctgactatgagggtgggaggtcaagggaaaggaggggctattccactttgtatttctagaacatagcacagtgcctggcccataaacgaaagctccagaaatacgtgttgtatggaattacgtcccgaggttccttccactatcaatcatctacttaaaaaggagaaaatgctctctttaccttaagtacctttcattattaaaaaaaaaaaatggttaactatggccacgcaatggctctcacctgtaatcttagcactttgggaggccaaggtgggtggatcatgaggtcaggagttcacgaccagcctggccaagatggtgaaaccctgtctctactaaaaatacaaaaattagccgggcatggtgacacatgcctataatcccagctactcaggaggctgaggcagagaattgcttaaacctgagagacagagtttgcagtgagcagagatcgtaccactgcacaacagcctgggcaacatagtgagattccatctcgaaaaaaaaaaaattggttaattgtagattacagattgataattgtaagaatatattcctatagacatatttttgtacatttatgtacagtagtagacaaatgttgtttctgttaactgaaccaccattctcccattctgatgatagtgcctcaattttcctgtaggaaaccacagctactcccctcacatgaagaaattcacatgaggggtatgacctcagccctggggtttcagtttggcacatgacatggctggatcaatgaaagttctccgtgggattcttgatatgagcaacttggcagtgagggggaaaaagttgctctcttatgctgagattgctactagtggcaagatagtaacattgtatggccaatgaccaccacatgagacaaggtgtccaaagaaggcaacatggaggaatcagagcccatggagggaaagacacagactctattttttttttttttttttttgagacagagtttcgctattgttgtccaggctgtagtgcaatggcgtgatctcagctcaccgcaacctccacctcccaggttcaagcaattctcctgcctcagcctcccaaatagctgggactacaggtatgcaccaccacgcccagctaattttgtatttttagtagatacagggtttctccatgttgatcaggctggtttcgaactcccaacctcagatgatccacctgcctcggccttccaaagtgctgggattacaggcgtgagccaatgcgcccagccgggagagacacagactcttaacaacactgagtactcggatctagggtgtcaaagctgtcatcggtcagtaaatttctttttctttttcttagaaggtctaggatggtttcagtctggtaacaccaaaagaaattcaaagttttaagtttaccatacataaactattagttgaagaaatggcaatgactaaatagcagaagaatgaaactcagctttgggggacatcaatctgtcagtcatctactgtgcagccatttcgaggggggataactggaagagatgaggctatcacctggacattcttaagagaattaaaacataataagccctctccctgtctaaatgcacagataattgattaacagaaaatgatcattactaaaatggcttcagagtttttcagggttgtgggaattacaattgttctgaaagaaaactgattacttacagtttcctcctaagattgtagttgtgcagtaatgatattgagacagcatgatgcccattaaaaaaaaaaaaaaaacactgaagactttacaaataactgagccaaatgagatattgaaaaatcaaagcgagaaagtcccatcactaaaagtatacaaatacatgagaatcagccagtaaaacaggaagtcactctcatctaaaatggcctttgcttgtcatcaaactcatatagaattcctaaaatctgtcagtgtagtagcttctaagtgatatgtcaacaaatatattcactgagaatacttattctgcctagagccaatgtttttagaaaaacatcctaaagagtcaactgttaaatcactaaaatgaatgttttgagcaggtgtttggaattgtgctgatttatccatattttccagtttaatttccacgtttaccaacaaacttcagcaagaaaacataaaatgtacctggaaggattatgttcatcataaatacaaggacagttgcgctaaacatatctgtactggtaacagtgattcataaaccatattcattaacctaaatccttaaagttttctgtttaaactgtagtgattggaacgccaagtgtcagagtttaaaatggtatttttaagctattagcagttgacattttaattaggcatatttatgacagacatggggggataaaaaagaaggtaagcaaggaataaaaggtgcatcaaggacacaagaaaagagaaaagaattaccatccattcctgttatccttttcttttagcatatcaataggaaagcagtataactaactggtcaagaatgtaagatctaaagccagcctttatcagctcaaatcatgactctgatatttaccagctgtgagaccctgaacaagttacataaactgcatctgtttccacagggataatgccagcacgtagctcataaggttgctgtgggaactgaattgggtactgctcaaaaaatatgttgcacagggcccaagaggaaagaagtattcaataaatgctaactactactatattatttgtaaccttacttaccgggtcaagggctaatagtggtagtaaattgttgcttaaaattttatttatatatttcttcttgaaccagaaaagatgccaggctatttattttttaattttttgttgttgttattgttttacaaagggtttctcagtctgttgtccaggctgcagtgcagcagcacgatcatggctcactatagcctcaaactcctgggttcacagagtgatcctcctgcctcagccacccaagtagctgggactataggtgcacaccactatgcccggctaacatttttgcgtttctttttttttttctttttttttttaagagatgggatttcactatgttgcccaggctggtctcaaactcctggcctcaaatgatcctcctagatcagccactcaagtcactaggatcacaggctcagccactgtgcccagcatgcaagacaatttaagaggcatacaaaagacaaaaatataactcaacttaagaacagattaagaattaacaagataagaatatttaagaataggttaagtaaacaaatgtcatagacaaaactagagtcaggaacaagacaaaggataagaatcacttagatatggctgctctaagcagctactagtttgtcttcagctttctggcatccaacacaagaaagaaaactgggtctgcggcacaattttcaatattcgtgagattaaaatatactaaatgcccagaaagagagagtacagtgattttgttagaggccgagaacataaggaactaaggccatgcagcaaatcttcagaggggcacatcatagccacggtagatagcattgccaaactcaatttcttagccctccttgtatccacacctgtatatggcctctggggccacacgtatttccccacctcttcagtcaaagcttggtcctaggacttccttaggccctgatatatggggagaagtgacagtgcatcttcactcagttctcaccctctgccttaaaaggtcttaagcatttctgcttgccttgctgcatctccactacagccatagaagtaagtgacatagttggtgtggttgctagtctaagggagatgaaaaacacaaagcagtatggagcagagccatccactgagcccagcctagatctgctaaaccccagatgattcactaagacacaagcaaaaataaatgattattgttttaaacttcagagttttgggataatttgttatgcagcaatggaaaacaaattcagtaacaaaatgatgacactttttaaagcagtatttctattgccaactataagtcaaacagtatgccttctaaatggcttaccataacctatcttcataactttgatttctaaacttattaaccttgttactgtaatttcagagaccctcaacaattaatataaattaaatttgtcactcaccctactaaatgaaagtactctggaatacagtcaccaaaattaaataaaggttgaggtcataggcctccaaatacaggccatacagcataagcaaaattaactgggaggtggggtagggaggcaagcagtaggtcataccttaaagagagaccaacggcttccaaagtaacaacactaggcatgaaagtagcccatgtgtggccctcaggagagctgccatgtgtatgaagacacactggactgagaaatcagtctcttcaaatgtgtgctttattcaaaagatatcagggcagatgtcccacaggatttgtgttgatttgagttgcttctcacatgagcaaagctatccagcatccatacggcagaagttgttatggggacttattcatttacacatggataatgaaactcatgagcaaggctggggagaccaactaacaactctaataacaacagtaatagctgaatcccattgatatggatggtgctagtcactgtgttaagcactaagcatcaattatttcattcaattcattgaacactcataataacccaaggaggtagttatttttattcatttctccaaccaactttgccttttgcttttacaggcaagtattctggagcttggagagactgagggacctggctatagttacaaaggcaccaccttgtttgacaggggctctcaggcaaaattagaacaggtaaacttgattagtatttgctttaggtaagtcttgaacattttctcagttaactgaagattttttttaatgtttatgtattttttaatgaatacattataattgtacataatatttacggggtacaatttgatgtttcaatacatatccgtgttgtgtaatgatccaatcagggtagttagtatatccatcacctcatgcacttatttggtgaaaaccttcaatagcctcttttctagttattttgtaataaacaatattttactgttaatcatagtcaccctaccatgcaataaaataccagaatgtatttctcctatctggctgttgattgtagttttaattcttttcttaaatatgaagcttctgtaacttcaactggtctgtgaaaatattatgccaaatagaaagcactttttgtaaataaagggcgtgtgatgcactatgaacacctcccaaatgatttggaggaaaaaaacatcaattccagtgatattgtttcagattatcccaatggtctaggtttattccaaagactttgacctaaatccctcagtattccccttcaactaactctcaacccatttgaaatcttattcatatgttctcactgttagattgtccacctacaatttttttttgtcctttgaattactttctactgaaaataatacacagacctcggtgttattggaaattgcattgtgaatacacaaggttttttgtctaaattttaggtagttttctctttctgttgctacctcaaagagataacagattctgcagtcacattatatgtaaattatgtacaagcttcaccacttgggcttgtacattattctactgattttctacagtggcgtggggggcacataatagccagcaacaaattattagaaattaaattcaaacccagtgtatgctggatatgagcatttccaatgcattttgcctccaatttagttcagatgactaaaaacagacctgtgggactgtttaaaggcactaaatctccacagaatcatgcagtgctatgacataggcattctgttctcaaatattcatcatttatcagcaacggaaacaaacataggattcacatgtgcaaagtaacaaaatagatggtcctagctgacataccagtttgactcaactgactattacccttacaatgagcagcttcttaaaccacacttatcctggtcccctttatctatgttagagaaacaagaccatctctactattaattctgtctcaaaacttcaggttacctagttttttccctcaaagattattcatcttcgacagtcaccactgcttcacaaaacagattttattgttttctttgccaattaagggctccccaagaacagtgaataatctgtcaggttgttataaaccatcaaaagttctagaaatgtcacattacctccttcaaatattttttaacatgcaacagggacatacagctttgtcatcaaaagctgtattggtttcctcatattttctaatctacaccataaagggaagatgtttatcataatggcaaaataaataatttagccagtccaaatctcttacaattgcatgtggcaaaccaaagtcaaactgaaggagaggagggtggaatagaggttaatttgctcacatgacaagaagccttgtgactttatttaggataggtctaggcagtgaggctggtaaacatttaacaatatactcatttaaaaaaaaaaagggcagggggtaggagggggctgacttgcagccaatttcaagctaccaacacgctgtcaaccagctcacagaattcctgaacatttaacaataggctattgtatgctgggatgagccatccccagcatgatactagatccagctatcaaacaatatcataaacaccccatcctctcttctctttttcctgctttacttcatctgatttcattctcaaacagatttactcaaagatgactgcagaggaatgttctcagagggctctaaataggttggctttggatctgccctcttaaaactaaacattaccacagaggaatgaagtattctgatcacccagtttgggagctagagagaatgggggtagctacgttcaaaccatttggatgaggcaggactcgcctgaaatggggtaagtgtagccctcctaagaaagaagcactgtgcggatgaacatcatgaacaccatccaagtttcaacatgtctgagattaaatctgcagcaaaagtttactccatttctgggtgtgtaaagcagctaaaacttcctaccatgcgtccgctatccatggaaatccggaacaaaagcttaagatccaagaaaataaaatgtgttttgaagaaaaatatgctcttgcaacataaagaagctgtcttcagttacaaatagatataaaatgtgaagatatataattgctgcataaatttattaatagaagtgctaatgccataaatcgtacatctccattttgacacgcaatcctttattttcctttcactgaggaagaaaaataaaggagcggaactggtaatattgcttgcaactaaattggattttccaccagagaaagctgtttagaaaaagctattctaaaaaagcaaaatagtactcacaaaagggtattaatgaatccaaccaggaggaaaaagcctccaacaatacaaagctttccaaaacctctttcaggactgaaagccaaaaggatgctttgaactctctgtctttgcagaaaccatctcacctacaaaccgagtatgagatagagttcaaattttagaataagaactcttaattcaaactacaagtcttaactgacgattcaagaggagagactgcagcagctctgggtttcgaaggaaaccgatacatcctgccctcaaactgtgaggcactataggagcaagatgtaaaggatgcagtgcctttgcgctcccacctccgccaccgtgggtgtcataatacagaggtgaaagttcaacatgcgacaggtagggatgcagcagactctgtggctttatactgcataggtctttcactgcttggtcacagaatttctttgaatcctatttgtttatacactgatatttatgtaataacaaaagagtaagtaaagagcaaggaaacagccaagaaaccctgagcaaatttttttccccctaagaataaaggagttgagttaggctatcttcccggagcttctctttatcgctagatgcagtcagctggaaacatatgcctgctaattgctgaatgtgtgcctcatggagcaacggtgcagttgtcgaacgacctcggggaaacaagtctaggcctatttgtgcatttctttctttcaccatgggactcaagtgcttcgccaggccactattaggacagtggaaaatcaaggtggaaggctctgatgaaatcaattatcactaagttattttcactggtgaaggggtttcctcacaggggtttaatagtaaattattctttccatgggatgtgctagattaatggaggaaacaaagcaaacaaatgttgcctggtaagactaagaggagggtcccaaaatactaatatttactgcccatgaagagatagccacattcacaagaaaataaatgtaaacctacaattccagaggcgaaaaggaaaaagaaatgctaaatggcagttatttcctcagtgttatacattacacatatcaataaaccctagagtcccatactatacatgccatatggatagataaatggcatatgtggtaatagtctttcaaactggatgatagtactttgcacaagtcagggatgcagcaattgtttgaaaatagggaaaataaccattttctagcattacctagtgaaatgtaagtgtgggtacagtttgggagaatctgtatagtatttatttttatcctagcaaactatactttacctttctggtagaattttaactttggatattttacaaatatcatatatagtcttggtaacatcttttatttaaaatcacaaatattagttggatagatgtgttaagggagatttaccagactgcatacacaaaggaggccatcagacatgggcatctgaattgatataggttacaccacaccgtagttaaagaccaaatatctgccagtgttcccaataaggaaagataactaagataaaagaatgtctcttgcagaattaagaccttgggattcttttaaagcctgggtttacatcctttgctcagaagagaaagacacattatttcaatatattttcattcattcttaggcattaactgtcttaataaaggcagtgcttctcacttaaaaaataaatttagctttaacaaagtaagtgtaaacgtgaccctaattttcactctgctgtcctttcttccctgttgtgcttattagctgctgctctttgaccttgaacagtaatcctttgagcatgcctccttccaccatcaagaggaggttccctacggtctggtagtatttctatcatagttgttgacatgccagggaaaataatttcctttggacactataacccttctcgaaaccagctccttcaaacaactcacctaattgaacgtgaaagacatgaaaccactggtgtcagaaattaaatataggtgtttctttgttttctttggcatttcttctatttactttctgtcatctatgccataggatttagaaaggaaagctatggaaataggcaccatcaactagaactcaaagagagaattttgtatgaggaacacagtccaccagcagaaatagaatagtgttggatatactcttcaacatgcttttttttttttcaggatcaatgttgatggactgtattgaaaacaaaagggtaattcttctatggagttgtcttgcaaaattctattctagggttttgtctttgtcctttgtaagcacaaagcaaatgagaaaacaagtatatggtattttgatcaaaatatatctgccattaaacctaaggttccggagctccatggtatctggaagatgctttagagggtaggtagcctgaaggtgctgcggtgccatcaaagggcaatgaacatctgttgccccatagcccctttcctcctcctccagcaacaaccctgacatcatttgggaattcaatcatctcctcctctcagtctataaggtcgcagtagaattccatccttagacatgaagaatgtgcctcaggccaagctaagaggcacatcttactcccctatgcccctacccccctacccccctacccatagagatttgctgtgggatagacacatgacctaatccattctaatcagggtgactctcaggatgtctacaggagctataatgaaagagttgtaatgtctacagcagaaataatgtcttctgctggagcttctgcagccatcctgccaccactggttaggctggataaaaggcaaacctttaagccttttttttttttttttttttttttggtgaccaagttttgctacttgttgcccaggctggagtgcagtggcgcaatctcagctcactgcaacctctgcctctggggttcaagtgattctcctgcctcagccttcctgagtagctaggattacaggcatgcgccccccacgcccggctcattttgtatttttagtagagatggggtttctccatattggtcaggctggtctcgagctcctgacctcaggtggtccacccaccttggcctcccaaagtgctgggattacaggcatgagccactgtgcccggcctgcctttaagcatttaatgggatgttaggaatacggtactgtaatttctccttgggtataaaatatattggagtcaatcactgttgcccctaccctagtggggatatggcaatgatctcaccccataaggcaaacactagaaatttatgcttcagaattccatctggctttggttactttttgatacttatgattattatttttatttgaaacagaggctcactatgttttccaggctggacttgcattctttagtctcaggtgattctcccacctcagtctcgaaagtcgctgagactataggtgtgcaccttaattattttaagaaaagaatgtaatggctgggtgcagtcgctcacacctgcaatcccagaactttaggaggctgaggcgggcagaccgcctgagctcaggagttcgagaccagcctggccaacatggtgaaaccccttctctattaaaaagataaaaacttagccaagcatggtggcgcatgcctgtagtcccagctacttgggaggctgaggtaggagaattgcttgaacccaggaggcagaggttgcagtgagccgagattgtgccactgcactacagcctgggtgacagagctagactccgcctcaaaaaaaaaaaaaggatttaatttttaaaaatcagcatgaactgaaatttacttcacaatggaattaaagacccccaacaagtcataatatgcttatatggcaatatcacattgtttgtgtgagttataaagttggatggatttgcactggcatcttttcacggttttagtgagagaatcatgcatcatccaaggaactctgatgtaaaagactggacatgagaattattacagctttgaaattctgtcaatttcctacccatttagtcagatttaagaacagtatgaacctatcttacccaaaaaaataggttctaaagtcagtacataaattatataatcatgtgatatgactttatcatatcagtttacattcctgaatataatatggtccaatatcttcaaaacatatcaagactctgatcacttcttaccattcacaccattatcatcaagttgaaaccaccatcacctgttttctgagttacttccaaagcctcctaatcagtccaaacttagtcccatgcaatgtattcttcaaagaaccagtaaattcttttaaaaaataaataaacagatgagatcacagcactacttaacacctctaacgtcctcccattgcaaaatctgtaccgtgacttacaaggtcttctcgatttgatttgccccatccctatccatctaatcccaattcctaccactctccctctctctcacaaagcttcagccccactgtctttcttgctgttccttcaacattccaagatctttctctcctcgggggctttaaaccttcctacctctgcctgcaattgttttcctcttaatacttccaaggtctcccttttgaatccattcagtttactgcaccaatctcatatcttcaaaaagtttttcctagacctcctaacaaaaataaggcccctttcctaatactcactatccccttattttcctcctagcacctgcaactatataatttccctgttgacatgctgattatccatcttatccactgaaatataatccctatgggcacaagtacttttgtttatttgctgctgaatcatagcatcaagcatagagcctggcacctataaattgctctataaatttctggtgaataaatgaatcaatcaataaatgaatcttccaacaacatgatgcaacacagaccaacgttcagatcctacaaggtctaataatgtggctaaaggggcacctgttcttggttccctttggtgaaaacctgataatcaatgaatggcaagcatatttacatatttaaaagtttgcctgcaaggtaatcttaccttgaggctgtgtaataggagtaagtatctattagctcgtaggaagcacatgcacacatgtatgtacacacataaactactctgatctctcatgtcttcaacaacttgactacatttttacctgaaaaaattattgtagctattactaatgtgatgcactaaccagagagcagaaacaaattgagttgtttgtttctccaggagggaaagcaggccgcagctacttccagaaggtcaagagatcagggtatgaatacctaagacatgtgtgtgtatatttctgccacagggagttttcacacaatacacaaatggaggatcaactaacaggctgccagtcaaggggagattcaagaagtttcaaagaaatgctctgaaccccaaaataacaaaggaaaacatgttttgaaaagtacacaaagacagttctcttaaaaatctgccaggactccttgccaaaatggcatgttacacatccccttctctataacctataccatctgggctttccgtaccccaccagcagggtgtaagaatgcctattcatttgcacccctgcccatataagttattataactttttaaaaatcattcccaaacctgtaggttaaaacatgatgtctccctgctttaatttggaggtctctaagttgcttacggtacaacctcaggatccattcatgctcattttgtagctacaaaagaaaaagctctaaaggaaggccaagtgaaatcctggacatgcagtgtgatgaagaaataagggctgctgcttaaccaagagtcaactcaagcagtctctgtgaagttctttctcactgcctctgtttattttcctcctcagccaacacacgactaacagcagcatcttgaatttgcgttacaatttaccaagcacctttattttcctcaatgatcttcataaaaattctgtactatggataagatgactctgttttccagatgcagatccagaaaatggactttccctcagtgtctccagttattaagtagtaaaacccagactagaacctgtgttttctcatggcctcttcaaagttctttctacgatggcatagttccttaagataaaccgagtgaaagaaaggtaactttcactcacaattcaccagaaaaaaaaaaaaaaaaaaaaaagaggaggtgggggagaaagaggtgctacactcagctgagcccacctgtttggtttctgttagctttgaccaaagtgccagtcattacactaaaattctattttgaggtttatcatgaatattggtttctacaaaattcttcattaattaatgctagaaaacacagctctcagtcaattgccatggggcacaatacccaggcactgcttttctttgttcttcccagtcttagggacaccaatccagatagaattacgtccaaaagtagcctaaggccacgtttatgaaataaaaacaccaaggacacaggctgattttagggcaaattttaggtctggcattttatcattctgctctagatctaggggttaaactctactgaaataactatggttgcttttggtggaaacccccttccccaggcccttccagccctggccaggattcaatcatccattcaacagctattcactacacattcacattgtgctaggtgctgggcatacaatgaagaacaagatagacactgcttttgttctttagagatgacatactagtaagagagacacactaaaaacaagtaaacaaacaaagttatgattgactataagtgtaatactctaaaggaaacaaacaggggcactaatggagaataacgaaggcaccttctttgtttagggtggccaagcaaggcctccctggaaagtaagttagtaacagaactgccattaacccacttaggcctagtgttccattactggaatgccaagcatgtgggagttatccatatcctactgctcaaagtcatcgccaaggtctgatttttcactcatgcaaaaattcaaaaaattacaacctccggcatatatgagtcaataagcattccttccttgacctacacatgcttcaatccatattattttccttagtaggtggctgatgaacaggtcaaaaaccaaacaggccatggtagggatggcatcaggcataccgaaaaattctgctttagaaatcagtcatgaaaggtcattccagtttaaattacaatcaacatatagaagctagaaactccaatcagggcaaaaatggcctctttatatcccatcaaggaatcatttatctaagatgacaagaggtatattgccaacaaatccacaattctgtttccaattaatgcaaacttataatattccaagctgttattagatttcaattaataacctgtgatgcctcattaatgcaaatatgctcttcgtggtgctaaaccttcattagtgaaatgggtccaatgacatgacggtttcatatgataatggaactatgattaaaaggcacaattaatcattttcttctactacataatctctgtgacagtttacttatgcctatatgaagcatttgtttcttgcaaacagtcaatttatatttaaactattcaatagcagaaagaaaagcagaaatatcatactaaattatctctaatagttgcaaagaatcccagcaccaagttaggttgttcaagaataaggaccaggcacgatggctcacatacacctgtaatccgagcatcttgggaggccaaggtgagaggatcacttgagcctaagagtttgagaccactctgggcaacatagtgagatcccagttttacaaaaaaaaattagccaggcatgcacctgtactctcagctactcgggagactgaggtgggaggaccacctgagcccaggaggtcgaggctgcataagccatgatcatgccactgcactacagcctgggtgacagagtcaaaaaaaaaaaaaaaaaagtcacagagctggtgccattctccattaagagcataaagtgtgaaacagaaaatctcagtcacacggctgtcagtgctttttctttctcttgtctgtgtactttccattctttgaaccctgaattgctccaccagcaggttcaagccagcaacagatcctgaaccaaacacagcaaaaacaggacactattcccacccctcattttctccccaactaccccacgcagcaaagtctgacttgaagcgaagctgcctggaacagtccattactactacctgcccagtgtccttccccaattctgacaataacactgttttgcctttgcagaactgcccatctctcatatccatgtgggcctggttgggtggtcaattgcaactcttccctcaagcagccagagagagggtcagaagcaaggctgggccatcaaataccccaatactcagcacagtgattgatccaggaatgggctcctgaatccagcagtctcctgggttttttttctgacattcatttactgctaataaagaataccacgttgactccatgcgttagctttgtttgctgtttgtgatttgtggagaatcgcagaagtgaaaagtaacaaacacatgtcaagggccatccaccccactccaacctccacctcaaccgtcacccaagtaaagtccagctcctttagactccctctctctcagtccccagtgttacttattgccaagagacataaagcgtgcaaaagccacacacttctccttctaaagtaaatatagttttaaaaatctattgagatttcattttaattgttgcttagtaaccattgcaagattggaactgtttcctagcttaaaaaataacactataaaaaagatcatttagggccgggtgtgggggctcatgcctgtaatcccagcactttgggaggcccaggctggaggatcatgacgtcaggagttggagaccagcccgaccaacatggtgaaaccccttctctactaaaaatacaaaaattagcagggcgtggtgatgctcctgtaatcccagctactcaggaggctgaggcaggagagttgcttgaacccgggaggcagaggttgcagtgagccgagattgtgccactgcactccagcctgggtgacagagtgagactctgtctcaaaaaaaaaaaaaaattagatatttaaaattaagctgtctaattgttttaaaactcagatgttatagtagctttgcatcggagatacaatcctaaaaaatttaaaacaaaacaaaatgactgggtgcagcggttcacacctggaatcccagcactttgggaggccaaggcggaagaatcactagagcccaggagttcaagaacaacctaggcaacatagtgagatcttgtctctataaaaatttttttttaaattagccggccataatggtgagcacctgtagtcccatctactcaggaggctgaggtgagaggattacttgagcctaagaagttgaggctgcagtgagccatgattgcaccactgactttcacctgggcaatggagtgagaccctgtctcaaaaataaataagtataaagcaaaatgtttgaggattttatttcaataatgccaatctattcctcttcaacgttttgatctaatgtatgaattgtgactctgtcctcttggcaacaaaagtaatgctgggtcttaatcaatgtgcattagtatgctagcaaaatgatacttcttccatatgtagttatatattaaatatatataaaatagaagtgttagatacgactcttatgattaagatatatctttatttaaataactatcccttactggaaaataaatatggatttatacatttttgattaataaatcaatactcatttataatctgatttataaatattttttatttataaacatttattgatttattaagtgcacatgatgtaataatggtttcagtgcctctgccaacaatcactggctgctaagagttgctagagtaatggattgaaaaatgcaaaagggcctgaaagcatggtacgaaagaccacagtgaatgatcggttatgtcggccaaggatgtgggactcagaaatggtagcaggcacatcaagagctttttttaaatctaccgcaacgtggaaaagtccagttgttctaccagtaggtgcttcacctttgtgaagtcacaattctctggctggctgtctactcatctttaaaatgagagttttgattagatgacctcttatgtcccttctagtttgaatattctatgatattctgaaaaaaaataataataatagctcttgtattagcatcccaagcagtctggtgtgggactagctaaatacaggcagcagtgagcttcgaggtgaaagctctgaggaaaaggcagagtagaagaagcaaactttcactgagctgtttagcctggagaatgatacctaaaaagcaaattaccctgtaagaggacttgggaggaaagtgcacagtgaataagtccatcatcttctcccatatattttcaaaaattattcctggaattatgttgcaaaggagtctcaggatgtttgcagccacaggaactggaaactatttcacaaaataggaagtgtagagatcgggcagattcagtgacctcacaatgttatgggtgaccccagatcttctgagctttttgctttagtgaccttgtgaagactttgtcttcaggctagttccctgaatggtgatgagatggctgcatgtagcaattggtgctctttgcttccttgttcggttcctgaaagagactagttgttcttccttagaagcatgagcaaagttctccttaccactatgtggtccaaattggttcctaccagctcatctttgaatctttggcaagacagatggaagtattctgataaggaacaaaagaagaaaaaagcaaacccttgacatctggaaactactcaacacatatagctgggcctcactgttagaaactaacctggcactcatagccaggccacattattatcctgctgggcataaacaatgtcacagaacataaacagctcaagaaaacccactctgagaccatgataaagtaagacaaaacaagactatttcataatttctctctcttttttttttttgagacagaatctctgcccagtctggagtgcaatggcgcaatctctgtgcactgcaacctccgcttccagggttcaaacaattctcctgcctcagcctcctgagtaactaggattacaggcacctgccaccaggcctagctaatttttgtatttttagtagagatggggtttcaccatgttggccaggctggtctcaaactcctgacctcagatgatccgcccgcctctgccttgcaaagtgctgggattacaggcgtaagccaccgcgcccggcctcatactttctctaagcgcagacaaagaaaaggtcactgcacaactcctgagataccaaacatccccgtccattagctactaagagtgactgctacttcattatgaaaaacaggtttagcctcactttagactgtcttccctttagagatgtgagatatccaatcataaaattatccccactttgtgacagcaccctatgcagaatgaatctccctcccttccttagactctcccccaaatcacccaaatgaactccaaattcgttctaacaccctcttactgagatatgctatggttctctgtggtatgtgttctccctcactgcaatgagcaaagaacccaacttcacctccaagtgtgttcctggaggtctctagctagagggcattaattctgattttatactaatgtttgctaacctttttcattattaccccccaaggagcctctttagacttttttttctaatcatcccccaccatttaattccacagatatactgtatatgtttgaggggagggggtttgaaagagggtctcactttgttgcccaggcgggagtgcagtaacccgatcatggctctctgcagcctcaacctcctgggctcagatgatcctcctgcctcagccctccaactagctgagactacaggtgcctgccaccacacccagctaatttttgtatttttagcagagacagggttttgccatgttacccaggctggtctcaaactcctaggctcaaaggatccacccaccttggtctcccaaagtgctggaattataggtgtgggccataatgcccagccgatgtgtgttttttatatagaaagggtaagattctctcccccatacatatcctcacaagccaattttcgtatggtttaaattaaattataagggggtagaaaggaagttgaagagtctaccacaatacgttaaaaagcacacaccttcttagcaatctacctttttagtacagtaatagtaacactcaatgctttttagcactttccacacaccaggcattgcttttatacatctattaattttacacagattaaataattttatccatccaaaaaatctacatggtagatgctagaattatccccagttcaaagctgaggaaactgaaggacaaatgagccaagtgtcatgccccaagtcactaggttaataaatggtggagacaccaaataactgccctctaactccagggaacatgctcataaccatgaggacacattgcctcacactcaacagcggctccagaaacactccgctcaatgcgtgcacaaatgagcaaacgagagtcataatttgcatgatactacactgccttgttccaaatacaaacaaggcagtaaaaattacggacataggataagacttaaaactaagatgtctgctatacagagaaacatattgacggaaatctttcggggcaaatttttaaagtctgtgctgcatgactcaaatgtttcagaaaactaatcccattctgtgcttatgtgtgtgtgtgtgtgtgtctgtgtgtctgtgtgtctgtgtgtgtatgtttacaaggtggaaaatgccttggttaagaaagggaggaagagagggaagaggaaaaggtagtatgttttcccctaaaaattagagattccgaagtgatgatgacatcctccaaccgctagatggaacgcagttctcccacaccatggccatgactgctcatttgaacttgctgcttcatggtcataaggccaggacttcctggcttcctcatgagccaccacattttccatatttttagagcattcttcctacagaagaaacctattttgcattgtttttacaactatcttttttgttgttgttctaatgttgccaaggaatcaagaacctcaaaacctatcttcttctgaggtcaagccatccactcacaggacttctcaagctggagcccttagttgagctgattttacacaatcgagtagagaaagaaaatggctttttgtggtgagcatctgctgttttgttaaaaatgtggttaaagacattaacaaaagtgacattaccagctgttgtaatgtcaagcagcttagctaaactgttttttatcaaatgacaacatatgacacccaaatcaattccaaaccaataacacattgttacttgtaaaacagagctgaatgagagtgagaatgagagcatgtgtgtgagtgtgacagagagagagagagagagagaggttaattaaaatacaaattcaaatttctcctgaagtaggaacaacagacaatatgatcctgataattttcattaagaaatttttaactttatcccagacaaagcaaaaaaaaaagacgattatgcaatccatattcttacacaagaaacagtgtatttcttttgtaaaattcttgtaatagcaaaaagatatgacggagtttctggccacttaaaatctgacttggcttctgtccttcagccatatacctcctaacgagtatgacaataacagaagaactgacttgtgtggctatgtttggtctctctatttttatctgcccatcatgtttaattatcaggctattaaaaggtggcaaatcggtagcattgccaactgcgttgtccctatggctgaaaagcctgtggcagttgaaacaaccaaacccttcccatgggcatcacgaagcttgtaaaagcaaaacggcacaacgtctgcctgcctgccatagtcatggccaatcctgaataaatgtttaatttccacaactgtgatgagggtagggcctgatttgtgccagtgcttaggaatctccgggtatttcatgtgcacaattattaatagtgtaattcacaaatgccaagtctacccttaaggcctgagctcagtcctgctctgctagagttggtgtgacttagtcatcaagaaagaagacactttcaagggcatgattcctcctggaagaaaaacaaaggagtgtgcttaggggataggacgcttgccaggaacagaaggtatgctgcacatggagagtgtttcgaggtaggtaactcaggagggacctgcatttgggggaaaaaaaaacccagaaccaacagaagcagcagaaataaacaagcaggtgtgtgcctctatgtctactacatgaaaggaaaacagggctgaaagtcacaatcagcatatggagacacacaaagaggggcacctgggaaaatcaatgtgcatcaggctcgatggtgcctgcttcctccaggagctcactgcattatcacaggtggataaagtcaccccttcaatgggcacaagtagatcactcttctctgctgagattggattaaaggcgacactgatgctaacagcaagaagaaggtaaaccggacgttggaaagaattttcaacagcaaagccacagtacaggacagatcaccaggagaaatgtatggggaaatgttagaaaagtatggaaagccctagaaatttcaaaagtccagctctgtgaggagacagaggaaggggcagaatgacctgaaaggccattctagtgctattactatacataggaaagcttccttgagggcattacgttttaggtttccaataaaggagagaccattttcaatattttttaaaattttgttgtgtcattttataataacttccaatgtagatcttttaattttactcttgcaataaacctgtacattttctatagtcacctgcctatttaagtcctttattacagaagaggtagaatataggccaaatgccagaagtaagggtcggttacaaattctcaagtgcttgtttatttctggattactttattgactcatttatgtaaccaatgagatcgtgcagtccagcctcagtttccctaaatatttagaaaacaggttgaccatgggatcatagtagtggggcatctggttttcttctgatagtgctatttgttaaatattctgtattatcagatgccctactgtgtgcctgtatatagacttcatcttattctaatgctaactttatgaaatgcatttcatttttaccttctttatagatgagaaactcgctagcaatcacaattaatatgaggagaagttaaaattggaacccatgactgatttcagagccaacattttttagtcactacgctatactcctacctataaacttctaaaaacactgttcacaagtacatcattcccctatggcttccctggatattgagagacctggattataattggaatttttgactaaggtaaacatttcaaccacaagacctgatagaatctttcctatgagaattggtctcaggcttacaacaaaactagcaagttcttccagagtacagagcacccctgtttgaggcaagacccagaactttaaaaaattctaacaaaggtcctagtttctcacacagagctcttggttttggataagacgactttagcctaggctggactgaagacatgaggggaagttctgcaaaagacattgtgcacacattatctctttcactgccctatggcccgtaagatgttcctaacctggaaactgagaactgcacaggtcaagtaaggtgtccaaactcacccaggtcctaagaaacagagcacagattcaagcccagttgtatctgcctccaaaatgagtgctcttttctgttacaatacatgctactatgtcacctccaaaggtaggtaggtactacctttacccacacgcgtgttcttgaactccccttacatctcacctaatgtgaaaagcctgcatgaccccctgggacatataaggccctgggtagtccacaaccaccacccctccacgtacacatcagccccctttcttcctgttaactgccacagaagcctccttctgttcctccaaggccccctgtgctttcctttgtacatgtggttcccctgtcaagaaaactgttccctacccatctctgccaccttgctgactcctgctcacccttcagacctccctggaggaagcctctccagcatccctggccaggccagatttctatggtttacagcagagtttctcaccctcaacactgttcacatttggggccgggtgattctttgttgtggggtctgcaccgagcatcatggaaagtttagcagcattcactagatgctggtagcacctacccctcagttctgacaaccagaaatgcctccagacgttgccagaagtccctagaggacaaaatcactcctagttgggaaacactgatctattgctctttagaatcactttccttatcttcagagcactggctccagagcacaggatgtgcttctgtcattctttgaccatctcctccacgtgaaaatgagtttcttaaaggcagagacagtgctggcttctgctcaccctcaaatgtccagtgttcaggggcatgcctggctcaaagcaggattccaacaaaaacattttttttggaatttctccctaaaaaaggtttggtgggagatcataaacttaagtaggtagctagtggaagactgctgaagcttttttgaataaaaaataatgccagcagagttcaggtcaggggaaatgaatccctggcaggatggacattaaccaaacacctaacacatcagcagaactttctgccaaaggtgttgagaggttatcagcagcccccacagcacaaacaggtgtcagaatgacatcccaccaaaatggcagcagggccctaattaaaagaagaggctgttctttcaagtattgccatgcagccatggcactgctgggatgtgtcaaatcacacccatctaaaaacacacaccacgacctgacatctttgcccagctgcaccatcccacgtttccgtgatggatattagaaaataatgtaacctcaactgacaagtttattaagacacagaagacattacagaggcccttttgacattccaatctctaacgcagtcagggggagatgctgacttgccatcattattgaaagtaattggtcaaaaaaaaaaaataaaagaggtgagagagaaggagagcaatcctataaagctgtcaggttaattatttggcctacaggtgtgctcagtgctcttgatctgcctaccactgggcttgccagtgctttgccagtgttttctccaccctcactcctagtttgggatagttcaatctaaagctaagagagtacatttaaagcagaattttaccttggccaagttatttccttgcctaattatacctacgtaccagtccaaatctccattcttccctatggctctgtcctgttggcataccaaactccaattttccaggacagataacccagttagaaacaaccgacttgtgtgaaatgccacagagagtcacaacgcaaaaacaagttttattcagattgaatttaatttcctaggcagtttagatcacagatccgaaacccagacattttcacaagccaggcaaataacctgaatgagtccagtgagtcagatgggagccaaaaggaagtgatgaggatgatgacaaacaggaacagcaggctgtgagctcagtgttagcagagaaaacccaccgtgccagggaagctgctgatgctactccctggctctaggtccaccacacgcagagtagatgctcaattaatattcagtgaatgaatgaatgcctgcccaagcattcaccctgttgtttccatgtctgttatttccaccagaagaatgttttgtaggcttaaatctccagtgccttcagcgcaactgtcatttggaaagtggtgaactttaggaattaaagaatggaaacaaagagtacatgggagtcactaatgcatgtgggagatactattcatgccacttccaagaatggggaatccgtacagctcattgtcataagtgatgttatttccaacttgttatgggtgagcattatttagaatagcttggaagaccacaatattttgcaatagacatggtagcctgtcagggatacaaaatgaagactaagactaagaatgtcaaatgagattataaagatacctatctttgctcaaataagcaaagggaaaaagtacaccctctgcctcttctcctctccttaaattccttttccccttactctctcaaggagtaaatatatatgctcatatataccaacataaaaaggacattggtagaagcaaacaatacagaagagtataacgggaaaaatacaggtcccactactgagaggtgtcctcggtgaacaatttcagggctgtgtgtgtatatttacgtgtgaaacataaataggatcgtgataccttacagcaacttctgtttttttcaccggacatctatggcatttttttatacttacaaaaatgcctcctttgctctttttatctactgttccataaaaactcactttataaacacaaaaggccaatttttctcacattcatcaaggaaaggctcctgtaatattgtgctcttttttctacctccaatattatgtttaagcaaatcatgagaatcaattaaaaagtggctaacattggcttgtttctactgtaaggactgtttttccataatttgggcttgaaaaaaaatagggttgtcaaagcatgaggtaagtagaagagaagcattaaccaggggtgttaggaacaggaaatgtatttttgaggaaggttttggaagaggagttatgcatccaaagggttcagaattatgggccaactattcctatgtacaaattgaagacattatataaacactacaagaactgaatgcatactcatctttggctgctatttcaaacttccagggacaaatatttgtccttattataaacatacatccaatatgtgttaagtgctcagaacatgtcaagcagtgtgctaagcagtacccatgtactatctcacttaattctcagattcaccctgaaagtaaggtactattattatctccagtggaaagatgaaggaattcaggcttaaggctacacaaagattagtgagacagcaaagatgaatcccagcaatctatctccagaacttggaccctatgaccttcacattatacgtttaaaaatgtcacagacagatggacacataaaactgtgttgctttcatgtcctgggtttctcttctaaaagcaaagcatatttttgttttctctttccctaactagatttccattttctttggtgagcttaagggagtgccctgccaccttaataccaaatattatatctagggtgagaaggagagaataggaagagcaagcagcaagggccttcagaaactatttgtacttgcctcccaagatagggcagcttgaccttatccatgtggctgacagtccagttgctctagtcatgcacctgtgagactactttctgctccctaaatatgccaaacacacaccatgctttgcatgggaactctcccacccctcgacactacccagttattcacatgaaggagtcttcactttcatcagatttctgctcaaagactgtctttcccccctttctaagagttctgcctcattaacctcttatcctataatctgttttgtgttatttttggtacttgtggaaataaagtgccatacacagtcaagtgttttgtgaatgtcaccatcactttaagcctcatagatatcccacttctggaacaatagaagtatgatgcttgataactatttgttgactaaaataatacattgcatactacttgaaacacacctcttattctagtaggaattatctaatcaaagtttgtgcatgtatgtaaatatatccatatatacacatgcatatgtgtacacacacacacatatttgcattttgcagtttagactcttaattaccaatagaggaaactcagtaagtagcatgatagaaatgcaactagtataaaccaactgaattacaaacacaggacttagaggataactgggcattgcaataattgtgaaggaagatgcttagtgaatgattagagggcaactatgttctgatatctgtgaatgaactgcacagtcttcattaatttcacagaaaattcatttttgtcctgttgcctatcctgccatgaaagtggagaattgctcagaatctagctttagataataacatttgtaaaaaattaaaatttgtggcagggcgtagtggctcatgcctgtaatcccagcactttgggaggctaaggcagatcagttgagctcaggaatttgaaaccagcctgggcatcacagtgagacctcacctctacagacaaaaagcaaaattagccaggtgtagtggtatgcgcctgtagtcccagctttttggagggggaagatgggctgagcctgagaggttgagaactcagtgagccgtgatcacaccagtgcactccagcctgggtaagagagtgagaccctgtctcaataagtaagtaaataataaacaaatttgttatcaacttgtcctgagttgatcaagttgctatagttaactatgaatttatttctgattttgatgttcatagttgcagaaactccaaaaactcctagtcagtacacagacggaggcctggcaataaacacttgaaagaattgcctgttggatgaatgaatgaaacaagagaccgacagacttcatccctccagagagatatcttctactgcttctctatgattgttaggccgatgtaattaatctaacacatggagcagattttacccttcattttcaagtacattgtctattaacagcgtccatgagccctctgattatgcaaggttcctgttaatggatctctgccaataccaaccatcaagctaatgatctgagcttgccagctccaaggtgaaggaccactcttgggcatatctctccaggactcaaagaagaatcccctctccaaatgatcttggagaagcaggtgtccactctgcctgccagaggctctgccagcacagggtgggggcatcaagggaggagaaaataaaacccagtaattcatatgggttgagattattgacttcactttcaaagaagataaagtgaaaaaggaagaaccgtgtttttgaaaggtaagacaggggacattatcctgcgtttcatcaagtcagctttttcatgtcaggcgatggtatatctcctgtaacttgtcaatggcaccacacagtgaagctaaaaggttgaagattatttttgtaacgattgatactctttctgccacagcagtcaagcatctgaagattcttcctttctctcctctgctctggtgaatccttttaaagttcttgggtgaaagagctgcaaaccccagcagatatcaaacctgaaacactaacttgacatatcgggatgtgtgctgctatattcactgcttggcttcaggccccttccagagcacttgaaatacagttggaggattctttgaatatggggtaaaagtacgtggatgacctagattgtcaaaggattctcttcaaccaaataagaaagtaagtttgggtcagcacatgctatcagctagaaagactgctcaaaattgtgtgtgccaaaataatgaaagaacgtgccaatacgtcaatccacgtttgtttcctgcccccgttcctgccacttcacagctctaaatagaaacacacgaagagaaattccaatgaaacaaaaggaatatctgaaggatctcacagctttcaggggtactgtaataccctgaaaacagtgtggttattccgggctccacaaactaggtagaaataaacatccatcattgcatagggcaggaagaacagcaaaagcatgttggctaatttataaatgtcacatacagtgttctttgtttcattgcatagggaggcaacgtaatgaaaacattaaaaaccatcttttggtgataattgttgttttaaactgacaaattatataagtcaaagtgaaataatctttgcaactccatagagaaacagaaaactattaaggcccttagaaacatcacaacccatgttcccctttcaaaggttagaataatcctgagtatattttgggaaagtaatatcctaagtcagtaaaaggtcagtgacagggaagattcttccacatcttcaggagacaaaaagtcccctggagaagagaaaccaggttccctggtgacattccgcagaaatctccagctgttagaagaacttggatctccgaggccacccaaacttcaacttaagaatgcaacaaagtggggatgaaacagttcccgggagggaggaggtagaataaaaatggaagcaaagctaccctacagcactaatctgtaaacctgcttcaattggcaagaaaaagaggaagtactacacatgcctgaaatgacaatgtagcacatggaatggacctctgctgttttcgatgatccagcattcctcctgattttcctttgggagaatcatttttcacctactcacagttcacatgattggagaaggcgccttctgggtacaggcatataactaaactgaataatccattccctgacttcatctttcctgtgcgagttggtccaaggacttttgttgaaaccactggaagagagtggctttcttgacagcaggttaataagatggatggaggtaatcaggttggcaagtggctgggcaactgtccttatcaccatacaaaggaaatcttccagagaacaaaggaatcacagaaggaagtggatgtgaaagacagccagagattcccaacaatatatgattctgtaaatccaaccatgaatgaagcttggtatccccactatttgagccaataactcctcctgttggctgaagttactttgacatgcattcttatcacttgcaactgataatccatcccacgtgagtataaatgtgaagaaatcattctaagtacatccaccttaccaaatggaccatgttttgctcaccagtgtgaccccagcacttaggacaagagatgatgtgagaagacttcaaattattgttcaataatttttttaatgattatttgttaactcatgaattatcttccatattcatatcttttaaaaatgaaagaaaatcaaagcaggtttctcctttctgtctaaatcctagcaagatcaaacactggggaaaaaaataacattctcccatatctatctgaccccagaaaaattattacttccaaatagtatttagtttttggcagttatttatgaacaggtaatctatataatttaatagataaacctatttaattatctattttttctcccacaaacaggaagaccagtgtcaaaatattgagcaactctcctaagaacaaggcatgcaatctcaaattcctggttttcagaaaaggttaattggacaagcaaaaacaaggagccaacttattggggagaactggaggcctaggaaaaagaaaaggcccaactttctatccccaacagacactttgggaactgataaaattaaacatttttcaaagaccctccatttcctattaccacaagaaagtcaaaatatttctatcttttaatttaactttatcttgcttttctttttgaaattttaatttagggcaatatttctgagggatgctatttttttttaaataccttctttccttcagctaatgtaaaacaaatagttactcctggaaattactttttactattggttccaaagctacaatttgcagcaaataaaaggactcttcccttctacagaaacattcagacaactacatattgagaggaaggtttatgtgtacttggagcctttgggtgatgttctctttggccatatgatgtggtactcccatcagcctgccatttagtgactcctatcaaagcaaacctctctaaaaacagacacttcaaagaagatgactaattgtgggtgccaactggatgctgaattgctgaatttctgaatggtttccatctcattttccaaagaaaatgtaaaatttcagagtaaaattgccacttttcttttttcacgatgtagtatttggtggcttttaaattcacagccttctattcttggaattttttaaattttaaattaactttccttccttcattccacattcatgcattcatttagtcattcattcattcgtttttttggagacaggatcctgtcctgtatacagcccaggctggaatgcagaggcatcattacagttcactgtagcctcgaacttctgggctcaagcaatcctcttgcctcagcctcccaaatagttaggattataaccatgtgccaccctgcccagctattttttttttataaatgggatctcactatgttgcccagatttgtatcatactactggcctcagtgatccctcttgacccctcagatcattaaacatttattaaatgcctttcacgtatcaggtagtgaaccaatgctgagaacataatcatgaacaaaaatccaaacagccccagtttttacagaatatccagattagtaggggagacaggtattattcaaacaagcacataagtttcttaatacaacaaaaggcgcatggctcttcaaatacaagtaacagaggaatgaaactgagctcaggaagtcaggagagctagttaagggagtgaaaatacgagttgagagccaggtagtaaataggcctagaagaagtatgggttttttgtttgtttgtttgtttgtttgctttgagatggactttcattcttgttgcccaggctgcagtgcaatggcacaatctcagctcactgcaacctccatctcccaggtttgagtgattctcctgcctcagcaccccgagtagctgggattacaggcatgcaccaccacgcctggctaattttgtattttttttttttttttagtagacatggagtttctccatgttagtcaggctggtctcgaactcccaacctcaggtgatccgcctgccttggcctcccaaagtgctgggattaaaggcgtgagccactgcaccaggactgaagtgtgttttgttagaataagagaaagaaagacgtgggataggggcagaaaaaatgttgggaaaacggaaagaacagcaggaacagagaccctgtagtggaaaaaacttagtatatgtgaggaactaaaaggcagccagggtggctggatactgagacaaggttggtgtgagatgggcagaggctcctccaagcaggactgtccaggctgttgcaggaaagaggtcttctgtctactagtaatagaaatgatccaatttactccattaaagaaacaaaactggatatattcaacacattttctctgtatctaacatttcagtagaagtgatataaagattgctaccacatattctgcttgcttcacctacatcttactgtatgatatgggtaacgaataaaacacattccccctatctccattctgtatgtatataccattattttatttcatcatggtatctgaaaagcaattataaatcatgattacagcagctgaaatttgctgaagacttactatgagcacggcattggaccaactactttctgtccatttccacactaaaatcagctacaaccttaaacagactgtcccatccaaagctagcctctcaggttgaaagatcatgatggattatgcagcagggacccaccattcccagactggtatcttagggtccagattccatccatcaggcacacctgggaagaaggcaacctcacttggccttctattcaccagtgaatctcaagtatctctaatgatacttgtggtagtgcagttttctgagtcagccaccctggtatgaattagactgggtaaagtgaatgttcatccatggatgcagctttccattttttagtggcttataaccaaggcatactgctcttaggagtttatttcagagaaaaaaagtatgaacagccaccatccttaaatgtacaaccttttctctgcaacagcttgtccttaaatccaggacacaggatgacaaatgggtttccctgccaggtcctgagaggtctgtgggaaggtgaggcctaggcaggagtggagatcaacgaagcatgaaatggtggatgtttccggggctgcagaattttggagaattcctcacgctgtctgctcaactggtctcagttctcagtggactctgtggggtcaggaggagccctttctctgggttttccctctttctccctcagcagagaaaatcgagaaaaggacattaaattcagtgcagtcactgtgggtgctaaaatattttcaggatcaatggtggtgctaaactatctccatgtttctaatatatatatatatatatatatatatatatatgtttttttttttttttgagatcgagtctcactctgtcgctaggctggagtgcagtggcgcgatcttggttcactgcaacctccgcctcctgggttcaagtgattctcctgcttcagcctcccgagtagctgggattgcaggcatctgccaccacgcccagctaatttttgtatttttagtagagacagtttcaccatgttggccaggatggtctccatctcttgacctcctgatccgcccgcctcagcctcccgaagtgctgggattacaggcgtgagccaccgtgcctggcctgtttctaatatttttaagactgaagtgctttttaaaaagaaaaaaaaatcttatggctacaccacaaaaatgcagtgtccttgggtaagggacccacccaagccccttggccttttactttccaggtatcatttttccctttgatagtactcttgtgtctgcaaaaaatgctctgtcttgatatgctcctggactgtaagattttgattgttttgttttatattttgtttatgtttatatgcatcttatatttccctgaaaactaattaacactgttggcctttctaactggaaaaaaagtctattatttttatactagtgttacaaaacagaagttcagagagaaaatataatttggccaaaatcacatggctaatgagaagtcaagttggaacctgattataaatctatttgctttcaaggtccatgcttttttttttcaagctcagataaatttcacataatataaaattaaccatttaaaataaaccactcagtggcatttattaatatcaattcataatattgcacaattatgtctatctagttccaaagcattttcatcatcctaaaataaaacgccatgcccactcagcagttatttcttattttctttttccccagcccctagaaatgaccaacgtgctttctgtctctatggatttacttattctggatatctcatataaatgcaatcatacatttgagtcactacagcagttaacacagtgcctggcacgtagtgaattttaaaaaatataggttgactgtgtgaacgaaaggataggggtggataatgattaaaccaccataaaatcctgagatattgttctaatatccactgcatgctctccacaaatgctccttcgaattttatcttctgtgacgatgacactatgtcaacctatccacagagcccagcagtgttaatgccgcatgttaataaaacacccctctttccccacagagctggatttttataaaatgaagctttagaatctagataaccaggacacagtacactgaatgtctactcctaatatgtttgcacaaagctaaactacacatattgctacctaaaatataaaactaatgtgagtgcctacagaggaaaatgtggaatgctgaatagggtgaaccccctgctattagcctggaaatgatgactctgttgtgaatctgtcctacagggtatctcagggtctgagataatagcataattatatatgctaactcttcctagttataatatcttggaagacaaaagatatagggtaggagggaagaaaagttaagccaaacaaaaagaaaagactaaattatttttactcaacataatgactctttgggaagtctaaatggcaatacgagcaaagttacaatgcatacttcagaaaggagaggtaagatagaagataaaagctgtgcacatttatacacatattctacaatggacaataaaatgagaaatgcacagtttttcagaagggcaacaagaacacctctacctcctctaaaaattaggatatcaccaacaaatcgttcaccaagttagaagctgaagcattttaaaactcaatgctattaacagcatacttgatataagcagaagacagtgggtttcattactgttaactaccctagtacaacccatagaaaccatgactcagtctgaagtagcacactctaatagaacttcctgtgataatagaactgttccagatctgttctgtccaatatggtggccactaaccacatatatttactgagcatttgaaacggggctaatgtagctgaaagacgagttttaaatatcattgagttaattaaactcaaagttaaatttaaatagccacatgtggccaggtgtggtggctcacgcctgtaatgtcagcactttgggaggccaaggaaggtggatcacctgagtcaggagttagagaccagcctggccaacatggcgaaaccccgtctctactaaaaatacaaaaattagccgggcatgttggtatgtgcctgtaatcccagctactcaggaggctgaggcaggagaattgcttgaacccaggaggcaaaggttgcagagagctgagctcgtaccactgcactccagcctgggtgacagagtgagactccatctcaaaacaacaacaacaacaacaaaagccacatactagtagctactatattagagcaactctatcagatattaattagtaaagaatatagaaatactctctagcatagtttacctgcatttcataagggcaatcaaaatagctttaagcatgtgtagtacaggcatacttctcaaactttaaggctgtgtgatatataaacaaacacctggcaactgccatatggaaacggacaaacacctaggtaggtggggtagagatggaacaaagtggaaaaacacaagtcaggtaagtaaaaaagctcatcgagggctgaaatgtcccaaagacttggagagtcaggccttcctaggagctttccatcttacaaagctgagtattggcaaatgttaccagagagatttagcacgaggaggaagctggtttaatgaaaagagctgcgtcaatcatgagccgatggaagtcctgctctagcctttggctatcgagccataaaatccgttgcttggaaatatgaaacccttttggctacttaatgttttctccaattcctctaactcagggaaaaggatcatggaaagaaaccaaggagggcaaagcaaggagaaaggccagaaatccaaagaggaagaccagaaacaggaagaaaaaatacaacataaaattgtgggagaaaaaaaaatgctcatagggagactggatgctcccagggtgaaaatgatgaaaaatctgtgcgaaagagcatgcccaagcagttagcaaagacctttgtgaatttatgtacaaaaccacaaattacacacatgcttcccaggaacaacaaatgctgcccataaaaataaatacctgccattaaaataaataataaggaggggaaggagagagagggtcagggaaataatacaataagccaaggttaaaaaaaaaaaaaagctagaagaagttgaacttgacctagaatttgatagtcagttacttaatccagaaaaaatgaaactgccaggcaaaagtactagcacaactggctatgaaaaaaactaaaggcattcacaaaggtattggtaactcgtcttatgatcagtttctccctaacactaaagtttccaattaaaaataaaaaacaagtgaggtaaaaggaatgattctaactatagtcccttcgcatagaagtaggtcaaaacagaagaggcttactgggatggggaaacagacaaattccattttgtaatacaccatggagaaaggtgtttattgaaagtggcagctttagcaccattgttttgcactctgagattagtgatttttgaatcacctcctatggtattacttttactgtgcatttagcaatgtcagctgagatataattatgccaaacctagtgatatgatcatctacctttcaggttcagctaaagagttctcactccatcaagacttctttttctctgaaaaggattcccactaaaatactgtcatttcctttgctttgtcacaatcacattttggtataggctggactgggtcagtgctgtgaatctgagaggagataatgtacttcaagtcccaaagtattttgagttgctggtatgccacataggattacaatcacaaaagaaagttaatagtgtgactcaatgctgagagtcctagctacgggaaagtgagacaagattggtttcatacctggcagcactagaatttaacgttaatatgaagtgtcctgattagctattatataaaacactgaaagaagaaatttctgttcaggaggtattcagaagaactgaggaggatagctggctatttagtgccagagagccaagtcaacttccaatccccatgggcttcttcagtgcacatgacctatggccaagccccatctttttatttcacaaatgttaacttcccaaatgggttagcaagggaaaactatcattattataaagaagcgcagataaggcagacacaatggctcacacctgtaatcccagcactttgggaggctgaggcgggcggatcacctcaggtcgggagttcgagaccagcctggccaacatggtgaaccctttctgtaataaaaatacaaaaattacctgggtgttgtggcgcacacctgtagtcccagctactcaggagactgaggcagcagaatcacttgaaccctggaggcagaggttgcagtgagccaagatcataccactgcactccagcctggacgacacagcaagactctgttggtggcggtggggggagggagaaagaaaaagcacagatatgtcaagtcagattcacttcatcaactctaagatttaaataatactaacactttactcactatttaaactacgttgtttttcgtccattagctcttcctcagcaatctgatcccatgtgatatatattgaagaaagactttcacagatcaaataaggtagggaaattctgaaaactaaactgtattcctagaaatataccatggtatgagcatattaaagaccctgagaagttctgcagtaaagaaatctgatattgccctctgtattctcctaaagcgttttagcttggggacgattttccctttgttctttatataaaatacgtattaccatctcatattcagagccctataaaatatacttcaagaaatactgaggggccccttaattacactataagactcttaacatacagtaggtttgtaaaaagatagtaaaaaggattaaagattcctcagaattagcttttcatgggcagcaaaagaagtgagaaaagaatggtatttattgctacctaccacgtggccgcattccattaggcgcatttcagtctcagtaaatcaccgcaacaattctctagtaggtatcattattctcttttatgcagaagagaaaaccaaagttcatagatgccacacagcccactcacggtcccagagttaagagacggcagggcagggatttgaaaggcctgtgccctttcccctatatcacagtggtgtaatcttttcacactatgcatacttctataaagcaaaaccattttgaaatatctgtcctgtgtgacatcacaatattgttaatggtttccttctgtttccagttgtctgcttagtataatgaaattaaaccattaaaatggaaatggaacttgttccgtgaccttccctttgtgagaatatgccaaattaaatcaacatgggatttttggaggatgtgccatttttttttaagaacagggtctttctgccaagacaggaaaacttataagaaattcaactacctagctacaggacctcaaatattaggttataatacatgtttctgtaggttgtaagtgtgtaaaaaaaaaaataggttccttcaggtttaagaaatccaaggtcatgaaaacaggcatctggccccagctagaaccctggtctagaacactaaggaaaagctaggccatctttcatttcttcctgacatcttggtctctctaaacgggttctcttcgttctgcatgctacatgaaaggaaacagctaccattaattccccagtattgctctctcctcatatgtgaggtcaaatagattcaagatggaatctgaatgacaattctaaattctctgaggaattagagcccaaccttggaggcaatcctccacggggactatatgtaatatatttatgtaatgtaaatatggccaatggaaattacacagctgtaaccacacaaactgggacaagcagcctctggagagcatggagagcagtggtgtttaggccaccaaaacagcttatacaaagacttgacaaaaagcacacaagctcgtcaatggaaaatttatgagataatgctgaagtgatttttaactaggaagatcacgggcagcaaagtgagtcaagttttaaatgaaaagtagaaaaaatataccgtgctgttgcaacaaaaataacccaacttgtgcttatgctgaagttataaaaaggagaaagagaaaaacttcacacctgcaacagcatcattaaaacataacaggatggtttgggtttgtcagaattaagggccacctgctgttccacacttcaccctcatcccaatcccagtccctgaaagaaatgaaaagaaagctgaaggaattttcatggagacaaaatcgagcagagactggatctgccaaagactatttttctagtcttcaagaaatatcctgaagtactgtttctaacagcttcattttaaaaaatattttagctctttgtttgtcttaggcattcagaatataaaatgtacattttatattttaattctctgttagaaaaacagggcatatgttgtaaaaacgtatggaggtcttcctttataatttgacgttgatgctttttcacagataagcatttatctttcagaatctaaataaaatgccatatttaaattttggaattttaatctgtatctggaagaaccaaacagaattttcaccatctctaaattactggattgcaagattaaagaatcaagtactttgatcttatttaacttgtacagtactcacaaaatttaaaacactgcacatattttaaacaaactaagtaagcatttacttatatttgataatctggatatttttaaattttctattttaaaatgaaggtgagtaggaaaaattacagtctctttaaagtaccatgagttaaactgccacattgatggtaccatttaccaaccagctatgagaagtaacaaaataaagttgcaccaggaatattactattactctctacaatcattacacagattacaaatttttttaatttttttttttttttttttgagactgagtctcactctgtcaccaggctggagtgcagtggtacaatcttggctcactacaacctctgcctcctgggttcaagcgattctcccacctcagcctcccaagtagctgggattacaggtgcccaccaccacatctggctagtttttatgtttttagtagatacggtgttccaccatgttggccaggctggtctcgaactcctgacctcaagtgatctgcccacctcggcctcccaaagtgctgggattacaggtgtgagccacagtgcctgaccccagattacagattatcctcattttacagatgggaacatctaggttcaaaaaggtaaaggaatttcccaaggatatatagctataggctaggattcatggcctggtctaatgtcagaagcaccccctattaccactggcatcaacagaagaccagagtagagtttaggttgttagtaaagacatgtttaataagcacaaagcctcttggtaataattaaaattgaaaatcttcatacagatttgtgatctggtctcacaaagtgaaaagctcaatgcatttcttttgcatttattgactttaattttcatttccatagctctttatagccttcaagatattgtcacattatctcattctgacagttatatccttcatattttagcatttattaagttgttacatgtctgactccaaaagaaatggaggtacaccctcctatatatatctctacctgtgatacatcatagcaatcaccttatgcatgatgctctgaaaaacaaatccgaaatatgcaacagcctagataaatgggatcacaaaatccctggtggggacttttaattatatgctaagtaagaggcaggttatgcagaactttctgaaaaaggggcagagggttttcagaacgatatgagataacttctaggctgttgccatggcacttgtaaactgtcctggcgccaatgggagtgtctttatgctaatgagcaatgaaggcaactagaggttgctttcctccccacctggtagttttggctggcttcttcactgcatctgaaaacgggattgactaaatcctgcttctattagtgggaccatgacctgaaaacaaatcctacaggcctcctacctcaacaaggcagcatcaactgttctcacaataaaccaaatatcaatgattccatgatttggtgagagcactgcctattagcatctttaagtagcacaaaacatggcagcagacgctctccttcatattaggttgcatctagtcactaggcaaaatcttggttagtttcctttcattttaaattttgctcagaggcccagtgggcacagtggctgacacctgtaatcctagcactttgggaggctgaggcaggcagacagcttgagccccagagttttgagaccagcctgggcaacatggcaagttcctgtctctacaaaaaaatataacaacaaaaaagtcaggcacagcagcacaaacctgtagtcccagctacttgggaggctgaggtaggaggatcacttgagcctgggagcttgacactgcagtgagctatgatggcaccactgcactgcagcctgggtgacagagtgagaccctgtcttgatcaatcaatcaatcaatcaatacttgtccaaatgagttgttagttcctccttttattctctataaatgctgccagtcgggggcagtgtgtaaaaagcagaaaaacaaagtcaaaaaataatggagggttaaaaaaaaaaaaagaaaaaaaagaaaaaacaatggagggttccactcctttaaaagatattctgtccatgacaactccccctctgcccatttcctgaaagaataaaaaggatatgtagttctttctctctgacatcttctgaataaagtatcaccttcaattcaaacaggtaaaatatcttgaaaaagtggtcagaggagctggccaggcacggtggctcacacctgcaatcccagcactttgggaggccgaggcgtgcacatcacttgaggtcaggagtttgagaacatcctagccgacatggtgaaaatccatctctactaaaaatacaaaaattagctaggtgtggtggtgcatgcctgtaatcccagctacttgggaggcttaggcaggagaatcacttgaacccaggaggcagaggttgcagtgagctgaaatcacaccagtgcactcaaatctgggcaacagagtgagactctgtctcaaacaaagaaacaaataaacaaacaaacaaaaaaataaaagtggtatgatggaggattgttttgaaagtgttttgttcaatttgaagtcaacaccgtgactaacaagtttgactgacagtgtccctcaatcagacacacttagaagctccacagacttgaccagaggttccacagacattctgggtacttcaaaaaatcacaccacaggctcaagtgtgccatgtcacactcttttcaaaacttgacaatgccaagtcaatcaaggaaactgattaagtgatgccgacaccctcttgcctccccagaatccctttaaaaccaagaccaactgtgtccaatctctattagggccagtaacttttactaagaaaaaatatttcctactgtggcccagatcctgatgacagtcaacagcgttaacgtttttactttttaattttagactagttttaaatctacagaaaaattataaagagttcagagttcccatatatgccacacctagtttccactattattagcaacttccatatatgatagagttgttacaatcactgaactagcattcataaattattatttatattaatttatttttcgtttttttttttgagtcagggtctttgccactcaagctggagtacagtgacgtgatcagagctcactgcagcctcaaactcctgggctcaagtgattctcctgcctcagcctcctgagtaactcggattaccgggcattatcacacctaatttgttttttattttttggtagagaccaactcttactatgcttcccagactggtctcagactcttggtgtgagctaccatgcctggcctctgagacattactattaacaaaagcctctattttattgggatttccttagttttcaatctaatatgctttttctactccaggaccccatccaagataccatattaacataacttatgttgcttaagacttttcttagttgtgacagtttatgagacctttactgtttcttatgaccttaatagtactgaggcaagtatgttgctgaagtccctcagttaaggtttgtctgatgtctttctcatgattgcactatgtctatggttttttgggaggaacaccacaaagataaagtgccatactcatcacatcatagcaacgtccatattatcaacatgacttatcaccgatgatgttaaccttgatcactggttgaagtattgtttattcaatttttgcattctgaagttactcttttttcctcctttttaagctgtacactttggacaagaaaccacgtgtggccgacatttaagatgtgagagctaggctccagctccttgcagtatttatgagaactatccggaattctgctaaacagatttttcaattctacctcatttatttgtttattcaatcatttatttccatccctatttattcaaatctttttttatattttgggttataattcaatagtgtttattctgctgttcgaagcgacccatctttggcgcttgggaactccttgagttggctcctatgtccctttaacacactcccattattgtgatttattttgttgtgttttctgagcactgtcttacttcttggcactataacgtgctccaggctcatcatgtatatttcttgctgaagtcccagaatttgccatttctccaaagaaccttggtttcttttattgggaaatggaattagaaacaaagatctgggtgttaggtgtatttgttgctcccacggtttattcgtgaagcagaaatgtaccctggttttagtaaatgcagaatgtcaggtatccaccatttacagcgtcaaattgaatagtttcatggtgtggggaaaaaaaaaaatcgcatgtttcacctattaaacctcaccccagaaccttcagtaacaatgatttgtttaccatctccatggttttgtctttaccagaaagttaataaagttgcatcatgcagtagatagccttttcagactagcttctttccttagcaatatacatttactattcatccatgtttctatgtatagttcattcctttttattgctgagtaatgttccattctacagatgtaacagagcttgtttattcattcacttattgaaggacattttggttgtttccagtttggggaattatgaataaagctgagacaaacattccagtgcagggttttctaatttcataagttttcatatcagttgggtaaatacctaggtatatgactgctggattgtatggtaaaactatgtttaactttgtaggaaactgcaaaactgtctttcaaagcgcctgtgctattttacattctcataagcaatgtatgagagtccttgttgctctacatcctccctattaatggtattgtcagtttttggtatttggtatttgctctacatcctccctattaatggtattgtcacacaccagtggctgtgtgatagtatcatcttgtactaatttgcaactctctaccaacatgtgacgttgaacatcttttcatatgtacgttttccatctgcacatctttagtgagctatgtattcagatcttttgatcatttttaaaattagcttgttttgttttcttactgttgagttgtaagggttctttctatattatggatacaagtcctttatcagatttgtattttgtgttctcccagactctggcttggcttttttcttcatagtgtcttttgcatagcttaagttttcattttaattaagtgtaacttacgatttttttcatgcattatgtttttggtggtgtatatacctactaacacattaccaaatacaagatcccagatttttttctagattttatacttttgcatttcacatttaggtctattattcatttgagtttttttgtgacatatgcaaggtctttgcttaagttcatatttttacagtggatgttcaactgttctaccaccatttgttgaaaagttatcctttctccatgtagtcacttttgtgcccttgtcaaaggttgactgaatttgtgtgagttagtcaactgtttttcaaaaaggctcagcattttcgaaaatccaagaaaacaggaaggtttaacttgaagccaagagcaacttgacagtggcagggcaatgtcatcactactgtgtatgtaggtcaaaccaagaatgttacacagtcataacggaggtgggctgcgtacagaacaccctgcatctcctaaatggtttataatcactgattaatcctctgtgagtatagacgggcctcattagctctagtaacaaggaaagacagtgttagattgataaagctaaggttgggaaagagaaattagagcagaagagctgtaaaaaggatggaaagtgccatgcccgcaaactttgtagatggatgtttttattgtatttgtttttttttttaacaaataccaccatcttttcattttcttcctatgttctacactccctcaaattaggaggcataagatatttaaattcaaatgggagctttctactctagctcccactgatgtgtatttcttattaaagctttgtgattattttgtattttaccagttcatgcccgtagagtgttgaggcctattttatcaaaactgaaatagctcgtgattagagcttacttaaaatatgcaaaccaagacaaggtcaaagcaacctttctttcagagggtcctgtgggggatcaaatggtatacattgtgattcattttcattcttcttctgtgtgtttacccatgatggccagggaacacaaaatacaagcctctcactggagtcagcgtgcaaaatgtgaaaccccctaatgtcaaactgcaatcaacacatcacaagcctgtcattaaattggcttcacaaaataaaagtgagaaaaaagacaaatgaagttaccacacgtaatacagaattgaagtggatgaggctgaagtttagaagagaagttgtcctctgaggaccgaagtataaatgcagtttttaaattaggccatggagggaaactcttggattgttccattgctggtgccctcggaagccttcacgggtttcctgtgaaacacgcaatgtaaagcagtgaatgcagaatatttgatcctatctttgtgttaatgagtcttcaatctagagagtgggtgatcacttacaaaaatggccttctgctgactcaccagccctgcctattacattcaccctgctcctgcacaaagccagaaaaactgaacaacaagcagcaaataaatttcaataaacagatttattgtcctatttcaatacaaatcacagtctattaagaataatgcactctagtccaggttctgacagtcaaagatgctgatttaagaagagaattgtgctcctaatttaattcattcatttgcatctctctcttctaagtatgatataattcagccttactgatcatagctggtaatcactcctctgttttatggttaaaattgtgcttttaaaaaattacaattctacctatttatgtggggatttttatatattatggttctaggatgaatggttattagatgacaataatgaaaaaggcaaggtttatcaaagtgacctctgaaattaccccatacattttcaaaatgatgcacctgtattacacagagcatcatagattccaagcacattttccataactaatgatatgacttggaccatctacaccttttgtcagcactgttttctgatttcaacatagtacaatccattgaatgtcagactctaacaggtgtctatgaactcagggatcttgacagtttctttcttttttttttttttttttttaccattattacattaaaggcaaacagaattcagttccttcaaaattagacattttcaacttatgtcccagctttctgttattccacctcacttttgtacttggtaaaataaatagatcacaccgtagatgctgacatgcttctatcacatattatgatattttggctttattttttagttgaaaaagtgactgtattttgtaaaattatacacaaccaagagtttaaattggattcaatgtgtgtatgctttccgctgaatgattcctttttctctgggtcttgcctcaaacaagaaaccattaatgagtagtgaaagctttggacacagattttgtgaagtttcatatgagttaaggagtgccttcatttcatccttcaaattttgacagtaactatttttataaagaaattaattcagcttttccaaacttctttacattgcatcataatatatatcacaccatgatgacaaacattgaatctatttctattaaagacaaacatgcacaatttccatctcaagtgaaatcttgagcaaggatggaaacttctcaaagaaagaaaaaatagtaagccaccttgtattcttaagaatgcagaatttcaaaatgagacatttctgagctgcctctcacaaagcaattttttttttagccgcagggcaccccagtagaagttaaaaatagattacacttctattcatctaaaagaaggacactaatatgagcactgtagctttctgcacttcagtaaaaatcagaaatgatctgcagcccggtgaataaagttgattcacttagagaacaccagcatttctctcctcacctagcttttgaaagcaagcatgagacagcccctgcctacaaaattgcagaggaattactctcaattacaggcttctgtctgttaaaaagtagagctggtgatcagtctgaccttttttctctgacaagtcaaataaatgaaagggaaaaaaaaatctgacaggtgttcaatttagaagctgggggtgggggggaaagaggagaaagaaaagaaaagcttgtattctctaactagatctccggatttttttgtattattcatcctattttaaaagttccttttcagtgaataaattgcatgtggcaatgtaattttcttaaagtcactcacctaatgttttaatttgagtatcatttactgaaatcttcccacaatcaatcattcaggcttttagtttcatactttagatactttagggcaattctgctgaatgctacaactccgccctacccccattcttccttccttcttataagtagattacaaatgaccacagaagaatgacttttctggttccctgcatttgctatatttattgcaagacatggcttgtaaacaccagcctccacattttacctgataatgcgatcattacagaattcactagaatttggtcggcattggtattatttgaatgtgaatgttttagtaatgacatgaatcgtttttcagctctctgacatttacccacgttttttcatttcaaaagagttaactactttgctaaggactgaaaaagttgttctgatgaaagttaaattctaaaacattctgtattcttcggagttggttggttaggttcttgataatccagcacttgttcagcaaaactactaattagaggtggaagccatgtatgcattgaacagttacctcttcaagtttcaaagagagaagaaggaccaaaggatgctctttcccttaggaacccatctgacctgcatttaggccagttaatgatgacttccattcagctttgaaacatgtttcttttaagtcagctacttttcagtagggaaaaactattttgagaattaatcattctcaaacatcatacagaagccaaccagttaaaataccacaatcttaaacagacctgcaaacaacatttggaaagttgaattgtgattgactgatgacatcacagaaccaaaataacgtcccacattcacttcttgctctgttatttttgtttgcttcataacagtcagaactgcttttctgagatggctgagacagttttctcagaaatgacgcagtgaaatggctaatggccagagagtgggagtgagatgagaccagaaaaaaaaaaaagaaaaactaaaagaaaaaaggtggaaaagaacaaaggtgatgtacacatacccctaaaagctggccaaaagatagttatagtaaaaattctaagggagggctgggcacggtggctcacacctgtaatcccagcactttaggagtccaaagcaggcagatcacctgaggtcaggagtttgagaccagcctggccaacatggtgaaaccgtgtctctactaaaaatacaacatcactggggactgttgtggggtgggggagcagggagggatagcattaggagatatacctaatgctaaatgacgagttaatgggtgcagcacaccagcatggcacatgtatacatatgtaactaacctgcacattgtgcacatgtaccctaaaacttaaagtataataataataaaatttaaaaaaaatacaaaaattagctgggcatggtagtgcacacgtgtagtcccagctacttggggaactgaggcatgagaatcccttgaatccgggaggtggaggttgcagtgagccgagattgcacccttgcactccagcctgagcaacagagtgagactccatctcaaaaaaaaactaagggagattttgaagttgtgtctttttcctgtgactgggaggccctgggaagctaagaaaattttattgaacatctgctttgcttccaggagataaagtcttcctgatacttccttctaatttaagtgaggcagtatcccacaattaaaaaaataaaataaaataaaaaaacaatggttcctttctccaaagagtcagccagcaatgatcaagaaaacagcacagtggtgtatactatacagctttggtaccaatgccaacaacccaaagtgataaaaaattaagaacagaatttatacaaaaataatgcttaaacacatgttttattaaaagctatagaaaaagggatacatttgaaataaaaatagcagtattttctgctttaataaccaactgttgactagtctcgtacttagaaaacggcaggttgtcacctagtgaactactcaaaaatctctctaactagcaagataaaaagcagtatttcaagtccactgaactgaaatgaacataccatacgaacataatggcagtgtacattgctcacatacaaaaccacatcataaagccgtagtgattagaagggcatagtgaccaaagcatgatcctctcctccagaaacagactcaaacacacagaaaagtagtatttttttatatgacattgcaaattcatgaggccagatgaattaatcaacaaatgttattttgggaaagtgaggacattgaaaagaatgtgaaccctacctcacaccttatcccaaataaattggagacagattaaagattaaaaattttaaaaataaaaatgtttcatttaaaacataaagcattgaaaacagcaaaatgatttaaaatacttttaaaaagtcatttttaaacatttttacagtgggagaaacccaaaagaaaagactaacaaagccaattacagaaaatgaaaagttcagataatacaaaccaaacagaaaacaaaccaaaacacctacaatcaaaaaaataaaggtaaaaggctgggtgtggtggctcacacctgtaatcccagcactgaggattggagactgaggcgggtggattacttgagaccaggagttcgagaccagcctagcaaacatggcgaaaccctgtctctaccaaaaatataaaaattaccaaagcatggtggtgggtgcctgtaatcccagctactcaggaggcggaggcaagagaatcgctcgagcccgggaggcggaggttgcagtgagctgagttcacgtcactgcactccagcctgggcaacagagcaacactatgtctcaaaaaaaaaaaaaaaaaagttaaaggatagacaggcaaaagttcaatggcctttgaaaaaggtaaactgagggctgctgaaagccctaaagcaaggagacaaatgcagatgtaggtttaggactcagcatgaatgctgtggctggagacatggggtatggcagatgcctttcatgaaagccaacagagactcatctccctacctcccaaatggctgtggaggagtttccgttctgtgactctacctctcctgtatgggtggacacgtaaccagaggtaagcatctgatctatgaacaatcaacacagagattgagttgagccatgctctctacagggcattcagaagtaaatgggatttccaagttcaattagcagagttgcctgcatctcatatttgacacctttaccctacatgctgcttacctgcccaggatctgaacttctggatatgtatctttatttcaccccacactctgagtcctaactttctaccctctaaaatgattccaccaccatccgtgaaagcagaactgataactacaggctgcgtgactcatgtttggttttgacttttcgtaaccacgatccacattaagagctttttcaaataattgtttataggttatatgaacttcataattttgaatgacacaagtttctactgaagtgattggtctgccacttccactgccagtgaaagaatattctctctgtgttcttaaaatcattcattctaaatgacactggggtaagatgaccgaaaactaaagggatgacattttgcttaaaaggtagaattgtaaacaccagactgcactcagaaaaatggagatttctcaaaatttaaaatcctcaaccatgagaaggataattaacaaaatacacttcagaaatatgaacacttagaatgcacttagtcactttacgagaactactgtaatcgtgcccaagcctaaatgcggatgtgagtataatcactgaccagttgcagcaacactgctgctgagaatggacctgcatcagaagacatgccgagggacagagctggtctcagcacccttaggtttcaatgcatgtaagagccagtgttcaggctgcaaaggtctgggcatttgtctttccaggctaacagaggaggagacaatgagactctacatcaatttcccagtatattctgcaaagtgataatgaatttctaaaagaaaactaaataaaaatatcatttagttggctaaagagcttccagaagaaaggcctcagaccatttcaaaaagaaaatggacaactctcaaacacagggacatagatgaggcagaaaagaagaaatatgcatacctataaccatggccttgacaagtcattttatagaaaggtaagatccaagtcttgaggcacttgctcaagcattcaaatatttctggggccaatcaagtgctggctgtggagatgccacatcctgaccctgcaaacagtttagtgggggacacaggctttcacatatatgactgtagcacagtgtgatatgtccaatgtcaggggccagtaatgagaacatgggggcaggaaaggaaggagagagtcctcacacctcagccaaagtggttcaggaaaacatcccaggaaaagaggtgtttgatatgggtgttaaaaaatgggctcgctttccaatctaaagaacttgaaagtatcatagacgacacaaatgtgaagacatccaatgatcatggattggaagaatatcatgaaaatgatcataatctgattatccaaagcaatctacagagtcaatgcaattcctatcaaaaaaccatttttttcacagaaatagaaaactcaatcctaaagttcgcatatggaaccaaaaagagcccaaatagccaaagaaatcctaaacggaacaaatctagaggcaacacattgcctgacttcaaattatactacaaagcaatagtaaccaagacagcatggtactagtataaaagtagatttataggccaatggaacagaatagggaacctagaaataaagctaaatacttaggaccaagtgatctgaaacaaagcattaaaaaacataaactggggaaaggacactctatttaataaatggtactgggaaacctggatagccccatgtagaagaattaaacgggatccttatctctcatcatatacaaaaatcaactcaagagggattaaagacctaaatctaagacatgaaaccataaaaatcttagaagaaaacctaggaaaaactcttctggatattggcctaggcaaacaatctatgactaagactccaaagcaaatgaaacaaaaacaaaaatgaataaatgatacctaattaaactaaaaagcttctgcacagcaaaagaaacaatcatcacagtaaaaagcccacagaatgggtgaaaatatttgcaaactatgcatctgacaaaggactaatatccagaatctgctaggaactcaaacaaatcagcaaggataaaaaacaaataatcccattaaaaaatgggcaaaggacatgaacagacatttctcaaaagaagatatacaagtggccaccaaacatgaaaaaaatgctcaacatcactcatcatcagggaaatgcaaattaaaaccacagtgagggctgggtgcggtggctcacacctgtaatcccagcaccttaggaggccgaggagggtggatcacctgaagtcaggagttctagaccagcctggccaacatggagaaacgctgtaacaactaaaaatacaaacattagccaggcatagcggcagggagctgtaatcccagctactcagggggctgaggcaggagaatcacttgaacccagaaggcggacgttgcagttagccaagatcgcgccattccactccagcctgggggacaagaatgagactttgtctcaaaaaaacaaaaacaaacaaccaaaaaaaaccacagtaagacaccattttaccccctccagaatggtcattattaaaaagtccagaaacaatagatgttgacatggatgtggtaaaaaagggaacatttatacacttctggtggaaatgaaattagtacaacctttatggaaaataatatcgtgatttctcaaagatctaaaagttgacctaccattctatcttgcgatcccaatactgggtttctaccgaaaggaaagtaagtcatgagatcaaaaaagacacctgcacacatatatttattgcaacacagttcacaattgaaaagacgtggaaccaacctaagtgaccataaaccaataagcggataaggaaaatgtgatatatatatatatttatatttatataattatatttatatttatatataattatatatatgtatatataattatatatattaatatacatataaacatgatatatatacacacatatatatatgtataccatggaatactactcaaccataaacaagaaaaaaataatgtcttttgcagcaactttcatggaactggaggccattattctaagtgacgtaactcaggaaagaaaaaccaaataccacgtgttctcacatacacagaggagctaagctatggatatgcaaaggcatacagaatgttataatggacactggagactcagaagggagggtgggaggggcgtgggggattttaaaaaactacatattgggtaccatgtgcacaactcaggtgatgcatgccctaaaatttcaggcttgactgctatacaattcatcacataaccaaaacctacttgtacccctaaagctattgaaatttgtttaaacgaaaaaaacttgaaagtgatacagttttaatcaaccagttactgaggatggacatattagtttattattgccgctgtcacaaattaccacatacttagggcttgaaacaacacatatttatcctatcgttttggaagtcagaagtctgaaatggctgtcactggggtaaaaccaaaaagtaagcagggctgtgttccttctgggggctctagttcagaatccattcccttactttgtccagcttctagaggaagcccacattcctcacctcatggtgccttcccacatcttcaaagccagcaacatcaggtcaagtcctgctcacaccacaacactcagacctctgcatccctcatcacaccttctctcactctgactcgcttgcctccctctttcatttataaggacccttgtgaatacattggacctacctgaataataccagataatccccctatcccaaaatttttaacctaatcacatctgcaaagcccatttggtcatgtaaggtaacattcacaggtgttggggattagaattaatacctctttgggggatcattattccacctaccaaagtgggttagggaccacacacccgccctaagtgcagacggaagcagcaatggcctaggatgtgtaacatacatacatacatataaacatatatacagacatacatatataacatatattacacatatatacatgcacacacatatccattacatagatgatatcatacatatatacaatatatacatactatgatagtaaatgttttatttgtaaaaaaaaaaatcaagcaggattatattagtctcatttcttatactttgctatgcttttgtgtgggcaaaaagccgtatggatcatgtactggggaccacaggtaagtacatacagccatgcagacaccccatgcatataaactccatccaacatgtagattactgcaccccaaatagatagatacatatatacgtagacagataaaagaactgcttttcaagtcggtgttccccatagtgtggtacatattccatttactaattcaaactttaaaattcgaaaagcagcatacttaacatgcatttaaaaatatataaccatcatgtcagtcatgatttcataaatgccacagcttggaactattctgcccatagtagtccctagccacatgtggctcttgtcaatgtaaactgtgactagtccaaactgagatgtgctataagtgtaaaatacacacaagatttcatagcattaaaaaaaaagaaatctcatttaaaatttcttattgatttgcatgttgaaataataggatacagtgggttaaataaaatgtaaaattaatttctcctgcttctgtaatatggcaactcaaaaatctcatgtgccttgcattatatttattttaacagtactggattaaaacaatgccaaagcagttgtgaagtgaaaacaaaatgagttgagctaaagtaaatattagtaaagttagcataaaggtattacaaatatcttgaaatttcaaagctaataacctatgtttggtaacactatacaacatccctggaaaatggaatccagcttttgaatattttctggaaagggtatcttagtacttccgaggttgttcaatgtagtggtagagggggtcaaatgaaaaacatttcttctttgtattgactggaaatctgaaaaacctttgtacatttctctccaatgcccttagttctggcttataaagcacagcacaaacctacccactactatccataactagctggttctggccttttgaacctttagtttcaaggctcccatgaaaccaacacagcagctttgtaacttcacaaacttgaaagaccacattgttggaggaagattcttactgcaggccctggcattccccattgatgagctgaaatcagttattatgaggttctgtatacaccttctgatgatggataaaacaaatgcatatgcctcacaggcacagcaggaattaaaaatacattagttcatcgcaacttcagatctgggattgaggaacgtttggatgacttttttttcttttcaaataaagtttagatgaggcaggaatttcactacagagtagagttctgagactctccaggtccagttcagcacttggagagaaatcaaatacatcttatcttaggtatggcactaactttcatcaaaaaattatcatatgctcagtcacaaatggttattgtaaaatctttactaacctaagtgcatataaaaattgtgaattcctaatacaaagcagtatttgacttttaaatttcattttaagcttggcccgttcacttggaatgtgattacagagtaaattaaaaagtaatcacatgtgaattacatttcctcatgaatgtaatgacttcaggaggctgattaatgttaagcagtgcctgtcctactgcatgcataccttcccaggtgagatatgcaagatagctgtcgtgagttgtttaattttcttttactggtattccagggagactgcctgaacacataataggctcagcacattcattaggactgaggatgttcttccctttggtatgctcaagtcccacgtgcaaaataccatcaccgtcaacttatggttatgagaaaagcccaagggaggcggtgcagctctggtaccattttctacctagccaagtttcaatttctcaatctctctttctatctttttggcaaattcttcatatttgaatggaataattccagagaatcactgaaaaatgcatttgcaccagtgtaaaggtaacgaattgtctcacaaggaatgaaggcttattaataatctacaacagtattactgcagagaacaaaatttaaactaagtggagcacaggatcattaacatatttcctctcaggtaatggggaatgtagcagtctaaaatatttactcctttctgtagtcaggttaaggcattgttttctaaaggagttgtcagaggaatcacgctattgttagaagtggaaaaggcttggtgcttcattatttctgtgcaaaagaagagcaaatacagtggatttagtagccagccaaggaaagccaggtactaaaaattaccttgggacaaaagttggtcttttattcctgtgattccccattccactgggaggaacaatgaactagtagagcagcctgagaacatgttacatcataatctagaacatatagacagctgatgtcatgaaactgtcatactatatgtgatgctctctgacatcatctattatataaaattttgtttttcttttttaagtttggtgagacaggctaaattgaattcaaaatccatcagtgactcatgaccatcagttagaaacattctggattgggagcctttggaatcacaggagttgagagactgccagctcacttcattgtcatttaactgtgggtcctcaaaggggaatgttccaaatgtcatgtcttcccagctttgtgtgggtggtgggaaaatgaagaggggtaatagcgagagaattaatgtcaggagaataagacagaaaaggcctacaattctgtagtttctcctaagactggcttcaggattcctttgagtttaatatttctgttatgtttttatcctgagatatttaaatttccagaacattcaaggtcaatgataagactattagaaagatttttatttaaacataaactcaaaagcactcaaggataaagaagaaacctatgagaactctgagtaggtaacctacaattcttctgtgttaaggagagagtagagagaattactcttgtgtttcaaactgggggtgtcaaacataggggactaaaaatgtgaaatataccagtatacaatataactccattgccttaactgagatgacagacactaatattcttttgttgtactagggtttttattctgcatttgttgtaccttataacatttttaaggcctttactaacccactgtgtgattcagaagagggtgatcaagaaagtgagtgacctagagaacacaccacgggataaccaatcaacatagacaaggtaagacttggacactagggatgggattaggaacagggtgtctccatccagaggacagtactgggtccaggctataaaggcagagacactggattgtgggtgctccctgacgtgctaatgagagttctgttaccaacaggactgggataatcaatttcccttctctgcatcccctttccacattttagggcctgatgtttgacagccatctaatgagctaaatgaattctacgaattctgctctaccatgttggatttgctcttgtggataatactcagcagaccactacaatttctagtgggtcacaatctacttttgacctcccccttctctaggacatatccctggcattttcctatacatgaccaaaattacttttagagaatgtaattttgtataaaatgggaaaaattaattaaatcattaaaatatgaaaaggatcctcttctaacaaggtctttcctctacagggcatccatgctttgaactctagggacagcattaaactgaagcaccagtgtctttcttctggaatcagaatccctttgttgcttttgggggaaaaaaaaaaaaggctgtcattgaacttttaattaggttccaaaaatgtgacctgaggcaataatagaatgatttattttaatgctacactgctcttgatgatattcggttaaaaatgggccagcctttgaaacaccctgacaccacacactggcatctacaatgttgaggctactgattcagttttatttcccaagatgtctttctttactcctttgttcaaccacccatccttctgtccattcatccattcaacaaacatcaacatttattgccaggcattaaggacagacaagcaacaaaaataaaatggtccctgtctccaacagaacttactaaagttcagctgggaagacaaccacttacccaacttaaaatagaacaacgtgggtggaaagtactcagtccaatttaaagagaccataatatctaagttttggtctttactgctccctctagcctgggttttatgtttggtttagccatttaaccaccactatgtataacaacacgtatgttccactgctgattttaccaacagaggccagtctcacggtgggaaacgtggctcccaatggtatcttatataccaaatgatcgtctatggtagatttcaatcatcattctaaattctacattgtgggtttgtatttctgagtgccaatacaaaccacaatactatctattttttaagagatggggtctcactatactgcccaggctggccttgaactcctaggctcaagtgatcctcccacttcagcctcccaagtagaatatcttaaagtccagggccattcagaggaagagagatgctacactgggtagataatcagaagaaaagaatcatttaacaaccaccctaccccccaaaaaaccctttctctctgcaaaatggaagggccatctagaaagaaacagaatcattcatacatatttattttaaaaccaataattaaccacctattgcagtactgaagttcatggcctacatgggatttattatactgattagtccacttctgtgtatatttaacctatctcataactttttttaaacagtcaatactaataaatagctgagttcatctaaaatatattggatctaagactacccaaattttcctcaaacatcctaactagaccccagttaaacttcttttggagtctcagggagaaaaaaaaaaaaatagaatgctttagaaattcttgattgaattttgttacattagctcagcataagcattacagccaccaaaaccactcttaccagtaagttctccatagcaagagatggctgcctgtcccaggattgcccacatatgtcttcttaggatactccaggaacaaagaggagaaaaataatcttggaaattctgtagactgttttgactttttaacccattcattcaatccataaaaatgaacaaagtgctataatgttacagtggaaagagcatcttttcagaggaagatagctggaattttagtcaagacttcgtcactaattatcattgtgcctttaaagcatatcacttcacttttctggaccacatttacttacaagaaaaatgaggaagttggaccaatgacctagtagcactcgtttctgattctcagtctgaagtcaatggatgctattaacatggaagtattttgaagctgcatttcctgcaggggcaaagcaatgcttcctccacattttcctgactcctttcaagttctcctagagagctcctaagacaattcataaagagaaagggggtactgctgcccaagcacacatcctttgtcacggtgtgtggtcaggcactagttggcattaatttacttgttcacagttgtacatgagacattattggtagagtagttatggttgcctgattgtggatgtgtaactaattctggaaaaggatgctataaagttacaatccaaacaatctcagcaggtgtcactgtagtcaggagaacatatcttcacaaatactcattatttatttatccttaagtaagagaaggtccctaccagccagcctaaaagtactgagctctgtttcccatcataaggccaagaatcatcaactttgtaagatcaaaagggggttttatgtatgctctgtcttcgtgcaggtctaagtggagccatgacaacctgaggcacatttgtagatattttttcaaggttataggcagaatggcactccatagcatcagtcagaaagctactcccatgccctactttgtctatgacctcagctttatctacttttatttatgagtgtggagcttaggatttcagtgacagaataatttgtttgacacattacagttaaaaaaaaaaccccaatagaagtacatagacatacacacacacgtgtctgtaaaattggtaaaatctgactaaactctgtggattgtaccaatgttaattttctagttcttacatgagactatagttactacagttaagcaagatgctaactatagagagtttgcatgaagtgtgtgtgagtctttgcatttttgcaactcctgtgaatgttgaattatttcaaaacacaaagttaaaaaaaaatgacaaccaccaaataattaagaaacctataccttcaaaagcaagatttaaaaagtaattgtaaaagttcaggaatagtgtaatgacacggttcatcatcagtgaacacctctccttcaaaaaatatttgtatgataataaatatccctcaacaaaggcatgtaagtcaccagtattcattcccaggaaataaggactgtctctttcaaaaatatttagaggacctgagatgacccttttcccctaggtcacaccaagagtttttatcactgaaagctcctttttgcaattcatagttttgacaaaaaagattttagtgatgtgtctgtgtctccagatgcactgctctgtgcaactatataataactattacctggtcaacctatgtcagcccattggaactgatctttaagaacacaaaaacatatatgtacacactggtatgaacagcaaatcattcttaaaatatttgatttagaaaaaaatgcaagagagatgatagttaatatccacaaaaggcaacacaatttcacaaatagacaagaaggggacaaagaaaaactaaaagaaaaaaatgggggcaaagacaggaacaggaagacaaacttcgcatgttctcacttattagtgggagctaaaaatcagaacaattgaacttgtgaagacagagtagaaggatggttaacagaggctgggaagggtcatggggaggggggtgaatagttagtgagtataaaaaatagaaagaatgaagaataagagctagtgtttgatagcacaacaaggtgattatagtaaataatttaattgtacattttaaaataaaagagtataattggattgcttctaacacaaaggaaaaatgcttagggagatggatactgcatttacattggtgggattattactcattgcatgcctgtatcaaaatagctcatgtactccattaatatatatacctactatgtacccgtgaaaatgagaaattaaaaaatgggcaaatatatggagaggtattttatttattttattattttatttgagacaaggtctcagtctgtcacccaggctggagtacagtagcgtgatntcagctcacctcagcctccaccccctgggctcaagcgatcctcccacctcagccttctgagtagctgggattacaagcacgcatcaccatgcccagctaatattctggtttttttttttttgttttgtttttttagtagagatggagtttcaccatgttgcccggactggtcttgaactcccgggctcaagcaatcttcctgcctcggcctcccaaagtgctgggattacaggggtgagccacccttcccagcctgaaaaggtatttttaaggtgggacaatataaaaagccaataaaaatgaaaagatgctcaaatttaatagaagtcagaaaatgttagagaaaacaatgagatgtcatttagacctaatgcactaatacaaatgaaaataaggggaaatacctgctctggatttagataaatggatattctgatacatggtagattaaaatatcacttttaaggctttatgaaatgtaatgtaacaatacctatcaatatttaaaaagtacattttcttaaatctagtactttcatggctgacaatctatcccattaaaagtaggttattagtgagaccccatttctaccaaaaaaaacaaaaaaatctggccaggcatggtggcatgcaccagtagtgtcagctactcaggaggctgaggtgggaagatagcttgagcctgggaggcagaggttacagcgagccaatatcgcgccactgctctccagcttgggtgacaatgagaccctgcctcaaaaaaaaaaaaaaaattatatgagctttttgtacagtgataagacaaaacaaaaccacacaaaggctggatcccaccagcagaaaatgttttaaaattatgttaccgccactggacataatgaattagatttatacagtagccttgaagggatttcctcaaagaattattgaaagataaaagaatgagtaatattccatttttgtaaaacaatgactgaaaaatctctccagatatgtatatataaatacacgtatgtattaacatattagcaggttgacaaatacacaagtataatcataggtcagaacgtcccaaattctgcatcttggcacaagtataagataataacttttatctaacactggggtggaaagataaaggttgttcatcaccagaaatgatgagccaaaggatagagccacctaaaaagcagtatttgagcaaaggagttggggagttcaaaaggaagttgttgcctgaggaggattctgggagcactccaggaagagggaggatagagcatggtggatgaggtgggtcatgtgtacgggaatgggatagtaccgagtgaaaacatgggaacaaaatgacgcaaagttcagaaatacacatacatacatttacatatatgaatacgtatgtgtattcttgaatttcatggtcatatttatgcattttcggtgaaattgtgtttttaaaacttactttatgtcttaaaaataacacttaaggctgggcgcggtggctcacgcctgtaatcccagcattttgggaggccgaggggggcagatcatgaggtcaggtgattgagaccatcctggctaacacggtgaaaccccgtctctactaaaaatacaaaaataaaaaaaaataaaaaaataaaaaaattagccgggcgtggttgcaggcacctatagtcccagctactgggaaggctgaggcaggagaatggcgtgaacccgggaggcggagcttgcagtgagccgagattgagccactgcactccagcctgggcgacacagcgagactccgtctcaaaaaaaaaaaaaaataaataataataataataataataattataacacttaaaaatgagcccaggtagatgatcttccagtaatttctcccttgattttcttgttcttgctgctattaaaatcaagagggcaccatatttctccctttgctcttctaagatccagtacttatgataagaaaaccatagtccaacacaccctatgtaagttattctgtgtatctgagcttcagatgtaaaggagctctttcagacttcagggttatgagagtttctgaatagccacctggcaaatctgggtagatgttgactttcccagcaggccacgatttattgccaaaagcacaatttttttcttttgttttgacttaacatgccagaaaaaaaacacaagactataagaattaaacctaatgcatcacagctaagctctctaaggcatgaaagaggcaagggctgcaccaaaacgaatttatcaatcacggaatgcaggaccccttgtatgattagcttaattatttaaagaatgcaaaagaggtggacggttctaccattaaattatcctgtttaaagaaaatgccaactcggtaagcatttctaagtggacaggctatttcaatagagtacattgctgaatgtgtgtgtgtgtaataataaaagaggctgccctttaaaaatccccacaccacgtacttttattaatttaatttggtgtccactgtactttttagttcgctccagttgcaattactattctagtttaatttcacatatatttgcattgtttcatggaaacccttacctcggtaaagagtaaaaatagatacctcccactagacccacctcaaaaggatatatgtgtgtgaaaacatacatacacaactaagtgggatgaaagtgatctttagagatatgggataaaggaaaaaccatttgaaaaaagtctcagaacactcctaggaagaccatatgtacttcctcatccagcaaagtgctatttcaaatgtgttaaataagtagggagtgtgtcagtgtgcgtgtgtgtgtgtgtgtctctgtaccaataaacatccagaaaaaaagaggggaaaaagtcaatataaaaatttagaaattagaatatttacttttagttaagaaaatttctagaaagttttattttgatatacaaaatataagacagccatctcaacaatcgtgtccagtcattcagcaatcagccaccactgacaacctacacctttccttcctttcaataatggccttccaacagacctcgaaaggcttctatatgggtcacttttcttactatatctgtattttttttccaaacctaatcctgtttgttctgaattatactgagtttctgataaactttaaaatgtttttcttagatccagctgcactaagagtataaagcgaatttagaatcaccaccccacagtccccccgccgacaaatcatactatttaatatggcggtgatgagaacaacgtatgtgactaccgtgacactcaataaaaatgctatgatttgctttttaaaaagtcagaaacctatagaattcgtatgtgagttccactcattgtttctataaaaaggtcattctgatatgttttagggcattgtcatgagaatgtgtgaaaaatctataggcttacaaaacatgaaaactcaagatactggttggtaaggacatggtaggggtaatgtattcttagaagagaggctgcatcatttctgcagataaatttgaaattttcttcatgcaatttggaatgtaatctcttactagattaaattttacagctcaggaaggtgaggagctggtaagagcaaactgcatgagacaagagtatagatatccaacaaacaatgaggcaaccaacctgattcacttagtacttgacagcaatgcttttattagaaacactttacttatgacctattaccagtggttcctctactattgggatacatttaaatctgtcattttaaatgtgtttacactttttctgtgtacaagaactgctgacaaaggcaagcgtgatatgtcatactgatgacgtgttaagctgaggaaatttccactgccacaggcaacactttaaccttatgaaacattttaatcacatttttattgaagaagcttattaaaagatgcaggctttcagaactcgacaaattttcttgatcctttgccaaatcagaggtaggcaaagtgtactctgaaatcacctccccccaaattgtaaattcattttctgaaattagatattgacatttaagcatcatataaaagtcaaacttttctaggatggctgagaagttgaaaatcctaaatgcccacattatgagaaaagaagttaaggcaaaggccaatatggtgagtaattttaaatttacacttagcatttagccccttttctgcattagtcccatgttaggaaccaactcattctttcatatccaacatatgtattttcagtatttgctaagaaataatcctcatttcaaagcattggttattattttctacaaaagcttggtttctcaatagtataattctgtgtttgcagactataaaagtatagctctgagaatatgaaagaaaataatcaccaggacaggcaatcgatttctgtgtgggcaaaaattttagaccttttttgtaggtgaatgacatcagagagccatttagctctaagtttccatgactacctgtaaaatggagatatcattcattcactcattcatttgataaatatcaagagaacatccacaatatttcaggtacagaactaggtggcattggggtgacagagaacacactggttttgcctttaaggacatttatagtctacttgctttctgtccacttcgactcagacataaagaatatttatcaaatataccggaagtcccagaataagggtactctaaatacatcattcaaatttcaaaatagaacctaaaaaacaaatgccaaaacatttacccaatgtattcaggccttatgaacctagtgattaacatatttttaatatgttatttcagctatactgtaactatatggtgaaacacaacaaaccaaactacttggtttatttagtttagtataaagccacatttagtagtattccaactcagtgctcttcggcaagtatgtgcacagctatattacgtctaggcactgtaacagtggctagggagatgatgacatgatgacatgatgatctgttagaaccctgtgaccttaagaagcttatggtccagaaagacatacaaatgtgtcattcactatgtgatactcctctcaatctcttcctctcaccatctcaccatctttcttacattcctactcctgatttggtccagacaatccacccatcttccagagccaagaactctgttgagccaatagtaaaaatctcattccctctgcaaaggatttgtttgtttaggaaagttgtgtgacccagtttcagccaacaaggaaagtgagtgaaaaaccattcaatagggcttttgaaaaagacatggaaccaatctaaatgcccatcaatgatgaactggatcaagaaaatgtggtacatatacaccatggaatagtacacagccataaaaaggaatgagatcatgtcatttgcagggacatggatgaagctggaagccatcatcctcagcaaactaacacaggaacagaacaccaaataccgcatgttctcactcataagggggagttgaacaatgagaacacaaggacacagggaggggaacaacacacaacagggcctgttgggggtggagggtgtgtggggagggaacctagaggatgggtcaataggtgcagcaaaccaccatggcacacgtatacctatgtaacaaacctgcacgttctgcgcatgtatcccagaacttaaaataaaaaattaagtatcaatccaaaaaacacaaaaacaaaaaccaaaaaaaagtttcttcactctttccaaaaagaggtaaaagataaacccaagtgaatggagaatttggtatatgataaatatgctatccttaaatcactggggagaagatggagttttgatatgaactgttgggataagtggatagtcacatgaagaaaggtaaaatcagatccattccttagactttaaaccaggataaattccaaatggatcaactatttaactatgaaaactaaaattaaggactagaaaaaaacatggtaatatgtcatctcaataacctaggaatggggaaaacttttctaacaattatttaaaatcccaaagtaataaggaaaaacatggataccagtgattacataaaagattccagaaacaaattgggagaacacattggtaagcttcactagagataaaaatccccaatatacaccagggctgcaaaatcaggaaaaaaacagcccaaaatcacactgaaaaatgagtgagaaatatgaactgattagctcataaataaatgcaaatgggccttaaacataagaaaatacactggactgtgctgttaatatgacaaatgcaatcgaaaacaatactaatataacattcctcacctatctgacaggaaagtcttaaagttcaacaatatagtatgttggccagacttagggaactaggaattcttatatagttgtggtataaatacaaagagacatatgcaaaccctatggataagtgttcatcaatacctagcaaaattacatatgtatttatcctttgacacagaattgcacttctgggagtctatccaaaagacacactagcaaagataaaatatatgtttgcacaaagcaattcactgcagcattatttaaaataacaagagattgaaaataaaaatgtttataaataggggatggagtgagaaaaaaacatggtacatcccccatgatggagtactataaaaccgtaaaaaaaaaaaaaaaaaaagaagaggaggaagaggaaaaagaagaaaagaaatcattctagaaagtgcaactaaatgctctccaggctatttttctaaagaacgaaagaaagttgaagaaaaatgtatagagtatatataacttttcaaagaaaggatggaacacaaatataaatgtatttatatacatacatgtatgtatatccacatacaaacacatatatgcaaccttatgtatatattgtatttgtatttaataaacagagtaagtattaaaaatttgggggaggaagaaacagagtataagggagatatagaagttatactactttgaacatactggttttatagattgattctgaaatcataaatattctacataattataatgcaaaattaaatctaaaaaagcaatctctataaattgaaagtaaaataaacctaatttcatatccagttgctatcataagcactcacagaggtgctatttctagcgattttatttaagatacataacaatttaaaggaaaactctaaactgctcatggtaattaaattatttgtagtaggactggtatcgatattctgagactcttgtgcatgtactgtgaataaatcaaagaattatgatggtatcattaagtgctgaggttttgttggggaaggagagtatggttgaaatgaaataaggatgtgagatcaatggggtaaggcattctgactggggaaaaccactctcccaaagatgagcctacaagttgccttagctggttctccaggcttctgtttctaaagttattgtcatgacatctttttaatgttcgcttttcatatgatgaggccaatatatacatattaaagtacatttacatgcatatacacacgtaaacttatttggatagcatgttctcatgcatcgatcacatttctgatttgagataatagtacactaggttaaattcttcctaattgactgtggccaagtctgctcacgcccagcatcggacctcacattctttcctacctacttgttttaagctgctggctccttgcagtcacttggcagaaaacacttctcctcaaacttgcattgtatttctagctttcactcatcaatatgaattttaaggctcccagtgaaaaccaatttaaggtatggagcctgtttaaaacaaggactggctccagtcacacccttattttcagaaaataagcctctgaggcactcccaacatagggacatgcagccaggacgccaagtggtatgctttggtagaaagaattaaaaacaacttagtataaaaacgttagggtatttgttggatttaaaaagtttagctaatgtacatgacagcagacctcaaagcaccagaagactcccttgtctgtaatagagcttcagatagaacacacctcttgaaataatactaatatctattttgggataatataaggtattttctccaaaacacatatctctttcacataacgggagacatataagtaaacagaaatatctctgaagacaactaagtgttgtttaagcactaaaataacaatctaatgaattagtaagataagaaaaaatctatggggagaggaatattatttagtttgggaaaataaatatggtttgcaaggcatatgaaatatcactgggacagaggacaggaaataatactgggcctgggacaggatatgagaaaaacaagatgaaatggaagatgtgagaattcagaatagacaaagaaaaaggacatggcggagcaatcctgggcgctaatgattttctaagaaaccagcaaatccgggtttgttcctgaggatgttccaagtggagcagctgtctatctcagggattttgctaactccagaagccatcagcctagtgcccagtgaatgtttaatactgagatgctttcatgccacctgaaagaaaagcaagagagggatctgtgtccctctcaaagtacctagtactttatggtagcttcattggtttattgcgttgattattcaagattccttggctgacgatgacaagaacacaaatcaaactagcctcaactagaaagagaattaattggcttatataactaggtattccaatgatagagagaacatgagacaaatctggatcaaggcacataccctttcttgctctctctccccccatctgcttctttccgtctcccaattctgtttgtctctgatcagcttttggcctcatattcttcttccatgagcagactctgaaatcccaaacccacagcttttttgtgtcaagtcgtctctctacatagatcagatttcaccgaagcaatcttactgacagctacatgggagatgcttcagcttcctggaacaatcgctggggcatattcctgtgattcagacattggacagacccaagtcaagctcccacaggccactacactggccatttccaccacaaccatacaggatggggaaggagcagttttccaatgaatcccaacaacagatttttcccactatccttccaataagactatttttcctccaagggcatggcctctcaaatatttttggccttctccacactttaccataacatctcctaaatatatgccccataattaaacagatggaaaccagaatttttattgtagacatcatcagtgaattattttcacagattgcaaatacattccttcaatattccattacctgattgtgatcacctaattagcagatgaaaactattcagagtatcaggagcataagaggaacaaggacatgtcaatttgaaaatgatatccttagaaagcatgcctatctacatctcctatctctaagtcataaatggaaagcatttaacatacttactgaagatttttatatgtgaaaaatgggatggttcaggtagcctacagatcctgcaaccgtggtgtgtggaacataggtgtcatgcagaataatctcatgtaataagaggttcagagggtggtcgtgactagcgcaatgggaagctaagtagatacgattccaggccctaccctcactacaaacagaaggtccaagatttcatcctctttcttatttgagagtttcatatttttcatttttttgaaaaagcaattgtactgccaaactaaaaaacttacaaacaagcaacaaattgtattagtctaatcacctcattatactaaagatgaaatagtttctaaatacagatcctaaacttgctgtcatttaaatttcaacacagctatccttttacttcaccaggctgcctttcttaatttgattttacaaaggaaagctttttaaaaaaaactaaaactaaaaaagcatagtattctatgcttgagttcttagactacacataaatatttaggccgtgcttatcagaattttagaattctgaagagcctccctgaactgtcaaaacctctaaaagccacaccatgctggtgaggcgacagagtaaagggaacacttacatactgctggtaggaatgtaaattagttcactcactgtggaaagcagtgtggaaatttctcaaagatcttaataacagaattaccatttaaaccagcaatcccactactgggtatataaccaaaggaaaataaatctttctgccaaaaagacatgtacactcctatgttcattgcagtactattcacaatagcaaagacacggaatcaaccaagatgcccatcaacagtgaactggataaagaaaatgtggtacatatataccacagaatactatgcagctgtaaaaaaaagaatgaaattatgtcctttgcagcaacgtggatgcagctggaggccattatcctaagcaaactaacacaggaacaggaaaccaaatacaacaccctctcacttataagtgggagctaaacattgaatacatatagacacaaagatgggaacaagagacactgaggactgcttgaggagggagatgaggaggggcacatggattcaaagcctgccaatcatgtacgatactcactacctgggtgacaggatcattcatccaccaagcttcagcgacactcagtttacccgtgtaacaagcctggatgcacacccctggaatctaaaataaaataagataaaagtaattcattcaattaaaaaaaataggctgggcctggtggctcacagctgtaatcccagcacgttgggaggccaaggcaagtggatcatgaggtcaggacttcgagaccagcctggccaatatggtgaaactaaaaatacaaaaactagctaggcatggtggtgcacacctgtaatcccagctactagggaggctgaggcaggagaatcacttgaacctgagaggcagaggtcacagtgagcagagatcacgcctgtaatcccagctactagggaggctaaggcaggagaatcacttgaacctgggaggcggagtttgcagtgagccaagatcgcgccactgcagtccagcctgggtgacagagtggtactccatctcaaaaaataaaataaaataaaataaaatggcacagaagcatcaaatgtggatagaagaaatatctacctatgcctctgttgaaatatcaatgagtctgtctaataaatgcctgcaataggctacttaattaaaatgaatagctttagcaatcaccttggttgacaacattcagaatgaagagcaaataatagttaacacttattctacataattactcttcccttccgtacacaaaacatgtacagagcctgggcttggtaacacgaaatttccaataatctatgagagaacacttaaagactttacacttaagaagaataatttttggattaattttgaatctattttccaaaagtaaatgactttttaaaggcctagtcagttaccatgataaataaagacatacactccaagtatttggcacatgtaattacagtaaaatgaacacaccccatatcaagcacatctttgtaggtcaagatggcaataagaaagtatttttcactctggtccacagtgatcaaagggggatcaacactgaaactgtatttcagaatgccagccaaaagctttgaccatgaaagagaagcagtgctggccagttgcccacaagactgcatactacattaggttttaatacatttcaaaaacagagaatttatatagaaactgtgacaatttgaagaagtttgctgggataatcttagaagactgatctaaagacagtctaggacagctgcatgcaattctaagagtcagatctgtttgtttgtttccgagataagcgtcaaatactaatacagataagagctaaaactaaaataccaattcagtgaaaaagctaaaacccagaagacgttttatttcattacctgtctgaagttatttttaacagtgacaggtcatgttctatttcttcactggggtaagagagaatatttgaatgtcccaaatatattaaagttataggcaaaaatgctcacaaaccatttagaaaatgattcattttactgtctacctaatactgagctgaaatactctactctaagctgactgcttagagtatgtttactatctgctaatcctatagctcgcacttaaacaaggctggttggatagataatccagacaaatgcagggttccataacagagcatttttaaatgtcttaggctatcacctaagccacaaacaaaattgatttttccagacatgttccagtgtctgcttaccctttcctgctaccaactgtcatctcactcccctgataaaactcttgacatgttttgcagtatcctctactcccttcccattccaaacagctgtcttcccttcctggcagaaactccctgacatctggatactcaggatggctactgttatgatggacagattccattttatccaactacccagctccgagaatataaaaatgagcaaaaggaggagaagtgtgatagtttcaccagctacacaaatactagttcaagtaatggctatattaaagcattagcatgttgaataattttcttttaaaagtccaattttgtgacatctgtaaaatgatacagaatgttaaaatgcgatgattctgaaagaatacacaattacaagcttcctaaatttctactcaggtaatgacaacaaatccaagcccatagctcaaacataggatttctgcttcatggcctaatttgatgtttttttactagatttaagaacaaaaacatgtgtgttagatgaagacagatgagtcgaagaaaagacaaaacatgagtcactttccttgagctcatcgcccatatcccatcaatcaccagttccactttgtgctgcttcctaaatatgtatcatctcttgcatattctgctacactggtttcttaaactgttttcctatatccattctcccactacttcagtctattctccataagcagccagtgatattttattgaagtgcaaattgggtcatatcaccctaacaccccctttctaaatccaatcagtggtcccccttccttgtagaataaaacctacgctagtccacatggaccctaaagctttgcataactctggtcccagcttctctctggcttcatcaggagcctgtcttcccctcactcaacatattcaaaccacactggccttccctccattatccaaatgcatcaaatttctcccattcctaaggtctgctttagcacttttctctttgcctggctccctcctgcccatggttcagatctcaatttatatgtcacttcctcaaggaattactctgcaatcaactgcaatatgttatgtatccttttatatctctcatgggatcatggaatttttcttagcagcacttttaacaactgtatttaattaacatattaagtcagacattaaagagatttgcaaaactataaagcaatgccattctcaatttttggttttgaaaaattgttaattcttgtttaaaaatgttatcttaatgtgcaaaatgtttattattgttttaaagtattattttaaaaaaattttaatttctaatatggcaaatatcaatagatttaacaacataaacaaaacttctttcggtcgtcaatcttttttaggagtataaagggattctgagatcgaaaagtttaagaaccactgaataagaaattaaactatggcttgtgaaagaatgagatactacattttaaatcctttaggaatacttaaaattgtagttaaatatattttatgtaggaaacaaagctttcaagtaatgttgctaccttagaaagaaaatgcttaattcttatatactgctaagagaattataacaggattgtacagctaggtcataagcaatgtgtcaattataaaacagttgataagaaagttcaacttgccatgacaaacatagtttacagctttaaatgaacaattttttctttgaaagcattctaacaaatgttatctttaataacaaacacatatggcctttaaactttcaaggcaaagattcttgaaaatcataattaaaacaaacctttcgatcttacagaaaagttcttaacagaagactaacaattttgcaatgacaagatggtgaatatgtgctcaatactaattacagtcatgatgactgtgatatcaacaaacccatatatggtacttttctaagagcttagaaatcagccttagttactattattattagcccaaggatatgtaacttaccctgcatctgacagctaagtaagtgacataaatgaggtttgaatccagggtctgagctcttaactctatactgcctacatacatacatacatacatacatatatacatacatatataaattaacctttcttatcctgcttctaaacaaaggtaagggccacccagtcaatgctttgtattcttccaatattctttcctagaacttcttcaaaggctctcatgaagcactggtgaaactggaaatcactgaattttactaccattttaaccaaggctgaatcaaataatttagaagttaatattgtttatttacccagggtctatctacccacattactctcattttgttcacaaattatctaatttcctactgcatctggctttgcttattttgggttttcattgctcctgaagatttttctggcaaattctgggtttctgcccctcgtaatccttctgtggacattcaacatgaaatactaacgttcctaggccactggactcttggaaagctaatgctgtgaaatctttgctttgtaatagccctatactttgttcaatatctatttcatctgtgtaacaagtattataaataataaaagttgggagtctccagtaactgagaaaattctacccaaagtcaacatatttatgttaaacaaaaggtagtttgtattctcaaaatgaattgagttattgggtctgacatcctcctgattaaaatgtaaacttattattgagtaacgaactttgaacatagtcagaattttagagaaacatcaatttaaaatatataattaaacagacagagggctgtaagttcatctgacagaatatgtttacttttgttgaaatgttaatgatgtcagtgatacttccctgtcccccttcattaatcttgggaaaataaactatctgtttctcctcaaagctttgttctcctcactccatttcttcttgtcctcacccagaagctaatgaagtaaaagctttagggcttcttaggctaacaccccttctaagatcttgtatctaaatgtgtggttataattgtgtaggctttatcctaaagaggataaaaattgcataagattcagacgctactcaacctggatctgccttacgtgagttgtaaatatttcagtcaacttgcaattactgctcatatttttgtttctctgtacttgcagccgaggaaaatcctttggagtggctcatggacatcagtccccctgatacaaaagcttattttggcaagaaagtggcaaagaattacaagtcaggatagaggctaaacatgaattttagatctaaatttctatcaataggtaattagatgaaaaacaataataaggtagatccatatcagagacaaagtggaggcctctagtcctaaatgggcctgaataatttagaaatgtaacttaaaaatgtttggttttgggaacattttatgtaaaaattcaggtgtcaaaaatcagacctgataaaactgggtataaatgctctggcctgaatatatttcctatctacctcccttcactcattttcaaggcctgcctgtccccacctaagttaaatttaggcaagcccaaagggttattattaaagttatattcctcaaattatggaaataatgcccaagagatattaattattaaaaaaaataaatcaactgacataatagcattcataatagcattcatactatgtttcaacttttattttaaatgatttatataatttctaagatgaattcaaattatttattatggtatacagtattttttaatattcagcagaaaaaattaagcacaaattttattttaaataacatttcctaccacctttaaatataacttcagtagcagacactgtgttgatggtttggctaaaggaggacaagaaaataggacctgctcaaattcatgcatggtggcaacaaaaattcagggatcatggcaccaaaaatcttgttttccaggatggatcacagactgaggaagcacagattatacatttagagccgacattcatttcttcacagcagtattagaaaagaaaagccacagtcgatgccatttccatctagctgcatccaagcctttctgcatacagagaaatatctaattacccaatacactagagcaacgtgtggggattgttttaatatatattcacagcatgtgtcattatggctcctggcggctattaaaagggtgggctagcaacatgaattaacaataacacatttggtatatgatggctttataatgcctaaagcatttagctagtctcattattcttaatgtgccctacagctcacaagaatcatgtaactgtgtattcagctggtcccaaatgctaaatggaaagcaaaatatctcctaaaagtagttctgagtaactgctatgtctagttttcttcctttttcatcaactaacatggcatatgttataatcaacagatagttctgttttcagaacgtttttttccttttgttttagacaagcagaacaactcataatagtagacaacttcaccaggagaacagcagttcagtacaacaggaaggccagtgtctccccagtaccacctgcttaagctactacaagggttcccttaacagagatgcctgcctctatccatcctcctacagcccattctccagtcagcaactatagacatctgtgaaaatatcagatcgtatcacattactcttcagctaaaagtactccagtggcttcaatatgtactaagaataaaatgcaaacttctggtcatttcccacaaggctccttcatgcggtggctgcctacttatctctgcaacttctgtttgtaccattctcattactaaacctgaaacacggcgcacacctgtaatcccagctcatagtcattccagtcattccacacttttagcatttcatggaccctcagcctggaatacccttcccatagatcttttaatgactggctccttctccttcttcagaattctgcctaaaattgatctcctcagagactatcctatctgtagcaaccattttttcccaattctctatcgctgtcctatttaattttttttttaattaggcctagtagagtgaaattagttgttttttcagcatgatttcttatcaactatccctatataaatgtgggtatgcacacacacagaaattcgcattccattaggagcacggccttatctatctttcctattatcacctccccagtacgtggaacagatactggtaggcagtaagtgctcaaaaattattgggcatggacaaacgaacctgctagttaagcatttccatccaggagacaatcaagggagctcaacttgggaatgtattcaaatcaactctttgaaattccatctaacaacacaggaaatcattctctcttatttatttattcatgcattcattcattcattcattcattcattctgagccaggattcaagtcctagtccctcttactagggcagaaaaagtataagctctcgagaagaaattatattcttctaccctcccctccctgttcttcaacttcagtcattcacctgctctctggtatggtttctgccacttctgtgtattacaggtaccaactttcactcaatgctcttttcacctttttacaatagcctcacactaagcattaggttggtgcaaaattaattgtggttcttgccattaaaagtaatggcaaaggccaggcagggtggctcacgcctgtaatcccagcactttcggaggttgaggcgggtggatcacgaggtcaggagttcgagaccagcctggccaacatgatgaaaccccgtctctactaaaaatacaaaaattagctgggttaaaatattattttaaataacatttcctaccacctttaaatataacttcagtagcagacactatgctgatggtttgactaaaggaggacaagaaaataggacctgctatggtgtggtggcacacgcctgtaatcccagctactcaggaggctgaggcaggagaactgcttgaactcgggaggcagaggttgcagtgagacaagatcgtaccactgcactccagcctgggtgaaagagcgagactccatctcaaaaacaaaaagtaatggcaaaaacctcaattacttttgcaccagcctaacagtaataactttaggataaagagtttgctaggactagtttttcctgaattacattacaattactccttgactattaaaacacatacccatacgtatgcatttacacgtatttttccatctacaatagtctcctccaacatttgggaaaactggatcagagatgaaggaagactttcttccagggatagaggctcccctcaggcagaatgacattgcagagtccctggagggctcctaacttttactaggcactcagtggtgtcatgctctgtgctttatttattacaatacccctttgaggaggtattcatataatgtattttgcaggggaggacccaggtacagggagcttaagtcaataggacaaggtcacatagctagcaaaaggcagaagtcgtgttcaaattcaggtccatctgggcaccagatccattcttggaaccgctgaatcatacatcatctttgcaacacgtaagcgatccatgctttgttttacaatatacttctttcctaaggtggtaatccgagagcttttatttacttattttatttactaatctaaaaactgcacacacccaccttcccttcaatattcccaagtaacaagcttgttgagaaaccctactgaaaacaagctgagccttcttttcattactcagtgatttttaagtgttgctagtttttataccattagacttttattttcataattataggctgccatgggcttcttccaaagccccctgccaagtcttcattcctacatacaggtgctaattgctttcttagcaccactggttattctctgaacctttggatttcaccacctacaataggaccctgggtttttctccccttcagtaacccttagcacaatggtcacagtcactccatggctgacttggttctggcccacaagtctcatctcctcattctcaaagcggagtcaagttaattctgtgcccgtgctgcgtcctgttctctctcaattcttggtcgtggtgcttgatcctcaggttaaagcaactgaactctagtagctttgaaacaaacttgtatgtttcctcctcccctccatatagtgtgaactatatataacttaaacattaacaataatagcaaacttttattgagttcctatcagtctccacaccaaagcctctcaacaaatttatttcgtaaaaaacaaacaaaaacgagcaaacctccctgtggaggagtaccgattttatcccccttccgctatcttccagaagacagcactgaggttcacagaggagaatccattcttcctggttccagagtccgtactctaaagacccactacccactatccctcttgtgaaaactgtcccaacctgatcctgatgcaaaatgatggcaaataaaaggcagtagatagatttttacagtaaaagagaaacagaagataattaacttgagttgtgaaaagaattcaagaagggagatgcttcctttcaagacatataatctgctcctgtatgtctttcacttgttcttcaaggaatcttcgaaatgttcccctcacaaagtttctccttatgctcatatccctcctaagccatccatgagggtacccatgaaggcccagttcaccggagctgcctgacgtactgattatccctctctaaagcatcctcttttggacaacaaattatatgtccacccaaaccataatctccatgagggcagggatgtgccttattctcctttttatctctcaccaggatttttattttattttattttattttattttattttattttatttgacagggtcttgctctgtcacccaagctggagtgcagtgtgtggtcttggctgaaaactccggctcccaggttcaagcaattctcttgcctcagcctcttgaatagctgggattacaggcatgcaccaccatgcctggctaatttttgtatttttagtagagacggggtttcaccattttggccagactggtctcgaactcctgacctcaagggatctgtttgcctaggcctcccaaagtgctgggattacaggaatgagccaccacgcccagccaggattttccgattttaaatcagtactggagtaatgcttgctaagaagtcttccccccaagctaggtagaatttcgtcattactaagtccttcatagcattttgtgttcgtctctcttacagaaattatcacatgccaactttaatagttcacagaccatatatgccatgcctctgtggcaggcctgagtctccactcatctttgtatccctagatacctgattagatactttatccagtgacgtggttaactacatgctgaccaactgaactcaatattcttttgatatcctcattttgcaggcaaactcttactgtcctgccaatggaacagaaaatttgagagttgtgagatcaatgatacaccaagtgctggaggaaagaagacagagtatctgtacctggagaacaggagaaagtttagaaacagggctaaaggactaggaggtattatctaggtataaatgtctgggtattagggatgggagagagttgagagaacctcccaggaagagggaaaagacagggcagatacaagacagtctgcacgcagaatggtgtgagtaggttgtgtggctcctgatggctgaagtttaaaatcagaagggagatttgagtagacgcttacttctcaacaggctgttctgttaaataccagagcaacagtaaataagcatttaatgcaaaacttgccctcttaaaacagcgactttgggatcatcaaaactgcattgtaactgaagataacagacggacaggggagcaaatagatgacctcaggacagcttatttggggctgagacagaatacagcattctctctccacttttgcacttccctcagcagatctacagaactgcagaggaccaagtcctgaccaggaatgtgaccataccaaagggaaaacagtcatttcaacatttctgtgggtgcctgtgctgaagggacccagtgaggctgggcgctctgtttataaaacataatacgaatcatgggactaagctatttagcagagcagcaatgggacagccccacagggagagaaagggtgaggagatgttaacaaatggtctcaggggaatccatttggggaagaaggtcccagtggtgaagaaggaccagaggacttgtacaacagagctgtcttctgttcaattaaaaagcactgttggctgggcgcagtggctcacacctataatcccagcactttgggaggctgaggcaggcagcccacctgaggtagagagttcaagaccagcctgaccagcagggagaaaccctgtctctactaaaaatacaaaattagccaggcatagtggcgcatgcctgtaatcccagctattcgggaggctgaggcaggagaaccgcttgaacccgggaggcggaggttgcggtgagctgagatcgcaccattgcactccagcctgggcaacaagagtgaaactccgtctcaaaaaaaaaaaaaaaaaaaaaacactgcctgcctgcactatactaacatgttctgtaatccctctcctttaccctaagcctttactgttgctgcacacaatgattgcaggattaaagcactttggaaaaatgaaaaactgggaacgtgtccaggctgaaaggaagcatggagggaaaacaacagttggttgtctctcgagactagatatagaggaaggagggagaatcaggaaggggacttatggggtcacatggatgtgtctagggataagaatgagaagcaaataatcatacagccctatggccttgagaagtgctggttttggagcacgcatctatctgtggacactgatatcccatcttgtctctattgtcacgccacttctctatgtgaatgtgagccattatcttctcctctggctagaacatctatctacctaacgtagtaaatgaatcaaatttaatttaaaggaaaatcaaaagtcatttccatgcactgacataagaaagcacttaatctcaataaactagcagttaggatgatgggaaaatctacaagggctcagaggtatgcagcaaatcaaaattctccccatttgtataatggaacaaagccaaagtaagctttcttcctggcctaaaccacataacctaacacctgttagaaaaatgggctggggcaatgagctgtgaccaccggtgattcaaaggaatcactaaactctccccaccagtttcacagaactgcattggaaaatgacttttaccaagattcttaataaaatcaacatctttgcctgtttcatacattattagattttatggcatgcatttcagaactctaataccttaactctgtctacaagtgaggtgggattcccgaaggaccaccatcccacctctgaaaatattttcattacccaagtcagaggaagtgaagaaatgaaagcttcctgaatctggccagctaaatagcttgattcaagtgtgttatgttttcattatttacatttcccttggaatttgagggctgtcttcaaattttgtgacacctgtatttttttcacctacttctgttcagtgatttcctggaagaaggaagaacacggctgaaatgaacaatcaacgaacactgatttaatctataccacatttacctccaattaggtaaatcatggatcactgtttaaaaatatttttacaaggccattggataaaaacaagtattaggtatcagtcagtgctctgatttgggaagagccatttacggtctctaagcttatgtcatctcatctgtagaatgaaagtgactgattccccacatggcttccaactccaagaacttctggaatgctgtactgacactcatacagagctgatttggggttaattattgtttttcatttctgcttccttttcttgatggattttatcaaaaagtgaaccattttaaaaagcaattactggacattttttaagaactgcaggggagctggagatagttgcaagagggagacctattaggtttcctttttcttttactaccacttaactttttcctccaagcctcttgcctcacaataaacataaaaacagatgaccctatcactccagactgtccttcataatggcaacaacaacaataatacaagcttttaatttttgaactcccactgtacggcagacctttatctcattattggaaggagtataaagtaaggcatgaaaccactggctctgacatactgtatgatcccatttatgtaaaatgtccagaatagacaaatccacagacacagagcaaagaaaattagtggttgccagggacattaagcataggagaatgagggtgacttcttaaccagcacagggctttcttttgggaagacgaaaatgttctggaactattaatagacaggagtagttatgattgtatgaccttgggaatacactaaaaaagccactgaattgcatactgttaaaaggtgaatttttttggtatgtgaattatatctactaaaaagataaaatttaaaaaaataaaacacacatccatggctctggatggagattgtccaggttcaaatcccagccctaccgcttctcagcttttctaagcctaagtttctacatgtataaaatgggagaaatgacaaatacctcacaaggaaattagaggactaaataatgctacgacttttaggtacaaaggccaatttatagcgtgttttaaaaatattcttacgagacccttgaataaaacaatattagataccaaccagttctttgatttgagaagagccactcctggtctctaagcttaagtcattttgtctgcagaatgaaggggactggttccctacatgagcatcccataaattttcctattcttatgtaatccccacaatagttctataaaatacgtagaacattactgattttagagatgaagaaacatcagtaaagggcaaggaagttgctgagccactaagtggcagaggtgagattcgagaaatgtcagaatggaacctcacactcttgagtgacacaccactgcctcctgacccacatattaataacccagcatatgtacgaactgcttactgacttcttactatgttgcagaaactcagggacagtgccctcaagaaagtcattacctggccacttgcagtggctcatgcctgtaatcgcagtactttgggaggctaaggtgggcagattacttgaggcaaggagtttgagaccagcctgggcaacatggtgaaaccctgcctctaccaaaagtacaaaaattagccaggtgtggtggtgagcatctgcaatcccagctacttgggaggctgaggcaggagaatcacttgaaccagggaggcggaggttgcagtgagctgagctcctgccactgtactccagcctgagcaacaaagtgagtgagacatcatcaaaaagaaaaaaaaaaaaagaaaaagaaaagaaaagaaagaaagaaaagaaagcaagccattacccaagatgggagaagaacaacagtgcccagggattaaggaaattaaggaacaggtgtacacagtaaaagtataaaagtagatatttttaccatataattcagaaccttctgtctttagaaggggactttcctatcagggaaaatccagagtaactgggctgagaaaaaacattatgtagatgaacttttgagagtttctaagaaaataattaagagactgagtgctgtggctcacacttacgtataatcccagcactttggtaggccaaggtgagaggatcatggccaggcattgaagactggcctgggaaataaagcaagtccatatctctaaaaggacttttttaaagttagccaggcatggtgatgcacgcctataatcccagcttctcaagaggctgtggcaggaggacagcttgagcccaagactttgaggctgcagtgagctatgattgtgccactgcactccagcctggccaacagcacaagaccctatctctaaaaaagataacaagaattaagtgtaatcggccactcacctctatgccaaataccatattttacttaagatttcaaatctcgttgttcaataccgtggccactagccacatgtagctaaatttaaatatattaaaattgaataacgttaaaattttggttcctcagttcacaccaccacatttctagttcacaagagccacacgcggccactggctgccataatgaacagaccagataaaagagcatgtctttcaatgcagaaagttttaagggacagcactaatctaaatataaaatcacatcattcacagtcaaataataagagaaaatgcaacattttatttcatatcctaaaaagagatttggtatccaagtgaatacctggaactactataaatgctcacctaagttgtaagatgacattataatttcttatctacactttaaaaataacattatctgatcatattgctctggtgtaaagattttccagaaaaaaaatcactttccgagactccttatttttaaaaatcgcagatagcataggcaaacagataatgaacatgtaagctcactgcatctcagttttgaaatggattcaattcactggtcttgaaaagaaaagttcaggacattggggaaaactcagttgctctggtctctgagttaatagccttatgagtagaatgcctttttgtccaaagaattctcaaaatagtattatttttgtttatttgtgtttttgagattgaatctcactctgtctgctcaggatggattgcagtggcatgatcttggctgactatgacctccccatcctgggttcaagcaattctcctgcctgagcctcctaagtagctgggattacagccataaaccaccacgtctggctaatttttgtatttttagtagatacgaagtttcgccatgttggccaggctggtcttgaacttttggcctcaagtgatctgccctccttgacctcccaaagtgattacaggcgtgagccaccactcctggccttaaaatatttcaataaccattctaatgtgagcagacatggtagtggcaacaactcggaaataaaataatcttatgaggtttggtcaaatacgccaataaagctcctctgccatcttgcctctgagccatgctcatatttgtgaaatgggaggaaaaatttttctccttctttgcagatatattattctccttctttgcagatatatatgtgtgtatatatgtgtgtatatgtacacatacacatacacagaagcgcacacatatccaatagaagttggtatctatcatccagtacttcagtttttaagtataactgacacacatatacatataaattcaattaattattttacagtctgaacactttcatgtaaccaacgcccagatccagaaatacagtattaccaacacctcagagtctacctgccgcagccttccaggtaccctcaagggtaaccaacaacctgacttctagcaccactggtgaactttgacagtttccacatcttacatatgtggcactcttttgtgtctagcttttatcactgaacaagacaccatctagttttgacagatcttcgccacaaggcagccatttaatgctttcctgccttatagaataactaatccttattgagcacatattatgtgtcaagtgctttacgtgccttgactcctttaattcccccaaacaagcttatcagtaaagtattattattatccctattaaatagatgagcacattgatgtgtaaaattggctaggctatagttcccacttattcagttacatactaatctaggtattcctgtgaaaggattttacagatgtaattcaagtctctaatcatttgactttaagttagggagattatcctgggtggacctgatttaatcaactgaaggccttaaccatagggctgaggcttccaggagacagggagcataaaataaggagggaagggggcatttttctggagcagataaccatgagcaacaatcatccattaacttatacatgccaataacagatgtcacaccaactcaaagacaaggctcttcagttcattcttgaataggaacttgtagtagaaatggtatgtgccacattatttttcaagccagccctgatgtcatttgttcatgcacactgtccctgtaagaacactctcatttttcaagtcctgcatcatatttcaagttgggaaaaataaggtcactctacacatggtagggtgatggaggtgtttttggacagccagacttttcagatttactcatctttaaaagcaatctcagtgaaaggcttctcttgagtggatctaaatagatctcaagtaaacctaggagattttttaagaacaggagcaatttcttccattatcttatcccccttaacatatatcattgagcaggactgaagggaagtcttggtaagtacagatgcatgttatcatttgtctcctctttttctattgaaggctgattttaaggattttccattttcagaggtgaaattaaatggaatccttagttttcccttccaaccctcaagacttcctcctcaagtcttctccatctcaattattagcgtcccacattcgctgggtttcctgggccagactcagtagtgatcagcaagtcagttctgcctccaggcatatcccaaagctaaaatcttatctccatctccatctccagtataagcacccttgttctgaccattctgtttgctaaacacagacaaggagacctgagtgatctcctggcttccactcctgcccctctaaagccatgtcatatacaacagagagctcattttaaagctgcaaatgtagtaatatcactctcctgcgtacaactccaaatgagactggatatgtgatgacactaaggaaatactgtcaacttttagaagtgataatgatactatggctatagtttttaaaagagttctgatgttctagagatctatggtgacaaatgacagcatgcctccttcaaataacactgtgcagtggtggtgactgggaaggggtgcagctggagagaagggataggtaaaataagatagaccatgagctgataattattgaaactcggcaatgggtacattgggagtcactatacttttctattttcatatcttataacatttttataataaaaaactattaaatccccaatgactcctgactgcacttagagagtaaaatcttaagaacttgtatggctcaaaaggtatttaatgatctgactgatgcctggcaatccatgattttatccagtacccagctttgtccattaactgccaaacagctgtaacagccatcccgtgccttccagccctttgccaccataggaccttcagacaggctcttttcagccttagagggctcctccccaagatgtgccagatgtgcccagtgttgggctccttctccttcaggtgtccactccaacaaactcctcagagagggcctcctccaccatgctacctaaagcaccttccctccccgctctcctcctgcccacccctctgcacccttaccactctacctattttctttcattatttcttcataatccttatcactttttgaaatcatcttttctcttaagtccttttgaaaaataagctgatatagtttggctgtgtccccactcaaaactcatcttgaattgtagctcccataattcccatgtgtcatgggagggacccggtggcaggtaattgaatcatgggggcaggtctttcccatgctgttcttgtgatagtgagtaagtcccacaggatctgatggttttatgaaggggagtccccctgtacatgccccctgtacttacatcttgcctgccgccatgtaagatgtgcctttgctcctttatcttctgccatgagtgtgaggcctccccaaccacgtggaactgtgaatccattaaacctccttcctttacaaattacgtctcaggtacatctttattagcagcatgagaacagattaacagacaagtcacttattatcaatatactccccatactagaatacatgctctgagatcattgggaccttgtctgtccagttcacttgcatgcttccagtgcctatgatagtgcctagcataaaagtaggattccaatgatgacacattacacaaatcctttaaatcagaccagacaattaaagctgtgtacatagcacagggacaacaaaaaataataataattaatgccttggaaagtgaaattatccttacatgtatatatctgtagtattaatgaatagttaacactaacggatttcatttgaattaaacatatgtcaacataatgaataactacttacacatattaacacaattaatgaataattaatacctgtgagttttctctgaattgcattcaatatatccatacacaatacatgcacatacacatatagtctttatttcattattctgataccgaatatataacaccattgttggcttatatgtaaggaatatgacagtttatgattgctatatctcgagcaggagattttgctaaatgtattgttgccagagcttagattttaaaattcatttctaagtcttagctggtgttaaaccatgtcagcataataagcaagttttgatttcctttcagatgttcctggctgctgaaagaattgattttgaagattttcccattgacctatagggctgtgaagaagagatagctcttcttaatctcaaagatccaaactgagtttacattccccagcctttgtttggatgtcaccttcagagcttgcttcattatgtgtctcaggagaaacacagaagtattagtgataggacactgactggtagactttaatccttctttgagatgttgtttaataatgatggtttagtatcacattcgaggataactgtagttagttaatatttttacttttaatatacctactttcccaagtacaaatttatcctggggctacgtaggtgacccaagtgcatcaggagcagtttcgaacaaggtgtaacttctcaacgttacatggaataagagagagattcaaaaatcacatccaaactcaaacatcatttcaaaggtcctttcccatcttcctctccccaaaaacaactaaaacatggcatattgcatctttcaaccatggtcaaaatccttctctgttaagtagattctatgtatttttaaatatctatgcttttgtttgttgttttttttttttttgagacagagtctcactctctcacccaggctcgagtgcaatggcgtggtctcggctcactgcaacctccgcctcctgggttcaaatgattcttctgcctcaacctcctgagtagctgggattacaggcacccataaccaagcccagctaatttctgtattttttagtagaggcagggtttcaccgtgatggccaggctggtctcgaactcctgacctcgtgatctgctggcctcagcccccaaagtgctaggattacaggcgtgagccaccgtgcccggccatatctatgcttttaagtattgttttccttctcagacgtttgagaaactcaagaaggaaacattgtatacagactcagacttaacctcaatgtgaacatacacagcaacatcattgacagtctacagttacatgatctcaatggcaagtgtggtccactgtgatgtcaattttataaagggaagcttgaaaaacatcacaacagaaagaaagctgtcatgcttgctttgattaaagaggatgtagtatgtttcataaacaggttagttctcacaggaaggttcaataaatggaagcaaaaagcaaaaactcacaatggagatcctcccagtgtttgaattttaaaaaataaaggtcagtttatcactagagcgttcaattggctccagggttcatagggtattgttagactagagctccttttgctaaaaaacccagaggacttcttgtattttgcttctagctatctgggtctgcttttaattcctcagacatactcttctgctgcacgtagttctcacacctcaagacccatgagtttgctgtctgcccaaatgcatcttctctatctttcaacatccaagttgaatgcaacttctttcagaaagccttccatttccatgactagtacctcattttcaaatcaattccattgttctaagtggtttgaccttgctgggttcatgctttaattcctctgattgtaacaataaaaagtaatttactttctatgtgtttgccacacatactagatgaggcccttgaggacaaagatagcatctcatttgggtctgtgtccccagagacttcctcctcagaaaatgttgaatgaaagaatcaaataaataaaggaatgatgaatgaagcaagccaacagcacccttcaactctcagtttgcttcaaatccccactactacccttccattctatccccagtagaatttttctattctcttttcagtcttaaacactgttaaaatttcaaggtaagcatcactgaaaactgaagtgctgtggcacaatgggtttttctaatgaattatttatctgtaagcagtagttcatattcacatattttttagagaccagttgcctttctttgtgaatggatatgttcatgtatccatctattagatgctattgtcttgttttgcaaggcaattgagtgttttatttccttttttttacttatacagtaatatttgaaaatattctcactgtaaaaaattcaaaccatatagaaaaatataaaaactcccttatcactccttttaatccactttcctccccaaaagcaatctttattatcagtttcagatctttttctatgcatttagctacatatgcacatatacaagctttgtgtttgggtaggagtctcatgcatatgtagaatcataaggttttataaacttctcccttcaattaaccatgtatctcagagatagatagtcccagataaggaacatacctcatccactttaagtactagcattccacactttggatataccaacatttattcatcattcccatggtgactaaaatatattgatactccattttcactcttacaaatcctagatcatatttctttatgaaaaagcaccaagagttttcaaaaatagaattactaggttgaagggtatgcacagactggcttcccagagtatggaactgtttatttctccatatccttaaaaattgtgaatattaacaggttttgtttttccatttttttttttttttttttggttaatctgatgatagcacctatttcctacatgacctaaaccagttgagaaatgcccatatttacacctaccatggtgtgttgcgactggaacaggttcaagtgaaatataccaagtgactgctaacagcctcctacctaactcctttcagcttacatcccagtaacataaacagggatccacactgaattcacgtttaattatcagaagacagggaccttgatgagtgtcttcacataaactatcttgtttaatcctcttagaatcctgtgaaatagaaacttttattcctgttttatgtttgaccacagtgaggcaggccacccaagatcacaagattgtacttgattccacaaagcgctccactgaccccaaattaagaaactgccccatacttgcattcggtttgcagttttccactgttattgcttcttggtgcctaatgtaactacccacataaaaactgaagatgtctctacctattattttaggaaaagctctggctttgaaaatactgaatttttctgggagaagcagctggttagaggcaggtagaaattaagaatttgtgggccgggcatggtggcttatgcctataatcccagtactttgggaggccgaggcgggtggatcacctgaggtcaggagtatgagagtagcctggccaacatggtgaaactccatctctactaaaaataataataataaaaaaaatcagccaggaatggtggtacatgcctgtaacctcagatacttgggaggctgaggcaggaaaatcgcttgagccttggaggcggaggtggcagtgagccgagattgtaccactgcactccagcctggcaccaagcgagactccgtctcaaaaaaaaaaaaaaaaaagaatttgtgtatcagcaacaaatacaaactttattggacactccctccctttcttaatgagttcctcaggttttttccagaactaaaccaagtcatgaaatgtcagataataaagcccttaagtattaatgtacagtataggtgaatggctactgtacttactctatcttagcgatatttaataatattaaatgttttaaaactatcctatctaagaatgaaataaaagaaagccatggttttattatcttaagaaatttataccactcaactagctgtactaagcaaaaaaaaaaaaaaaaagtcacagcaccatggaaaatgaacacaaaagatgctttctaaaatgctgaaaagcataaaataaaagattaaaacatttcactatgcatatgttatgctggaaccttgaagctatcgcctacatgagaatggtactttaaagattactgaatatgttttctgaaagtatagaatgatcgattcatttttcaaacccttagtgtagttgcactcttcctttccctgacagatgacaaggctcagggaaagcaaagatcagagctgaggaacaacaaaaaaagttggcacctgattcacttccccttcatgccaaccctgtttttctcccttatcatacaacaaagcaaaaagaaaagtattgaatatgaaaaccaaaaagattccccatgactgagctttggcaagtacaaatgcattaggaatggagctgattcctgtgaccttttcaattatgataatcctgcaaagaaaattaaaatcattttctaaaacatggtccaaggagttccatagataattgaagaaaatatttaggaacatccctggcatttttctaagaatgtatatacttagcccaggtctgttgcacactgcagccatttcagccatgagtatttgtgagcaaaaggtcaaattaacttgagagatatttttgcaaagcctacttccagagtttttgcccttcattttttcttttgtatatatttacattttgaaatgggaagactgaaaaagagggaagctatatacttgtttctgctttggtctgaaaatttggtagttgaatgtacttctttttgaaagcatctttttggctgggaggagaggctcatgtctgtagtcccactaacttgatttggaaggctaaggtgggaggattgggtgagcccaggaatttgagagcaccctgggcaacatagggggaccccagtcttttaaaaaataaaaaacttggctgggcatggtggcacatacctgtagtcccagctactcagggggctaaggcaggagtgtggcttatgcccaggagctcaaggctgcagtgaaccatggtcatagcactgcattacagcctaggcaacagaccacaactcaaaaagcaaacaaaaaacagaatctttttgttttgggcatgaaaaataagtgaagaggctttagagttcctaggatctccactggatttctaacaagcaaaagtttccctaaagcatggaaaaacacacagatttaactatatttaaagtaaaatgatccacaaagctcatccttgcccaattctcatttaatgaataagaagactaaatacttcagaaaatcaaagactaccttactaatagacttagataaatggatttcagtttagacccaagaagggaagtcaaatctatagatacagcatctaagaagttgagaccttggttctctattctactctccctattattggccttatgaccacaagttggtcagttcgcctccctaagcctcagtttctcacagggaaaataggaatattagcaaatgacagagcaaattcacaggactgctatcataggattaaataaaacaacacaaaaaactgtaaaaattatataatacaatgtaaacaagcaaatggcataataattatttgtccttgttcaccaagttaggttttcaatatcaatatgcatctccctaccacagcaggacagagacagctacagttactggaaactataaaatgggttccagtcaacaaaagccattggactgctttctgattcttctaatagaaaatcagagcattagtaggagagaatggggaaaaaaaggctttgcttcaaatttatatttctgttcctgatacctattaagagccagttatgtagctattaagctacagcttgcaatttaaaataaataaactgataacaaaacccttaaatttccatcatcagagcagatcaaactacaacatatgctaccgaggatgcaaagcagctaatgaagacttcaatatcaggattatgacccttaatttcaataggaatgtgttctgttgtttgagctcacacataacgagaaaaaacatcacggaagcacaaataaactgtctcattaaaaagcactttgccttggtccaaatataatttcgtttttatacaattcaaatgctatagaacaaagaaagagaaggaagagggatgataaatgcagaggacttgggagggaagcctgttctgcaataattgagatggaaaggagggttcaacctgcactcctttgtttgtggagacaaagtcctcaacagctggcagatagcaggaagtagaatgctgatggctttgcagttagcttcaaaacctattagcaaccctcagatccaagagctgtacctgctttgaaataaaccaggaaatagggaataaatcatttcttctggagggaaaaaaattgtttaaagtgattaaaacatgccacaggtttctcacacaggaggaattaaggaaactatttcagaacttaatgggacctgttaaaaaaaacagatttgtaagaatttaaaagtaaatatttctttatgcaaacttatcatagtgagtatcttttaaatactaaagctagggatgcacttgcaacagtttttaggaaacgggggtggaatggggaatcacttcactgaagaagtttaaagacatatttattcctctgtggattccatttcttaaaagactgccctgaaacttcttcctaaattctgtcataattccctaagacagtaccaagggaattatcattctttattagatgccaaagaaacataacaaggatcacaaatgaaacaccagaaaatttatcaaataagattggatgtacagacccattctaaagagcattccttctcccccatgttttaagtcaaatttatattaaaaatcttgaattttctaggaattttaagtactgtcccctaattttccattaataagcacgctcatgagtatgaaaaaaatatttatttacatgcatttattataatgggccaagaaaatatttctatgtaaaggtactatcttcctattaatctgtagtttttttgctttttttgtaagggttgaaagaaagagaaaagcaacagattgcaggtggggatagaggcaaagagagataaacggtagagaaaccagttctgaaatgtcagggaattgcctggagagagttaaatatactgtttctgcggacccattcccagataggtaccgcctattcctacatatgaagagagaagagatgagttatattcatgactagtaggagttagtttatcttgcttctgttttttaattttactctaagacaaagggactgctataaaagaggaagaagtggagcttactctaattactctttattattctcttgatcatcatcacctctagtaattttgtaattcattacagtaatttatctaagtttccaaggattttaatatgttctttagctcctaggtagagaaaaattgtggtaacaatcaaatgactaatcacaattattggttaggaaaatgaaaatcacaatgcaatcattataaaaacagggtgtgtatgtaattacactaaaacttcattgatttaggccattattaatatttggtaacaactaaaaatatgtattatctttcacgttttatttcttcccagcttctccagtatgaataagaatgtatacaagaggatgttaatgaaaacaatcttacagcatcacatggtattaaatagatttttatctgtagctgtatatttcaaataaaattgatattttgcttattttcagaggaaatttgtttaaaatcctataatatttcatgttggcttcaaactctatatatttcaccccaaaccgtttctcagtacatacttacatccttttttcattaacatgttcacaaaacccatttgggtccttatttttctgcaaagtacatattatttccaggcatgttctatattcgtgtgtatgtatgtttgcttctccccaatccacataatcttcatgagataaattatattgccttcttcactactatctgtagcttcaacacttagaacaatgccttgcagagagcaggtacttgaggcaaagttgactgcttagataactccaatacctcttcacctcttcccatcagtaactatattatttatttttagctgagcacagggatccccgaaataaagaccacatcttctaatttcaagttgactgcttttgccccttcttctctctttcattctttctattggttagaagatggtcataatggctgaaaactctattagacagcactgctttcagtccttcttcctcatacaaacacatatgttcatatatatatatttatataaacacatacacatatgtgaacatctccccaagcttctccatctccttgctttttgtcagcatattaacacaccaggagaagtagatgttagtctaatctccaagccactaggtctttacttgaattgataggcacattttcaagtgaaccacaatggccttgaatcagcgttctcattttatcagtgtgatgtcaatattcagtccaaaactaaaaaaaaaaaaaaaattagatttgggccactcatatttaacactgaatatgaagcaaatggattgttcgcctttgggagggtggtctatgattaaacagaaatacagggttacctctaagcagcttcattttgctcacttggataactatctggttaagtggtattcacagatgggaaaagagttaacactcaatgaatgctatgttgtcattaattcaacaactgaacaaaagggacaagatccccacactcataaagctaacattctagtggggcaaacaaagaaacaaataacatcaacaaaccacactcaattggtttcttcagagaatgtaacactactgacaaattagtattgtcaagaactactggccatggagaggcgatggggagagcttgacctgtgcctgcatacactctagggactgagcttaaaatcttgactttaagctcaacaaatggctacatcttttgaccaaattccatcatgctttaagctccacggtttaagcccctgaagtcctttagaagatagaggcaacggctcttatttaatctatagacaccagttcaacagcagaaactattatcttgaacagggtaacacctacaaccgtgaggaatgataaccaccttcttaaacgttgaagatataatctgtacgacagtggcaggtgatgctttacattgttttataatattatcccaccacccagttctaaaataaactttaacttttttgttttttaaagccaggaaaggagataaagaatcaatgaaaggtcaacacagaacagacagaaagtaccagatgtgctctctaaattatgttctgtaagagtcagcagggagaacagaaataatttatttcaggaatcctgacgttaccatcatgtacactcggttaaatggtttgtatagctgaaaaactcagacaggtcttacaccattctcctttacttctaccacttagagaaattcaatcaaaggctgaggttaaagataccagttcccatcaagccagtatatatattaaaagtggcttttctgatcacagcaattctcaggcagtttaggtgtagtgataaacctaaaaatataatctgacaaattttcaactgttcattctaatgttcaatacttcagttattatacttcatattttccctataaatgtcaaggaaagggaattgtctataggatacacacatacctatatacacataaatgtatggggggagggatggaatttccattaaataaagagagaaggataaaaggtcacacaattgtcactttctaaaaataatttcccaggatctataatttctcagagctgtagtaaattagtcacttaaacttattaaaaccaaaaatttaaggaatacctctgaatataactcagaataatgtaacaagataatcatgagcctttacaagatttcatgttgattaacagtaaatagcttttttactgactgatttctgcttccaaatgacaccgcctaaacaaactttgttgccacagaagccacaaaattgtaaggcaatgaatttctgaattggggcctcaatgagaagtttgatttttaggatcttgagtgttctgaattgtgctcaacagtatttaccacacgtgttgcttgtttatgagacagagactacaaacatcttgaatgggacttttatttaaaattctagatgtttcacatttatattttaaagcaaaagatcttacatttgatcagcgtggcttttaattttagttatgattatttaaaaatatgctaagatattcctgacatctcaaaagaacaaattattactgtctgtcaatgcatttttagaaaaactgtatcataaaaaatgtatagcttcatataattaaaacattcaggtagtgtgcattgactaaagtaatatggactattaagtaattcaaaattgtgtttagcggcagcagctgtttaattaaaaggtaaaaactgcaactaatccactatggttgacagaaatacagcctatatcagcagtcagatcccctaggatagagaatatggatatgaattcaagaagtcatgagcttcatttaatgaatataatgaaaataaccacaataaatcagtactgaaacatactttatatctaaaattatctgtatgttggcccacttttaatttccttgtagctaataattttgcatttcgatgtagcaaaaaatcctttaacatacatattgtcaaccatcaatgcacacagcttttatcagagggcccatagcataagctcaacttataaggaggctagaaatgttcttagaatcagatgatcccttcaaagttctaaacttcagggttcaatattcaaagtactcactcataattaccttctatcatggagaaatacaaaatggccaataagctcataaagttaatcaaccttaccaacaagtgactaactgaacattacaatttcattacaaaattattttcacctacgatattaggggaaaaacctttttgttaattgaaaaaagaaactagtgatgttgaggatgatatagtcatttgtaaagataatcaagcaatatatatgatattcccagcccttgatccagaacttccaattctagtggaattacacaagtgggcaaaactttatgtacaaaaatatttattgcagaaatgtttttaatatcaggaaaatgtttaaaaatataaatcaatattggcaactgatccagaaactatggtaagcatacagtgaacaattatctgggcattaacaagaactggaaaaaaactatctgtatgtacattttatgtgacaaaaccaaaacaagccattggacaataaatgcagaataaattcatttttatacaatgaataattgtaaaatcaaaagatataaaaaaaattttcttaaatttgcctatgcttatgttaaagtaaactgtttaattcccttcataattttctgcttaaaaaatgcttatttttatattgtttaccctggctgtgctttaggaaatagatcagaagtatggaatgaggcagaccagtaaagaggcattgcagtaatacaggcaaatgaggtagaaatggaaatgtagagaaaaacaaaattataaatggcaaataaatgaattctttttagaacagttatactaaaataaaaagtctacctccagcaaatatatatagagagttatctttgaaggaggaaaaccaaatcatttcaacagtgttcttttatttccaggaggggaaaaatgtcctattaaaatggcagaagagaaaaggggaaggaaggggaagggtctctcttttactttacaaactagaaacaaacagttcacaggtttcttaacattcgtatcaaatgtcccgtggattttatttgcaaattatgaggccagcaaagcagaaaatgggagtctttaattaggaagaacaggtggctgagaggcacaaggtgagtattagccacatctctgcctggtgccaaaaaacacagatccgacctgcagaacaaattttaagggtgagagcgtaactgtctccagttggagtggagcttgagtggagctcaagctctgtattcagcttttctgaattatatttactcctatttaaagtgaaatggtttgctcttcagctttggttggaatttaccaattacaaattattgaccttcttcatattgacattctccacacagtctacaatcctctctgctgcagttgaagcaaattcttgacctgccaaatgttcctgtttctcttactgggttttcaaaatgattctcctaaacagctgattacgtattttaagttagaatgacaatatagggcttataaaagtggaacacagaggattttcagtgcattgaaactattctgtatgatactctaatggtagattacatgcaagtaactatttgtccaaactcatcgaacatacatcactaagagtgaaccctaatagaaactatggactttgggtgtcaatgatgtgtcagctcatcaactgtaacaaatgtgacactctgatagggaatattgataagtatatgtggaaggggagggagtattcgggatgactctgtaccttctgctaaattttgctataaacctaaaactgttctaccaagtaaggctattaagaagtgctcagagctgggtatggtggtgtgcacctgtaatcctagctacttgggaatctgaggcaggaggatcacttgtgccctgaagtttaaggccagcctgggcaaatatcacaagaccttgcatcagaaagaagaagaaagaagaaagaagatagaagacagaagaagaaagaaagaagaaggaagaagatgatgaagatgaagatgaagatgaagaagaagaagaaaagaaacttaaaaaccacttatacatagatacatattttttaaagcttttctgtcattaaatgttttgggtttacaaaattaaacatttggcattcttgctcaaaaacagcagtaatcttatcttaaagttcataataatcatatacgcccagcctctggctctcaacttatgagtctcacatttaggcaaatttttatgaattgaaccaatggcatttcatagtaacgtaagttcatgtccaagtgccacagcttgccacttgcttgattttaggcaattttcataacatcttatgcctcagtttcctcatctctaaaatgagagaaattcacatatctacttcactgagttgtgacaattaaatgaaagaatgcagttaggagctcagtgaagggcttagcacacagtaaagacttaagaaatgttaactctttttgttatgactaactacaacttaatgtaaaagggaactacaagtaattttttaaatcgataagcacatggagccttcgaggagaaaacatgacaccttcaaaaatgaatatgcaaggtttggaattcgttacttcagagtagaattttaccaggttagaggaatgacttataaccatatctaaaaattgtcattcttcagtgcattgctcttcatctgcatttgaagctgcctcgttataaaaaagctgtaaaacgtcctcaaagtaactttagttcttccccctaagagttcaaaatccactccctaggtttattctttggtacaaaaaccttcaaaagctgatttgctgatgataacaaatttgttttcagaaataatattcctgatctgaggtgataaacaattcagaactttcatatcattggggaattacatttaagagatcaactggggatctgtgaaataagaagcatttaccttgctagaggaatgctagcctgcatttaattgtataatatttccccttcagggtgtatgagacagcgtgttggaaaatggaatgattcttggctttattcagaaagagaacaaaggagagaaggcaggtaaaggacacagcaccatggaaatgacatttcgtttccatttgaattctaaagtactgaacttttaaaatcttcatttgaagaaactctgagaaatttgtcaggagggagtaagaaaaatgatatagcctaccacttaagatagggtgccaaaaaacattaacaattgttcaacctaaatggttagtattcaggttgaagggtggcagaatatgccacccctacatatgccactttagcataaggattattttgagctaaaggcacttaaaaaacagcaggtgctagaagggcgctgtgactcacccctttttcttcccgaatgcagggataaaaccccaatacagaagatgtcctctttataccagaaggaaagtcacatttttatcatcaaggatgaaaaggtgagacctggagaatgctgcacaaagataccatgtgaaaataattcttatcttcctttagcctgcctacagagttcacttacttttccacaattgcatcttttcagtcaatcgaatataaaagcatctaggttttgccatttctttatgtcttcatttcctaatgagggctccataaaacttctattaagtatatttgcatgcttttcttctgttaaactgttttacatcagtttaattctcaggcccagccaaaaaactctaacaaggcaggggtagaatttttgccttcctcacaaggtgttcgtttttctattcttgaaactttccgtatgtttcacaatttttataaacaaaagttgggggaatgaactattactaaaaaatctggaagacaaaattctgttctcatttgacacaccgagtatctatttacacttttctcggaaacagcgtcttctcctcctccacaaaacccatgtgctctgagggaggctgactccatcacttgggctataaggataagccacagctctggtgaggacaactggcaaaatcccatcaccctgttcatttgattggctcaggggatgagtgagagatgaaagttggaccaataaggatgaaggatttttttttcaacagttatcagaagagcctttccattttcctacaagacatgaatggacaaattagaaaggcccagtgccaggagtgacattagaaccatgatctgagagtctcctggagactgggcacaatatcaaggaaatacagccaagacacacacacacacacacacacacacacacacgggagaagggggaaggaaaaagagggagagtgtattaatctgttctcacactgctaataaagacatacctaagactgggcaatttataaaggaaagagatttagtggactcacagttccacatggctgaggaggcctcacacgcatgccaggtgaatcaagagcaaagtcacaccttacatggcagcaggaaggagagcctgtacagagaaactcctgtttataaaaccatcagatcttgtgagacttattcactaccacaagaacagtatggggaaactgcccccacgatttaattatctccacctgtccctgctcttgacacatggagattattgctattcaaggtgagatctgggtagggacataaccaaaccatatcagagaaaaacgtagagagaaaaaaggggaaagagaaaaaaaagagaaggaaaggtagaggaagagaggccatacatgcactagataaagtcgcacctacagctgagcaagatagtttccaattatcctagccaataaattctattgtctgcttaagctagaatgggtcacatttttagttgcttactagtgaaattatcctaacatgctaacaggcaagataaaaatagtctgagcaatgactaaaggagcacattttttacctcatatactgacaattcaagagcattattgcatcatttgctgccaaatggagaggaaagttggttcctaaggaccccctcggccagaaaagtacaaaacatctgttgaagtcatgggtgacttgttagcaaagttcagcagcagtaaagcttcctaagaaacaggtcttttctcaccagcgggtattgatataattagggtcaattacaatttagaatttccagggcatggggctgaattacagtggcatttaagagctctgctaaattttcccattcatcttgaagatttctggaggaacctgttgtaattaagtaatcttcttcttttcatttttatgacaattttcttcttcaggctttgcaattacccactactccaaagtaccttcctttagaagaagaattaaaaaaaagaccacctgattttcaatcgacaatgagacttggttttgctgcctgctaagtgatggattgtgatgtgtacagcaatctctaaataagctgcttcaacaagattttttaaactcccactgccctcaccaaacacagataatcccaaaaactcattgtctgagtgggtgatcaaaaacgaaagaggtgacattatgattgctgggcatcctttacccacgtggtttgtaagtagccctgggagatgtgcaaacaaactctattacttccttgtgggttttcacatatgcttcccccatacagattttatgaagacataccttttgagctttatgcaatcgaggggaaagagctttcactggattaagctattccaattgcatttaccttgggcaacaaagtaaaccatatccataaaaaacagccagaggcttttaagtattaggtcaatagcacttgagtatcatatagtcccaaaagaagctgtaacagatcatgttgattttatggaatgccttggctctctctggggagggagtagtacatagggagtgaggaacattatgacacctattactatcaaccactgttcagtgatggctttctatgcaagcacccaaccaccctgagaaaaaagtactaacatcttcaattgcacaaaagaagagggaaaaataattacagttagttgtctggtctgtgatcatccagctcaagtgaaaaaactaaaatttgaaaacctcatctttccaattccaaagtttatatttaaaaattgtacttccagtgttgaaaagtatctttgggaatagttatgccagtttctgactcacaataagatacactccatgcatgttgtgtgtgtgtatctaaaaccatccttgacccagtacaggcacttctagttaatctttcaactgatcttatccttgtccagcgtgtgggccactgctcatgccatttcttctacacagcatacctttcttttccctcccatttccacctatggaaatcttgcttgtaagtcaaagccctgctgtgaactaactatgtgcaagacatgacaaacacagcagtcagacagatgtagcctctttgttatctattccataataacacgaggcatgtaatagtgtttcacagtttatgaagaccttccaatgcacttccagaatggccaaaattccagctaactctggaaaacgcattccaaagagaaccaactagaataaatggggaaaaattttatgtcatgagtaccgaatgtgtgccaagtatttccatatatgcctaacttaatcattggctgtatgacaaaatatgattgcaagcatattaatgtattaattcaaaaatatttttgcaacagctctgttgttaaaggttctgtgttagacacttgatgcaagcaacacaaagatgaatcagacgagaggaaataaagtctacacaagtagacaaagaaaaacagtgctttatattggacattaacaaacaaaaggaacctgtaatcccagaactttgggaaaccaaagcgggaaaattgcttgagcccaggagtttaagaccagcctgggcaacatagcgaaaccccgtctctataaaaaaattttaaaaatttaaaaaatttaaaaaattagcagatcataatggcaactgcctgtagtcccagctactagaaaggctaggtgggaggatcacttgagcataggggggtcaaggctgcactgcggcatgatcatgctactgcactctagcctgggcgacagtgaaactctgcctcgaaaagaaaaaaataaataaatagaaggaaataaacgtgtgctcaaagggtattatggtagtagacacctttattccagcagctagtactgtacatgggaaagagcaaataatgattatttaataaacagataataaaaaaagactgggctgggcgcggtggctcatgcctgtaatcccagcactttgggaggccgaggccggtggatcactaggtcagaagatcgagaccatcctggctaacaaggcgaaaccccttctcaacttaaaaaaaaatacaaaaaaaaattagccgggcgtggtggcgggtgcctgtagttccagctactcgggaggctgaggcaggagaatgccgtgaacccaggaggcagagcttgcagtgagccgagatagcgccactgcactccagcctgggtgacagagcgagactccatctcaaaataaataaatgaataaataataaaaaataaaaacaaataataaaataaaaaacactgtggcctcatcgagtttctactgtagtacaccattgaaagagcacagaacactgaagtattcattgctacttatatttttaagtttttatttccattctacactccagtgagcaaatcaaaatgcctactgccaaaaaaggctcataattaatacatttttacttacaatgaaggctatcattagtatatcaccaattaatgtcagaaaaggaagatctgtcatgatattctgaatcgacattgtaaaaaggagaaaatatatggatggaaagtattctggcatgtttctagttattaagaacaactctgctgaacagcaatttgggatgatgtgaaatgaaacaaatgatatcactcattgtattcagtgtgatgatcagttggcaacaattacaaaaatgtaccagtaaggatataatatcaaatgtctatagatagtcaaaattgcaaatggcatggaaaaaacataagagaaaaccatcacacctttctctctgttttgcagtcaatgattttctcatttgtattctcctatactgtagacttcccaggacagagattacctgaggttcttctctggatctctagacaaagcccactgtccaatacttaatatatgactgttaactatggaaacaaggaaggaaggaagtcacaatttcattctgaaaactaatccaccttcttatcagccaatatgtcctccttcaaggagcagcactggaaaaactaatgaaataaaacaccaggacaaaacgtggtatccttctccagaatgcacaggaaatttctgaatattaccaagaattaaatatatttgattgttatatagcctcaaatgggccagcacttacttgtgagttactaatctaatctcaactatttcttttctttacaacattgtatttcaaaataactcaaacctacaattggttgcaagttagtacgatgaatacctgcaataccctacttcaactgttaaggttttatcatatctgctttctctcttttacacacacagacacacatataggcacacactcagcaatatcatcatcattttcccaattgcttcttagggcacaatggtttgggtattcaagaaaacaagaataaaagtcatggcatcctgcagaccaaagcaagacctaacccttgtgtgaggtataatcagtatcttgagtgaaatcatttccctggagtgaagagttcccagtgcaatgaacagtgagaactacaaccggaaaaacaggtagcaaagaccctaataactccatattttatctaataagaaatgaagtgctgaagatttgtgagtgggcttgtaaccaaataaaatgatttttcccaatataaattagagatactatatcaaacgcacagcagagacaagaaggtggtggcaggaaaatcaggcaagtttaaaacacctagagtattagcaaaaaaatacataatataactggatttgttctattcctctaacaaaatataactaaaagggtttgaaaagtcatcggccaacaatatttaatataacatactcaaatcacatatatttcaattaattaggtttctacaggagtaatgtggtatttggacttggacattaaatcaatactggccttacagttacttcccatgttcttcagccctccattacaatccactcccctacccaaaaatcaataccaaagccttatatgagacagaaaggacagtaatctttaagtggaaataggaatctaaattacaattgtaaatgtctaaagcttgtagtctggggattttcctaatgggaatatttgatgtgactttttgttattcttatggttgtgctcataagcacatcacaaggatggtttaaaggcccgagcaccataaattagatattctttaagaaatcatgttcttgacatattttttcattatctgagaagaatgaaacagattttttttgttaattagtgctaaggcatgtattttgcattagcattaagtttaccaaaatggctttaaaaacttgaacagatggcagaattataataacttttccttatgatttaggttaagaataaagtgtcatgagaattctcctcctacctaacttttctataaagttaatgcatttaatagatatggcatgtttgtttttctcactgaggtgtaaacaactctatcacacctcagatgagtataatgagatgcgggaatacatttcaatactctctacctagggtaaagggattttccagggtttaaacatcaaaccacgcagaaacaactccaaaccttcgacaataactgcacaggatggcacaggggttgcaaagacagatgtctttaggggcctggcaggtactgaaaacgagtaaagtagacttgctctgaggataatagggagtagtgggaactgcagccagccggacagagcaagcaccacccggggcgacaaacccaacttctcaccaactgctttcaggaatggaatgaaggccctgagtagctggaatcacttattttccaaaagccgccccaaatctaactttcctatgtgaaatgtcccaataaaaatttcggtggctagtttatatttttttaaagaaaagataaaataaaaagaaatgaggactaaagaaaacagtcagtggcctccaggaggaaccatgagacattagtctgcagccttagatggatatctataactggtgttcatggacctgggaggtggaggttgcagtgagccgagattgtgccactgcactccagcctgggcaacagagcgagactccatctcaaaaaacaaaaacaaaaaaaaacaaacaacaaactggtgttcatggttagtgctatggcttatttcatgccctgtccttgagggggatctcagcccctaagtgaaacacttgaaattagtaaactgggtcggcttgcaagcctgatttttgaaaaggtattatggtgaaacctggaaacctgcatgaattctaatgtggcccacctttatacctatgtgagatgatcttgagctctgtaacctccattgatcttaccagtggctcagctagctctcattttatttgtcttcttgactctcccttaaattccccatcgtgcctattcccaatttatgcctcttaaaagtcattagtaactgaaatgagcaaagtttaagaactggtgcctcttcctggcctccatatgctttaatttcattgcagcattggatatctcatcttcccatgtctcttatcatcaacctcaagctccccaaatttccttgctctcactaaatttacccatttttctcaagccttttaagatttcttagaatccagaactgtaagcaataaatatttgttgtttctaaatcacccaggctaaggtattttgttatagaagcaggaactgactgaggcaaaatgttatcttgcttaattcagaagacagaccctatggttacgccattttgtagatgagctaactaaggctaagagaggacaggtaacttgcctgaggttacacaactaggcagaagccaaatccaaataccagtcaagcactagccaccaggctctcctttctcatctcccacttctaatcaattgataactttggtagatcccaccttggtttagtaccttgcatccacacctctgtgccatcccagcaccatcataattctaatcatacatttcagtatgattggtcaggtgcaatagtctcctaatctccttaatatctctagtttctttctcttcaacacaaatttccacactctatgatcttactaatattcagctcccatcatgttcttcagaaaaagaaaaatgtgtggaacctacgcaatgtctaggtctgttcagtgtcttcaaggtattttacaactctgttacattacaggtaactaatagtaatgcaaaatattaagacatgcaaattatttcctgtttgatacaggtttactttgacctccttccttcctgccacctggaggaagaaaacagctttgcctccattttcacacacatttcaatattcctgttttataaacatgcctgttgtttggattatcttttaaaccagttatatcatctgcagcttcccttgtgaattaaataaaatctttaacacaggttcatttctgtatctgtctgagagttatgacttaacctattgctgaaaatgttcttctaacatgtttagctcctaacagatccttgctctaaaaccttcaatggacaccagttgccaaatgaattaaatccagaaacgttaccctggaattcaaaactaagagtatcatctactctgtcagtcatatattacactgcttgtccattcacatcctgcatggacaataaaagaaactccgtgggtgccacacatttcactctcccagttttcttcctctgctgatgctactctttcaccctggattgtggcttttcatagagtgttcaacataatagctgctgtggatgccctaacccatgcttctcaaacatttcacagtagtaacatggcatagggattaacatttgcttcactgaagtaggggagcaggaggaggacaaggaaggtggaggtaaagtagactgctacaagcagaaatttctttgatgtctcatgctttagctcaaaaatatatgcagattaaaaaggaatgagatcatgtcctttgcagtgacatggatgaaactagaggtcactatccttagcaaactaactcaggaacagaaaactgaataccaaatgttctcacctgtaagtgggagctgaattatgagaacaaatagacacatggcgggaacaaaacaaactaaggcctgtcggagggtcaacggggaggagagagaatatccggaagaagagctaatggatgctgggcttaatacctgggtgatgggttgatctgtgcagaaaaccaccatggcacatgtttacctatgtaacaaacctgcaatcctgcacatgtaaccctgaacttaaaagttggaaattaaatacacacacacacacacacacacacacacacacacacctctgcagattttgtacacactccatcatatatcagcaggggcttttgtgaaaaataatattgccacctccaaatattacaataaaatttcccttcctggcaggtgactagtctgtggtgttgtacatcccatgaaacactctgtgacaacgttcaactttacctgagccctgtgctcccagaaaaccagaattaagaaatcttcaatcctttctgtaagatcccatctccatcgttcctcaggattcccttgtttagcggcctctctaaaactccaggcccacttcctcttcttcaaaatgttctaccataattaatgctctccctgtagcagtatcctaaataaaatcacctccttaactgtccagtgcattatatctttgacatatggcatcccttctttgaaaagtccatgattttagatggtgcttcctaagattattactttaaaatattaaattgtgatagtagtataggggaaaaatatattttcctcactcaccactaagttcatggctgaggcacctataacaaaaggtagatcaacaaggaaaaagcatataaatctattgaatgaattttacgtgacatgggagccttcataggaaaatgaaaccctcaaaatagggaagcctgtgtctttttctatgttggtttgatggaaaagtggatagtaatgaaaaagtattattggatgaaaaaatatgatctaatggtaataagctgggagggactttggaaggcctgtttgctaaatcttctttgtgtccctgtatcttcagagataaggatgttccctttctccagatctgtggagggtacctcttgaatgagggtcttatgagaaggggaaggggaaggggaaggtaaaagagatcttcctgcttctgctatgttctcaaatatcaagatgccatattttgaagtcatgtgtcctgaaccctattcagttaaaaaaaaaaaaaagacctaccttgatgtggttccgaaagatttttttcacctgtccccatttaaaatgactaccaaagttatagccgtcaaaactacataggaatctctgcagcaggccaggaattgctgaggtagagaaatagaagaagtgggcagagacctttcctatcacccttaaaatatctgaaaactaaaactactggaaatagacactagttttcattcaatctttctttcaacaaatgttgctcagacatagcagatgagcggctgggtactggctatacaatctgttcaggggaaagctatggaatcttgattaaaactttgaaatccaaaccacagataagatgaaaaggaagaagatgagtagtgggtgtggagagaccttcaaagccggaaggctacaaaacatcaaaacattctgaggacaggatgggaagaccttaagttatggcaactgcaaataataatggcttacatttgttttaagggagtatcttaaaatattcaggaactaagcttagtaatttacattcatcaccttgctaaatccttagagtaactccaggagctaagtactattattatccccacttaacataaaaagcaacacagcctcagagaggttaattaacttgcccagggacttgcagacagtaagtagctaggctgcccaactcaaaatcatgtttcaataatgcaccccaagtgctgttaccatgggttttctagaaagggtatccaatataaattggaatccagagtgaggtggagaaagagtaaagagtgggtcagatttcctatgccaactcagggagtgtgaacttcaccctggcaatgggatgacaaggaaataattcaagggagggaaagcaagaggctgggacctagcaatggatacccctgtaccactgggccccttccagagcatgaaaatgaatgagaatagggtagaatacaaccacaggctcaagtgtctcaataaccacaaggtcagaaaggatttgctttaaggcaatatttaaacgccagtgaacactcaggtctgaattctgtgcatctaaccactacaagttagaagagaaaaaaatattagtgttcttaaggaagatctagcaaaaccatccttccagttctaagggccgtagagggtgtaggaggttggttcacacttcagggtgtaccaattaagtatgatgactgcagcaaaatagtgagtaacacagctagatatttaaaagcctcagttactggattcctgccactgcaggaaacttctgtcttgactaaatttaaaaaaaaaaaaaagaaaaaaatagtgtcaggagaaacaaagtgtaaaatacagaacttatttttcttcctgccaggtgtaagcgttaaaacttggcgtattcactattgtttagaagtttgaaaacttttaacaaaacaatagaacacagaagtgaaaaagtgattgttggggctttagacttaacacaaagcttttgcaaataaatgcctctataaccttaatgaattctaataaaatatattatgctatttttttcttgtatctgtcagaggtgtttgaaccagagcaactctatcttgaatagcggctgggtaaaataaggctgagacctactgggctgtatttccaggaggttaggcattctaagtcacagacgagataggaggttgacacaaggtgcaaatcacctgataaaacaagatgcagatgcgtaaagaagctggccaaaacccatcgaaaccaagatggtgataaaagtgacctctggttgtcctcaatgctcattatatgataattacaatgcatcagtgtgctaaaacacactcccaccagcgccatgacagtttacaaatgccatggcaaagtctggaagttacactatatggtctaaaaagaggaggaacccaaccctcagctccgggaattgccaaccccattcccgggaaagtcatgaataatccaccccttgttcagcatctaatcaagaaataattataagtattttcagttgagcagcccaaactgctttccaaataaacttgctttcactttactttttggaatacaaaagtattttggaataaaaaaagtacttatccctttactttcctaataaagttgatttcactttactctttggactcactctgaattcttccttgcatgaggtccaagaaccctttcttaggctctggattggtacccttcccagtaacatatccacgacaggtgagaaaagaaaaacaaaagacatatatatcatattacatcctacctaagatggtaccaatcgcaaggaacgtattaatttcagagacggtgagtattagaatcatcaaaatacactataattatcacattcatgagtcctgttgatacatttattttactgtctaaaattcaggagtttatggtaagggagtctatttgtaagagaccctgttgattttcacaagtcaagaaacaataaacttcaagacatactaaaaagaaaccagcctgatgtcagatcctcttcaacatagaaactatcctcatagtaaattaaattgaggaaatatttaatggataagcttgactttgtaaacgtgccttcctgaccaataggtacgttactgatgacgttcaggacaccccactttggcactggaggaaacagcagaagcaagaaggtctcttggaccttcttcctgcccttctcctctgaagcagactatacagtaattctctgacctctgcagtacatcattaagactcccatttcagaggttctctcactgtacctggagaaaaggaacatctctgtctctctgaagacaaagggacacagaagaatctgaacaaacaggccttcccaagtcagcccagtttattaccattagaccataaccttttatcctcctataatatttctcccctaccatctactttatcaaactgaacattaaaacatgtacatttccctatgtctttgggtcttcattttggaatgatcctgtgtcacataaaacttatgttaaataaagttgtatgtttttctccggttaatctgtcttttgtcatagtgtctcagtcatgagtctagtgacagatgaaaaatcttttgtcccctacagcatctatgaagatccaaagaatgtcaaagtataatttttaaaaagttacaaacattgcttttagataaatataaagcaaacatatcaaaatgaatttcttaatgagggaaccagtagcatggtgtattcatacaaaaagaattaaagaatctaagtacaaataggccctgacaatgtcaaactttacctgagccctgtgcttgcagaaaagtgatggttaacaaccacccctacaaaccttttgaaaattaaaggcaaaacatccccaccctttttggttctgggaaatggctgctgaagagaactacccttccccaaatgacttagatatgactattcttactctatcataattttcacaaaatgtgcagaccaccccttttgtttacctgtaacaaggccagaaagagacccaaccctttttacctctagccaatttcccactctgtggctcaggattgattagctaagattagaactctttttacccctaaaactgctagacgctgaaataaacatttcctgttcagctaactgactgaaattccctgacggcaaaacaatcccagctgtgaatctcttacctaaagagttaaccaaataaactctttatgtggttaggtactttatatgacttagtacatataaagtacaaagaaaaaaagataaaaaaaaaagacttggatttgaagaacaaagaactttagttctttgaaaggcacagtttaggaaataaaaagccaagtcacagactagaagaacatatttttaatgcaaatacttaataaacgacttatatctagaataaaaaataactaatatctcagtaagatagtcaacccaattaaaaatgagcaaagtacccaaaatgacatcgtacaaaagaaaacataattacaggaaaaaaatgcttatcattagtcattagggaaatgcaaattaaaacccaaatgagatactgctacacagctaaatagaatggctgaaataaaaagactgacaatatcaagtgttgacaaggattggcagcaattaagaacttccaaatgttgatggtagagtgaaaactgatataaccattttagaataccactggcaattccttgtaaatttgactttaaatatagcatgtgactcagtaattccacttgtaggtatgcatccaagaaaaatgcaaacatattctccaatagactcatctatgaaaaattatagctttcttcataatagccataaagtagacacaacctaaatgtccactatcagatgacttaacaaactgtagtataatcatgcaacaatactactcagcaatgaaaaggaatgaactgttgacacatgcagtaacaagaaggagaaaaggccccaggaacaaaaagatacatgctacatgattccatttatacaaaatacttaaaaagccaaacctaatctatagcatcacaaagcagatcagtggatgcctgaggccaggggtggtagagaggaggtggaatgcaaaactgtggaagaaacttattgatttgatgacagtattctacagtaatccacagtgtatgtaaattttatgtgtgttgctgtatataaatgatatcaaaaaattaaaactaaagaaataaagtctttagcttaaatgcatctttcaacaagttcttcatttgcaatctagcttatcacattagaataattggcagtctcctaggaaactggtctggagaaagtgagtgtttttttttttaaatgaaaagattttagatttacgttgagaattttaccaatcatcttaaatatttttcctttgaatctatttgatctgttcaaattaaacttgttatgtcctgaggtggttagctaagggtaccatcaacaaagtatgtggcatcagcttccagtgaattccccaaagtgggggagaaaaatattagagatggatccaaagagaaagcctttcaccaaaatctccattcagccttgcttttcatcacttaaatcctagaagaaaatgttctctgaggaccactctgtatgtaggagtagcctgatgagcaaacataatacttctcaagtatagacatgataaagcagcaaagtcaaaaccatggacagattcaagtcataaaaggattttgaatacatttagccatgcactcactgataaagccttcctaccaatagttcagctcatattacatataacaaggaccagtagctagaaaagctaaagcttaaaaagaaaaaattatcacagtggaaaattatcattagaaatactcaacttaagaaaagacttgaaaacctcttctgtacacacagcactttatcactataagttactggttctattatcttatttaatcctaataacactaacaataatacattaagagagttaatagagagttaatataaaagcacaatagagcaaacactgcatatagagcatttagaagtccttcgaaagcctctgctaggaatggcttcaaaacccagggagttgaatgtggactctccttttctcctttcttttatttcagtggttcttgaatgttcaagtacatatcaatatatcaaaaccatgtactcattaatgagccacttaaggaaggaatttttaaggcaattgtgatgaaatgcgactttcacctcactgtttctcaatctttttttcatcatcatccctgcaaggagcgttttctaattgcccccctgaaattttaataccacagattttctttatatccttatacgtattgtctctatgtctgcgctttacacataaaaagaatgactttttattgctcccaagaattaattttcaccggcttgggggtgatatcactcccactgagaatgcacgacctaacctggacctctagcttaatatgaacctctcctgtttatcttcaatggctcctttcaatgaaaagtctacatcccagagccttcttggttgaagcatatctattaaagtttgttttctttataccaagtttttcccaacatttctgctgaagtacacaatgatagtggagaaggaacatacatgctgaaaatgaaaaacatatatagacatatttagcaagcaggaaatgtatttgagctctgatatcttaaaacattaagcaaacagagaaagagtagtctttttaagagatggtccttggacaagtggatatctacacacaaaagagtggaaggctcctacttcatagaatatataaaaattaactcgaaatagatcaaagacctaagagtttaaagtataaaacttagaagaaaacatacatgtaaaccttcatgagtacggattacacaggggtctcttagctatgtcagcaaaagcacaagcaacgacagccacaacaaagaaaaaatatatataaattagacttcatcaaaatgtaaaagtttgtattttgaaggacatcattaataaagtgagaagacaatcaaagaggaatgggagaaaatatatgcaaatcacatatctgagaagggacttgtatctagaatatataaagaactttttcaactcaataataaatagatgattcaaattttttaaatgggtaaaggttttaaatagacatttctccaaacaagatactcagatggccaatacgcaaatgaaaagatactcagcattaaaagccatcagagaaatggtgatctaaacaccatgagtcaccatttggcacccacaaggtcacctataactaaaaaaaaattaataatgatggggaaaaatcagaacccttacatcttgcaggtgatcatgtaaaatgatgcatctaatttattatatacataaagatagtatatataaaggtatatatattacccagcaattccactcctagttatacacccaagagaaatgaaaacatatgttcacacaaaagttctatatgaatgtttataacagcatcatccataaaagcctaaaagtggaaacaccccaaatttccattgatggatgaaaagataaataatgtggtacacgcatacaatggaatattattagcaataaaaaaataaagtactgagacacattacagcatgatgaaccatgaaaacattattctagctgaaagaagccagtcacaaaagaccacaactgtgtgatttcatttataggaaatgtccagaacaggccaagatataaaaacataaaatggaatcataatgcccagggccgcggagggggcttcatgagaaacagaaatgactgctaatgcatctggggtttcttttggtggtgatgaaaatggtctaaaaatgactatggtgatagttgcacaattctgataatgttccgaaaaccacagaatatacactttaaatgggtgaatggtatgctacatatattatatctctctaaagatgtttgagcaggggaagggaaaggattaaggaggagttagatcctcagatcccatctcccactcctgatagccaggagattgcgacaccccctcatcctggccagtgacttaagctttgttcctgtagagagtaaaatagagggtctctgacatagagtaccccagcaaaatgagagagcagggctgcaggagagatgtctctaggaagatgaaagtgccagaataccagaagtgcatgaacatcttgagaaggtatttagacaaccagtgaagactttgggggctaagacagtgataagtatttacaaaaccaagcaaattaaaaaacaagaaaattattacatccagagaaatcaaaagtcaggcaggatagaaagtgtgatggtagtttactccacacttcagctttagatgacatttcaatactgtactaatatgaatattaatttcatcaaatttgcagtaaaattacattgagataagggacagaagaagagcgtgtgcaatagaagtgaagggaagactagtgatattagttatgttctctgcttccatagtgcaaaatcaatagaaagagcttgaaatgtaaaaaataaaaaagtatacatattacttagagatacagagataaatactaaaataatcagtttaaaagaaatgagggagaggaaggagggacaatgtaggggttttgaattattttttagtaacaagccttatagggctacatgaggtcacatatacacacacacacaataaatgggaaatgcttgcaaattgcataatgtaatgaaaattttcaaatactttataaaaataccatggaaaaattatgctattataagaaatgttatgtgaattgtgttctcaataatatgatttttgtcataatacaaaaatattttaaattactcagtaggtaaagtatttaactttgttctcaaataagcaaaattcctcaaaagatgcagcatgtttatcctaggtctccacgggcctctgaacacaatagcaattaccactataaaatcccagtctgagattttgtgcttaacatatgaccgttcttccacacttagcattttctactgtatacatcattaattcgtttagtaaatatttaagcatttactaatgatcaattcaagtaaaataaaaatatctgatctaggactgatcctaacaaattagttttctggaattatattttttctagattgctgatcaccacgtacatgaatacaaaactatttattgaagatgtgtgatattcagcctaaatcttgtaaaacttggacttgatagtctaagaagctattatgtgcacacatatttgaaggacatttttaaaagtgctaaactataaatattctgattcactgctctcttacatgcactaaaaatgacttcgtgcaatcactaaccaggaggtaggttttgtatcttactgaaaatgtcacttaataaataaccttcaaatttaaatgcaaactgtggatatcattcatagaacctcaaacttgcccttgaagtctaaatgggcaaacaaggtaactacaaaaagcttttcaggcgttaacaccctactgcttcaactccttgaaaagcagtctgaacttttgagtttttagcataatattcttatgctgaataatctctatctcctatagcatttaggctgaggacgttaagtatgatgtactgttgggataatttgcaattttcacttctcattctcagattagattactaacagtgttggaggaaatcactttactgcatagttcattcatagcagttcatttgtctattcaaaacctgatgtcttgtttatggctgtatatcctaatgtgttgcattaaggtgttaacagaactagttgcaaccctaaaattggactaggcaacatgacttgggactggcacagtcagagaccaggaagctggacatttattgagtaagaagaaagggaaattttgagacagagaatttgcaattatgtattatttacattatgtgaagttgactttttcattagccagtatacatccttgattgtgactgctatatatagtttacttttatatcctccatagtatctgtgttcacagtaggtgtaggtgtggtcgacagaatcctggccacctatagatgtccatgtcctaatactcagaacctctgaatatgcttacatgggaaaggggcattaaggttgcagatgatgaaggttgctaatctgctggccttaaggcagggagatgatcctggattatctaggtgggcccaacataatcacaagggtccttaaaagatggaagagacaggctgaagagaaggtcacagtgatgaaaagtgagaagtcaacctgccctttctggctttaaagatagaggaaggggccatgagaagctggaaaagtcaaagaaacaggttctctactagagcttccagaggaaacacagccctgctgacatcttgattttagcccagtgagagccatttaagacttctggcctccagagttgttaaatgattttatttttgttgttttatgttactaagttttcagtaatctgttatggaagccatcaaaaactagtaaatgattaatttaaaactttcaaagtaaaaaataagaactaagaagaacacctaaaggaataagtatgagccatcaagatattttcagttttctacgtctttaaccttattgggaacctttggttgatgtagttaatcactggagttttcctgtccattcatttgaaatctagaatttctttccatttgaaatagttttcttttactgaccagaagctaaactgtcctggatcacctgctggctgttcttttgagaaatcttggtattttccagtgagttatgactgcactatgggatactacttcctgagaacacaaaagttgctttagcttatcgctttaggcagatatttttgcctcagttatcttttagctgtgtatgacttaaacacaaaaattttaaaaatgtgggagtgcaaagaaatatcttttgaggtaggcagtcttttatctatttctccattcaaccagcatttgctaagcatttaaaatatcctagcattgagccaggcattgagtatgtgaagactgaacaacacagggtcattttcttcaagaagctcacagtctagtgaagcagatagaaatgttggaacaaataagagtttaagaaaggaatctgtaagtgttacaggaactttgagggagaaatgtctaacttcattttaaaaaactgccatttcggttcataaaaaatggggagttacacccctatgggtgaacatttgctgaccttgtaattagttataaactcatgggttggttagaagattcttttaagtatctattcaggcccatagctttctctgaaaatgaccaggcctcatacgacgccagaactaacatgaccaagggggtgtatctgactctacactgggccagccaatcagattctcagtccagagaatttggaattagaattcatgggatgaggttgtatctgttgtgacagcgaagtcaggtgacagagactcagtggtctaagagaccaggccacgcaggcgcatggagccccagcacagaaggcagcaaacagagaaaaagaaggccaaagcacagactccgaccacaactgcagttcttgcttgcctcccccagtgaggctttgttgccctctctctttcctgctgcagtgagagacacatttgtgtccttcacatacaatccctattttggttaaagttactttgagtttctattacttgcacagtgacatggttctacctttttaaaacagattccacattttcaccagtccatttgcctcaataaccttacctgcaatatgggaagaggaaagcagtttcctttcagggaaaaggcagtagaactcataaaagatgttcaagtataaaagcacttggactataaattatcatacacatgcagaagattgaaatctgtaactggttatgaaatattgttcacaaatgacccctattaaaagccaaatggaaggattttccagcaaaaatgaggtaggaaaaaagctcaaataaaaatgggccaagattctaggcagagctctaatattcagtttcagagattagttcggctttggccatttccaagtgtgaaagagggatggggcgaagaaggtaatggcaaaaagagaaagaatctacaaagaaccatggggaggaacaccggcaaggattttatccttccagagaaagccatatctgctgttaaaacacagtgcacagcagactgacaatgatcttcttgcaataggtcatagaaagggcattaaaagacaactttcaaaggtctcaaactagataaaccgaaatcagtaatagaggacttatgctggacctataggagattttcttccaggtgactattaccagaggaatctacataacagtggactgctgctatttgggggctaacttctgctgcccacctttgaagtcactaatagcttgttagcacagaagccacgctccgtggctcacacctataatcccagaactttgggaaacaaaggtgggcagatctcttgagctcaggagttcaagaccagcctggtcaacatggtgaaaccctgtctctccaaaaaaaactacaaaaattagccaggcatggtggctcacatctacactcccagctactcaggaggctgaggcaggtgaatcgcttgaacccaggaggcagaggttgcagtgagctgagatcccgccactgcactccagcctggggaaagggagtgaaacctggtctccaaaaaataataaaataaaataaacgcccattagcatagacaaagagaaagacaagaaagtaaaaccttagcttatgttattccctattagcatctctgataatggatttgttcattaacaagttaggaactaattgaactggagattcaaaataatctaaaaatttcagttcttgatgttagtactgctgtctctatgcactatcaagtgcacggaaagtatagaggtcaatgtatggcacatctgctttccattaccatgaaattcacttcaacacatcactgtcataaaaaagtcctatactaagcattctgttgttggtattgatccttcccttccatgttatgaagatagttattcatttttgcagactcaacatggcataatgcctggcacagagctaatactcaacatctgtgaatgtataaaagagcagatagtagaggctccatgcacttctgaattgctgaccataattgttaacattttctgaaaacttaccaaactccaggtgtagtaccaagtgctttatgtacattgtttcattaaaccctcacaacaacccaatgaggaaactgaggcacagagacctgtccaagatcatagactactaactggaggaagtgagatgcagacagaggcagcctggttccagagctcaagctctacaccacgctgcagtactgcctcccgtattctagtcctctcatgaaggcttgctgatggtctagcacatccttcatgctctgcgggacacaaaaccagacacaattttaaccttgctctttggagttaagagtgagagttaagtggtatttatacaattaactccaatatgaagcagaatttaacaagtatgtctagaaatgaggctgaaggtacagaagacaggaacacaactcttagctaggatgggagagaaatggaaggttgcatagaccagggacacataggctgggccttaaattatatagaagatctgcaaaggcagagatagagaccagattatagtcagcaaaatcatcacatgtcagaaaagtcagtgtgtgtctggggctatctggggcacagggtatcttcaggaagcagtaatgatgaatcctttaatgatactctaccaattcccccggtgtgaaaacatatcaaatcttgaggtacagaaagggggacaaaccgaggactcccaaaactaatcaaagaatactccttgaagttctgaacattaatgaggatgaggacctcactgaatggccacttctgtacaaactgagtttgaagtcacagaaatgttagaactgtaatcctaaaactcagttaagagggaagtgcatctacaaatcaagacagacctccagctgaaaatgcctcaacagacacttgcataggccttccttccacctttccgtgtgcaaacggatactgtgattttgagaatgaaacatgatagctcctgcatccactactaacaaaagcaagtgactggcaatgagggtaaatcaggcctcccttgagttggtccttgaaggtgctatcaaattaacgtatgtctaacaattctgtctccattcaaatcaattcgcctaggtagctaacctgctcactgtttctctaacaaggtaaacaatggattagtaaaaactacacatatcagacctggtttcttacaacattaggctcaaaatgcaagatttacataaagagaacatctatggtgagaaataatttgcttagacaggaaattttatcactgccattcagttagttggaaaatgaagatttagagatttggggaattctctaatgttctacataagcatagggtaaaataaaaacttcgtatttctttgaattaatatccaattctcttctagaggaaattttattgaattggaagtgtaattcttctgtttaaaagaaagcctcagccaggcatggtggctcacacctgtaatcccagcactttgggaggccgaggcgggtggatcacaaggtcaggagttcaagaccagcctggccaacatagtgaaatcctgtctctactaaaaatacaaaaaaaattagccaggggtggtggcgggtgcctgtcctcccagctactcaggaggctgagggggagaattgcttgaacttgggaggcagaggctgcagtgagctgagatcacaccactgcattccagccagagcaacagtgcaagactccgtcgtctcaaaaaaaagaaaaaagcctcattattttttataatgatcatgctgatcatactgctattctagtcactgtcaataaacaaaatgacaataaataaccattacaaggcagcaattaacatgatggtacctcctaacttctaagcttgtttctttaacgtgaaaacactatttctattggcaagtatgtagatgagagctgagtcttcctgaaggacagattgaaagagttttcacaaatatttaaaatcacagaaaaagtaatgttctgaaacatttacagaaattaataaaagtatctcatctttgtgtagattaaatattaaaatgcacttatataacttttattaaaataattaatatttaacgaagacaattgaaagaacacaactatgacaaattacattttggcagtaatgataagcctttgagttctagttctttctccttagggatgttacatatctgttttctctacttaaatcactctgcctcattatcatctctgccttctactctcagttcagcttgaaagttcatcttatacagggttacacgattttataatatcagataactctctttcacaccacttaccagagctctaatactaacttatgtgtctcattcttggttgaacatttctctacctcactagattataaactccttgagggcaggcactggttccactctcttccactaaatccccaactccaaaaccctaacaccttaacacctaatatatatatcaccatttacatatcagtcactcaataaatatttgaagaacgaaatgacaaaataccctttacctgaatgcttacctaaaaatgtatcttatatatggaatgaatgatccacacttactacatggatgtataaactcaaacattatacttttctttgcacatttgagaatatgtgtcataagctatgtttacaatgatatggaaacaaaaacttgtctataacaaaaacatgcccatagcaataacagcaacaacaagaagtggttccaaattcaaggtggtagcacagcttttttcaaaaatttgagaaaaaacaaatctattaaaacagaagatatagtctcttggactccactaaaatgagtctgttcaggtctactacaaaacacatctttaagagagattcatggccttagtagccagacagtaggtatggcccagaccttcccagcacagcctatgtattgaagactttagtgaaaacactcatgtcagcaaatttagcatggataattgcaataggaagttctataactttgctttagggaaaaaaattctattttaattttcattcccaaacagaattatgttagaataacaaaataaacttccccacatttatctgttttttaaaaatgatagtctcaaggaagagaaactttcttttcattcatttaataaagatttttgcattttatttaaagactccttatggctatattttaaggattcaagttcatttatttgtgataactagaaaaattttttgtccctttgtgaaaattttggaactaggcatattttcattactgttttcattattactgacaacttggctccctgctctgggaaatatttctggaagaaaagaaaaaaaaaaaaaaactatgaatcaactaacttacttagcaaggtcatcagcttactcaccagggcttatttcaagaccctctctgtgccacaaacacaagactactttgtctaaactcttgtccaattccaatcatttctctgacttgcagtacctgccttaaagtaatgcagaacaagcccagaactccataaatgtgctctcctaatttatccattttgagcaactaatcagattctctcaatcttgtatattcttttcctatagatctaaaatcatagctttgcttgatcaacaggtttttccggtagtcttgtggaaacttgacagtaggcattcatcttatatccactacacagaaacctgagttcacagatgttgtcttagtcaatgccatacacacacacacacacacacctgtgaccagcacagtggttggcacataatatgtgatcaataaatgcatacttaggaaagaagattttgttctatagtattacagagggtcaaagttcttataaaggagagtcagttactaaaactaaactgatattctatcttctcatgtggtctttcggcatcagtcctatcctacacaataatgccttgcaatctgtagttgtgaaattagacttctttttatgtgtgcacaaattaagccagtttctacaaattaaagaacatccagcaattattgctctccttcaagctgaccaataggataagtttaagcagtagttttgagaatttgtttttgcaattttttttttttttgagatggagtctcgctcagtcgcccaggctggagtgcagtggcatgatctcggctcactgcaagctctgcctcctgggttcacgccattctcctgcctcagcctcctgagtagccgggactatagatacccgccaccaggctggctaattttttgtgtatttagtagagaccgggtttcactgtgttagccaggatggcctcgatctcctgacctcgtgatccgcctgcctcggccacctaaagtactgggattacaggcatgagccactgcacccggcctgtttttgtaatttcttatactacaatgtttccttctggagacagaggaagtccagcagatgaagtctaaaatactctgcttattttgtgaaaagaccaggcattcacacaagcgtttttctcaaagctgagaaaaaggaggctgaaggtgcaaaagatatcagagtactcattcagaacccaagagtctataaaatataaacctggtgagagaactggcctcagccaatggagatgcctcaatagtgtttgtgtcacgagcgaacaaggtgaatcataaaaatattttttaaacttctgtttcaaaggtgcaaaaggcatatatattagtctctttgcattactctaaaggaatacctgagactgggtaatttttaaagaaaagaggtttatttggctatggatctgtaggctgtataggaagcataacactagcatctgtttggcctctggtgagggccttggggagcttacaatcatggcagaaaacaaaggcgagccagcatgtcacagggcaagagagggagaaagagagagagtagaggaagtcccagcctcttttaaacagccagatctcatgtgaactcacagactgagaacaaactcactcattactgcaaggatgacaccaagccattcatgaggaatccaccctcatgtcccaaacacctcccaccaggccactcaaccaacaatggggattacatttcaacatgagatttggagcggacaagcatccaaagtatataagtacagcagctagaactttcagttacttaaaaaaaatcttgctgacatcttaattacctgctgaagtcctggtggtcagcaagaaagcagtgaaaacatttaaaatttcaattttcatattaatggtcctaatttctggatctggttttctcttttaaccatttgcataaaaatgttttgtgagggacatataaagaagttggaagctgcagatataggcgttaaaaaggaattatttagcagacagtgagggtatggagtcctccgtaaggttttcctttgaatgaaaagcagccgccaaatcattttcttttctaacaaagagcagcctgtaaaatcaagctgcagacccagacaagcaagctggaagcttgcaatggatgaatgccagcagttgtgccaataagaaaaagctacctggtactaagcatgctcaaaatggcagctccatcttcccttttctttgccagccacatgtagagtaacgagcaggcaacatggcgccagctgggagaagtcgccatttgcttaagatcagggtagggcatccagcttcctcgcatgttatgtaaacatcacacctcgtccaaccaatctttgggccctatgtaaatcagacaccgcctcctcaagcctgcctataaactccaatgcactctgccacaggctggaagtctcattcaggcacccttttctctctcaagagagaaagctgttctcctttctctttcttttgcctattaatcctcagctcccaaactcactccttgtgtgtgtgtgtccctgtccttaattttcccggcatgagatgacaaatctcggatattatcccagccaatgacactgcttcactgcaatttgcaacaagaaaaatatttacgacaaggaaaaaagatgaaccaactggaaattaatgacttttttagattcagcagagaactgaggtccaaagcaaactagtatccccaaatttggagaaacatgtaaacacaaagaatcataagatcagattacctaaagcaaaaacagaaggacctaggaactgatacgaacacgtgtatgataattttgacaaattgctggaggctcagtgcagactagcttgagagttaaaaactcttgcagcctagtcttaggggagactatacttttctgagttttatgtccaagaaccctatcatgttctcatggggaagtctggagaaaaatctcagggaagagaaaaagtaaccattttggaagtttcccagattgttctctgtaagaaagacacgtcctttcagggaagctattttaccagagttctatctgacttgggagaagggcaattagtcccctccagactcttttagccttcctgtctaatgtcaggggacgaaaaaagggctcagaacatttcagaagatcgcagcctagaaactcaggctcactaagaaaactgagatgtaatcataatatacaacaattatccttcctgagacctcatcaccacgtgaagaggtctttggtgattacaactgagaggtgaaacacacagactctattgaataaggagctcttaggaaagcccaaagacaacagggaagacaaaaaatacgagcacacagaagcatctggaacttaaagctacagcaagcattaaacacagtccagctctaagctagattaacataaaacctcataacaaaaaaaaaaattcttagttcccatcactcgaggtattatttccagctttcaacaacaaaaataaggcatgcaaaaagaaatttcttaaagataaactttaaactattttaaactaaataaaaatgaaaatagagcttagcaaaatttgtggaatgcaaggaaaacaatgctttgcaggaaatttaaagaactgaacacatatatcaaaaaagaagaaagatctaaaatcaataatctaaacttctgttagaaacccacagaaagaaaaacaatttaaacctaaagcaatcagaagaaaaacagaatagaaattagagcagaaatcaattacattgaaaataggaaatcaatcagagaaaaattaacaaaaccaaaagctaattattttcaaaagatcaataaaattgctaaacctctagtcaggctaaccaggaaaaaaagagcaacaatacagattactaacattagaaatgaaagaggggtcatcactactgatctcacggatattaaaaagatgataaagaaatatgatgaacaactctgtgatctcaaatttgataacttagataaacagaggcaattccttaaaagaaacaaactaccaaaactcacaaaaagagaaatagataatctgaataggtctattcaggttatatctatatctgtatctttttaaaacattgaatcaataattaactttctaaaaataaataataaattgggtccagacaatttaactgatgaattctatcaaatatttaagcacaaaatgatagcaattctctacaaccttctttagataggtaaagcagagggaacacttcctaagtcattatgttataccagcattactctatagcaaaatcagaatacacgtgcaaaccccattaaaagaaagaaaaactagaaattaatatcgctcgtgaacatgatataaaaagcgtcaacaaaatcttagcaaatcaaatctaataatgtataaaagttattatatactacaactaggatttatttcaggtacacagctggtggaacgttcaaaaactcaacaaacattcctagcactttgggaggccgagacgggcagatcaggaggtcaggagatcaagaccatcctgactaacacagtgaaaccccgtctctactaaaaatacaaaaaaattagccaggtatggtggcaggcacttctagtctcagctacttgggaggctgaggcaggagaatggcgtgaacctgggaggcggagcttgcagtgagcggagatcgtgccaccgcactccagcgtgggtgacagaacgagactctgtctcaaaaaaaaaaaaaaaaacaatagaagaaaaccaaacaacaaaaaaaactcaacaaacgtaacttagcgtatcaactggccagagaagaaaaatcatataatagcaacagatacagaaaagcactgacaaaatcccacactcatttatgagtagaaactctcagcaaactaggaatagatgaaacttcgtcaactcgataccaaaaaatctacaaaaaaacctacagctaacatgacatcatactcaatggagagaaactggatgctttaagatcagtgtagtatagtaggctgactaatgatctcccaaagatatcaggtcttaacttttaaaacatgaaaatgttaccttctttgaaagaaaggactttgtagctgtaactaaattaagaattttaaggtgagaagattaccctaagttatctgagtgggccttaatgctatcaatcataaatatccttataaggtagaggcaaaggtgaaataacacagactcatcaagaagccagtgtgaccaggaacacagagatcactgtcacacccacacccacaacccaaagaatatatggagctaccagaagctgtcaaggaatggatttccctccacagcttctgtgggagtacggccctgctgacacctagattttagacttctggctttcagaactgtcagggaagaaatttctattgtttgaagctaccagtctgtaataatttgatatagcaagctactgagaacaaggcaagattttcccctgttaatactcctattcaacagcataatggaagacctaggtaaaagtaagacaagaaaaggaaagaatattaagaaaaagatataacgattgggaagaagaaaataaaactgtttttgctctcatgatatggctgactatgtagaaaaatcctaaaaaattgacaaaacattctctagaacaaataagcaactgcagcaatgtttcaggataaaatttttcttttatcctgaaaaaaacaggataaaatatttctttccaatatgccagaaaataacaaatggaaattgaaattagaagcacaatatcacttatattagcgtaaaaaataaaacacatagatgtaaaaatctaacaatatatgtacaggatctgtaaggaaatataaaaaattctgatgaaagaaataaaatctaaataaacgaatagatattctgtgttcatggataggaagacttgatactgttatcggttcttcccaacttgattatacattcaacgcagtttcagtcaaaatcccagaaagttattctgtgaatatcaaaaagctgattgtaaagttcatagagaagggctcaagatccagaatagccaataaaatattgaagaacaaagttgaaggagtgatactactcaactttaagacttgctacaaagctacagcgatcaagacagcatggtactggtgacagaataggtaagtgaatcaaaagaacagaagaggaaatccagaaatagaccaatacaaacataaacaacttgccctggacagaggagcaaaggcaattcaatagacaacaaatagtgctagaataactggacatccatatgccaaaaaaaaaaaaaggggggatctacacacagaccttacaccttttacaaaaataaactcaaaacgcatcacagaactaaatgtaaaatgaaaaatgcaaaatgtaaatcctctgaaagataacacagggaaaaatactagatttgagtttggcaatttgtttatagatataacaacaaaaaattatctacaaaaaaaattttaaattgaattgtattaaaatttaaaacttttgctctacaaaaaatactgttaagagaatgaaaggacaaggcacagaatggtagaaaatattaacatcatatgtcattaggggattacaaattaaaacaatgacataccagtatatacctattaggatagctaaatccataagactgataataccaaatattggcaagaaagtggagtgatgggaacgttcatgcattgttggtggaaataatggtaaaatggtatagccactttggactacagttttacagtttcttataaatctaaacatagtttcaccacagaatgcagtaaccaagttcctaagcatttactcaactgagttgaaaactaatgttcacacaaaagtctgcttagggaagcttatagaaactttattcataataatctgtctttcacaacacgagaatgtataaacaaactgtggcaaatccatacgacagaatactagtctacaattttttctttaaaagaactcttatgccataaaaaggtgtggaggcaccttacagacatactgccatatgacattatggaaaagggaaaactatagaggcaataaagggattactagttaccagggatccaatatagtttcttagggcaatgtagactattctatacgaaactgtaatggtggatacacgacaatatgcatctgtaaaactccatagaaccacagaaggccaagagtgaactttaaagtaaagtatgaacttcagttaatataaatgtgtcaatattggttcattaacttcagtaataaatgtgccacactaatgcaaggtattaatagtaggagacacttggtggtggggcggggatgggggaatagtggcgacacggaaggaaaatgttatggtaagtctctcaactatctgcacaatttttctgaaaatctaaagctgttctaaaaaataaagtattttaattttattttaaaaagtacatcttagaaaacatacctaggatgatctctaggctctggatccagaaacccctatttcaaacaagtaggaagattcttatggctgctaagatatcagcagtccatggtttcaggaatacagagccccaaggtgaatacaacaaccagactgaaataagtgcagttccaagaatggagcttaaactggaaagactagagagcagctggctagctgtttagaggtaacagatggcagaaccctcaggatcaagtcatcctgaatgaagaaagacctttggagagtgcacacttgagtaaatagcggcctctgttcatgttctccagtaacaaagaaataaactaattagatggcattcataagcaagctaaaattcctttcactggaaatctggaaagaactgatttaggagagcgaaaaacagggatatatacacacacacacatacacacacacatacatgtttgtagtatcaggaaatgctcaactttgctccctcaagtcatccagttccaatgttttatatatgctattatatgtgacaaaatcatataatatatattaatacatatcattaaaaatatgtaactgttaatgtagcataggtatatatttttcacataccataacatttatccttctaaaatatgtaattcaatgcttttcagtatattcagaaaaacatgtatccatcaccattatctaattccaggacccaattttgtttttaacacatctcaaatgtagattacaaaaaaagaattgatccactagggatacggtctgtaagaagcagcctagattttttaaaaatgtttttcttctactctacatgtaaataagtctgcatcctgtcagtatttaaggttttctttctttctaacaatcatgtaaggctggtattttttaaagtttccactcagaagactgtcttcctgacctgtaaagaaattaagtgtaaaaatgtatgcaattggactaaataatgaaaaagaggttgagaagagtgcaccgaaagaggtaaaaaaaggagactatgggccaaaggtatacaatagggaaaataaaagaagtttctagggcactgcagaaagacaatgtattctagtgattacctttattagactctattggatcaggagccagttcattaaacattaatggcaggggaatgccatccatatattataaatagccattaagttgagatagacagctctgcccagggtcagtatgaattaataaaaaaaactgaagctggcatttcagaatcataaaaagataggtttagtagaaaatattcaataagaaggaagaagaacagtatatattacactatttgtctgaagagcaaactgaaaatgagaacaaacttaacataaacctaaaaagacccttcatgaatgaaacacttatttctcgaaaatggatgtcacttacatttaagaatcgtaacagtacaatgtgtgacattggcaaatggtaaatgtaaagacaaatgaggtgtagacgttcagctagaaattagacaaaatgtgaatgcaaacaaaatatcctcactgaacacagttccaaacatagtatgtggcagcaggagaactgaagttattaacagataaggtctaatttccaatttatctattgagttaatcctgaaacctatcccacttgcctgtatttacaaggtaggtcatcttagttttaccatgagttttcactattttaagagagaaatcatgttatgaaacatggtactgataagatacttacataaagagctacacttttttaatttatttttctcactttctttgctaatttacacccattgtttctgagtaatctgaagaatgagacattcccatttttttatgtatcataatgtttctaagataacgcatggactttttaaagaatttcatggtagcaaatattatgactcaaagtcaatatgaccctggttaacaaaaatgatcaaaaactaggaaataaagctaacagtagtggtagcaatggtgtatgtggcgtgtctgttcaatactgtactagaattttgttccccaagcccactcaaggattatttaattctctaaaagaacatatctgtgtttggctttgctatatacattttgattattgtaccaccactgtcaagttataggttaacttgtagtttttgtctagtacgaaagaaccactgaagtttatggtttaattgtcctgtgggatactaatcagtcttgtataaaacctagtaattttattcaaatattctccctctccaactcctttttaacaaaatgtctagaagtacccaggtcctcaaaatgcccctggattgcactggtttcttcattaaagacatattaaatgttggtatatatttattctgtatttttattatagtcatattaacccttagaaagtagtatttttcactccaccaagcacctgtgtaagattttttaaaaaaataaacatttgccaatgttttgagaggtgaattaactcaagtaaggcataaccagtaatgccaaaaataggtttatgccccatgaattatctctccagtggtctgccagccacccataaaagtacatttttaagttatactatagaatgagtgagataaataaaatgaataatgaacggcagacttaaaaattatgacattttcttaatcttcataaagcctgtgatggatttttcacttgtctacttggctaaggtgaactacagtccctccccacttgttcaaacacagatctagatgctgctgtaaagagatttttcaggcataattacagtccctaatcagttgagtttaattttaggaaatcatcttgggtgggcctaacttaaccagtttgaacactttaaaagaagactgagaaagtcttgtacttggtgttggctgccagctgagatcttggctgagactgtcagctagaactctattttttaaattttattgtttaaattgacacacagtcgatgtacatagttttgaggtacatgtgataatgtaatacattcatattacttagcattgggatatccatcaccttaaatatttgtcttttctttatgctagatacatttcaattattttcttccatcaactagaactcttataactcacggctagccactccacgtgatttggcttctctcacagcatggctgttggattccaaagaaaagcatcccaggagagggtaagtgggtgtagagggggaggaagcaggggtggggagcacacaccaacatgcatgaggtgaatgctattcactccacctgcactgagtgcatcctactctattctctatcctagtttcaacagaaggaagagaaaacagactccacctcctgatagtgtatgacaagaatctggaacaccacaatgaactagaaatgcaggtgtggccacttttggaaaatgtaattatgccacaacaatctttgactatttttctattgtatcattttcataatggtttttagaaacttggaataaattagagtcattagccctatgtacataatatgagttgcaaatatttttccctcaaacaaatgtatttttgttattcttacgtatcttttatctcagaattctaagtcccttggaagtatgcaaattttattgaagggaattgaatttttaaaagaagcacttgtagaggacattttcaatattagtgctatcagttaagtaatttacagtaactcttatggtacccaatctttctctcacagtgatatttacaagtttaaacattttttatctcaaacagagtggcctctgaattttcctcctaacaaggagcttaatctactatagcaaccataatgaaaatgttatttaaaaatcagacaagagcaacagggaaagtcggtgtttgctatttaaattgtttttgtatcaatgggcttagaacactgtggagctatatcattttattcagttttctttcattttaatgtcactgaaaggtcaagcaataatccagagatcaatttaccatcccatgcacattgcttccctccaatttgggaatataaattcaaatgtaagatggtcttcacccaagctcttccctgcaaaaaaaagttaaggcctcagatatttttatatctacagagcagagaaggctttacttcaaataaatgctgttgcaattagcctgatgacccttcttttgccttttaatattttgatattagcaggttctacttttcctcctgatgccgaaaaaaccatgtcatgttaacaaattccttaaatgttgaactcagtcagatcatctataaaatgcaacaatatcatctccctacctatctgttaagtttattatgaagacaaagtaaaatttccatttttttttcagacagagtcttgctctgtcacccaggctggagtgcagtggcaagatcttgcctcactgcagcctctgcctcccaggttcaagcaattctcctgcctcagcctccccagtagctgggattacaggtgtgcgccaccacacccggctaatttttgtatttttagtagagacgggctttcaccatgttagccaggctggtctcaaactcctggcctcaggtgacctgctggcctcagcctcccaaagtgctgggattacaggcatgagccaccacacccagccaaaatttctgtctacttctgacattagactgctgagagtactacatatatgacagtttattagtattgcttttaatacttagaacactgtttgagacacatattaagtgcttaataaattttacctggtgtttttgtgatatgctttattttatttaagaatttaaggggatcaagtgtggaaagagaagacctaccatctcatcatcaagtattatgtgcatatagcatgagaggaagagagaagaaaaatggggagacaaagaaggaaaaggaaaagaaaggattcagggttctctgattatctctgtgcaggtaagctgagggaaactgcacacacttcatcagcaccagtgggttcccatccagcctctttcatttactactgatatgaccttgggaaagatacataacccctctgtatcagttatctattgctacttgacaaattaacccctaaaattcagggcttcaaaccaccataaatatttagtatcttatacaggttctgcaggtcatgaagtttgaagctgattagctgagtggttctgactcaaggtctctgggaaactggagtcacaacacccaccaggttgggaataatctgcagacttggctgaagctgaagcatccacctcaggttcacttacaaggctggaagttggcgctggctgttggaaagaaactttattccttgctagaggaagctctccataaagctgtttaagtgttctcacaaaatggtgactagcttttcccaaaatgagtaagattttatgacctagactctgaagacgcacactgttgctttcactgtattctactggtcaaagagataacataatacaaggtgggaggagatgtcactaggaggagaattttaaaaggtaaggatcactggaagccacctggaaggctggctaccgtgccctcaaagtctctgatccagcatctataaaatgagaataataatgacttctacctcacaatgttggtggaaagattaaatgacaccatgtattcaaagtgactgtggtccagcacttgctccacgaattgcaaacctccttaatcattctgttttctaggttctggcacagtgtgtgtgtgtgtgtgtgtgtgtgtgtgtgtgtgtgtggaggggggtgtgggtgtgtgcacgcacacatgcctgggtccatttggccacctgatgaagtctgtgtacaacttccaaaaatcatacttttaaaaaaaagtacataggattatgagaatacagattatactagaacatagccatgaaaatattttaaaatatatgtaatacactaatatttgtttctttattaagacattatacaatgaaacccaatggaagctttaacaactatatcttcaaaggaatgataagcacaaatgttttgggatacatataataactgaaatatgattagacagtatctgtgatttctattggtgagaaagtcacaagtactgccaatgccaccgtggtcttttgcctatattcacacttgaaagaaaggctaaaatctactcagaggttagtgtaagtgaagatatcatttttttaatccaagtttaaagttttcataaacactctccacaaacccaatggggttcaccggaccctggactaaacttaatttactttaaaagaaagaggaggaaagaagaataagaagaccattctagtatttaatattctctacaaataattttcttcctattaaatttcctactgtacacaggaacatctgttctccatggttctctcatttcaaaatgatcactcatttcattggacatatacctacataatactttcatttaaacatattttaatgaatctttagacctagataaatggatttacagaagtgctacattaaaaggccattttaagtttgggatcgaaaggacctttaatttatagctccagaaaatatccattccatggctcaaagatccttgtggattataaaagaggaaacgactaacagaaaaggaattattcaccacattattaaacatgacaaaaagcttctgaattggagcttaaaacgggctatttaagattccagcaatccctaggactttggcaacaaaaatgttcaaaagccttttatagttgctgtcagatttctgtaaagcatttgagattcctgtgaacttatttatataacaagctaaaacctgaagctgacttgaaagtctttctattctaattatgtagaaatggaaatgcctagaaatgatgttccgtgttctcccaagaatatcctcttgaaatggtggtttcagaaccgggtatttagaagaaggaatgagagtgtagctgctatggtttattacacggaaccattcagcagatatacaaactatagtttagcaaagtggcttcaaagaactgccatttagttattctctctgcagcagcacattctaaatgactgttcatattgttccctcctggcccactacagtggtttatttctgaagctctatagttcatgtgtaatcatgtagcaaagtaattcacgatataatgacccaccaggatctcagctgattgtggttcttatcacaatactgtttctgatgctatgcgtggctttccaaagccaactttttaacctcttatgcttcagcattccaatttgacaccaggcccctctgtgttccgagaagtcagcacataccctaagctagaaatgctaggagatattccaacagaaaaaataagatgggttttgggaaagagtactgtgcttgacagcttctaaaatggctcctaataagcccaccacctcctgctattcacacccttatgtaatcttctctcactttgaatgtgggctggacctagttatttccttttaacaaatagaaatgtgatttgtttataaatgactgtgacttcatccttttcaccctttctctgccctcttcctgcttgatgagacaaggcaagctgacctatggagagcctcatgtggcagagaactgagaccaacagtcaacaaccctagaagaactgagtcctgccaacaaccgtgtgagtgaatctggaagtggaatgtctctaatcctgacaataagatattgacaccaacagcagagatgttaaaacatgtagggtctcagaccttatcaaggaaaggtctagaaaaggaatatgaaaccatttttttctagttccaaagcctgtgcttcattcactgcattacactgtgtctccaaatgagtcctgttccaaatactgaattgggttttgcctgtttggaagttggaactcatttccctagagataaaatggcataactgaaattaacagagatctgacacaatagcagagaggggaagacagaggacttggggtgggagggctcacaaaggtggctgtgccaagaactcctgagtcttagcagtctgatccaggcagctcatgggggctggaggagtgaagtccaaaggctggactgagaaaatcacttcctgatttgagttagcttttacttgatactaggatctttgtggattaattaattaaaaatctccagatgagactaaagcggcctcattgtctgggatgataatcaggttcattgtctcacagctgaggaaatcaaggctgcagacacacaaggagtgaggttaaatggggaagtttaataggccaaagaaagagaatagctctctgctggggagaggggttctggaaaaatgggttgccggtccacagggaaatacagggggttttatagatacctggtgaggaggcagagtctgatttacatagggtgaaagactagttggaccaggtgtgccatttgtatagggcatgaaaaaccggttaggactaggtttgccatttgcataggatgcaaatttctggtcgcctccaccctaatcttttattatgctgtcacgtcctctatctgagctgtgccatgttgcccgtttctttactgtacatatggtaacaacaaaaaaagggaagatggagcctccatgtcggacatgcctgggccccaggtagcccttttctgttagcacagctgccagcattcccctgtgcaagcttccagcttgcttatttatgttttcagctcgatttttcaggctgctctttggtaggaaaaaaataatttcttgggatgcttttcattagaaagaaaattctgctgagaactcttttacccttactatctgcttaaataatttctttccacttcctgtgtcaaaattatccatatttagagtgagccttaaatccaatgactggtatctttatgagagaaaggactgggagatttgggcacagtgacccagaggaaaagatcacatggaaagagaggaaagattggagccagagtgccacagcctaggaatatcaggagccactagaagctcgaagaggcaaggaagtatgctcccctgaagacttcccatggagtctggccctgtccatatcttgatttcagatttttggcctccagaactgtgagatgatagattccggtgatttttaagccaccaagtttgtgataatttggcacagcagcccttagaaatgactaccaacaccagtgatactaatattcaactagacgtgagagccaccacttgaagctgtggcgccaaccttgccaggtgaactgttattgagctcaaggtagggcccaggtggaaatcactagcaatgagaacaccagctgcaataatcaccagaaaaccaccttcatcttcaaaacaaaatattaaaaacccactgtgttaaaaagtctttttttaagcaaggctgttgtgagacgcttcgaaatagttgaatataaaccaagacctatattatactgtagtcggatatcatctcaggattagcatactgtgagcaaatcctcaacacgttgggagttccccttccccttccagataaaagttgaaaagcctgagaaaatcaggggtgtcctcctaacttggatgttagctgccgtccatttctcttgaggttttcctttctttctttaacttttacaaccaaatatttatagttagtcctgctctaagaaagccttagaagccaggataagagcatataatactcagaacaaaactgtgtgaaacagccatattattctatctgtgacttgataattagatgtaactaaattgccggccaagatatcccatacccaagcaattatagacaccaactaacgaagacaggaaatcaaagaatgaaagctgaatgccatcagtggacatatcagaaaacatcaagaaaagctttctatgaagaaaaaaagtgtgcaactcttttaaagaaagcctagtcataaaatgaaattgaaatgtgtatttttttgttttattggctttatttcaaatggctattattaaatccctgatagtcaattaaaaaacattcaccaaactagaaatctgctgaagtatacatgtataagcatgcctaaatatattacaaactattgaattgaaacattaaaacattctccatagcaacactaaatcaaactgatatttcattttggttcccctgatgccaatacatatagtacattaaacccacagctttcagagcataaaaatgtctttgaaaacatacgtaatctagagatgatgttcaaatatagtataatatacaccttggtttatagttattatttctttcccaagattacatttctatgagaaagaagaggagcctaaatatgatatagggtcattaattttaatgatgaaaacagaaattttgactttgccagttctgaccattggggaatctgtgcccatagtaatagattactcatgtcttacttgcacttttcccaaaaatctcaagtcaaagaccacagaatttatacgctagaaaatataagaaaaaagggcacagaagctaaacaagaaaagaagaggaaaaatattccagttatggcttcaaagtcactaatttccatggaaggagattaagcgtatactttatcgaccttctctgccagcaaacaacgttttattcatgtcacttaatggggaaggaggtcaggtacagatctgaaggtcacctaactatatgctttcttccacagtattatagggcatagggaaagagcctaaaatatgcctgctggttggaattgaaaatgaaacggtcccttgtttaatgccataaaaagtatcctgagaaagtgtagctcttaggcttttcctctccgaggatttagggaaaatcaacagtgcccactggacaaaaccactttagataaagaggaatggcaaatttaagggctcacaaaatgtacttaaaagtttagaaattgggctttcaaattataccagtcaagttttacatgaattaagtcctattttgagctaggatgcatcattatgggaggtaaaccaaaatcttaaaaaatatattagtttagaatgagaactgtgcctcaggaggtgccatggaattcactaggaggtaaacctactgcaaattacattttaaaaagcaatctcagcaatatattcttctctaaaaccacaaattcattttgaatcaatatttgttatgagtccttttcaacatttttccaggagcaacacagcactgtgtcttcaggggtcgaagagggaatctacaggacttaaaaaagcatagggagtgaatatggggtcatagcttctgtcattgttgaaaagagatgccagtaagttctatgcattaaaacagaccacgcaaagcacatctgatggaataagataaataacataacagattcactcttgcatgtccaagcgtacttctgagatggtgaaatgcatttgatgcactgaaacatgaaaccatcaaaatctacagctggaagggacctcagagatgaatcatttgaaagccctccagaggaacccaggttccaggaaatatgaagaacgtgaccaaggtcacaagttagctggcagcagaacttgcaccagaatactgatctaattttattatatacacttttagtttctaaacaccaagaggcatgaatttacaaacaatgagtacagccacatgctgtgcctaaaataacaattacaaaagtaaacctacagcctcagttaaattacttacctgtgtttttcccccaccatacagaacattaccattcgcacaaaggtccctcatgttgcccctttctggccacattaatttgctcccgccctcactcctctaaccatccttaatcactgccaaccactcatctgttctccatttctatacttttgtcattttaaggatgttatataaatggaatcatacaacatataaccttttgaaattggctttttacgctcagtgaagttctctggagattaagctgtatgtatcaatagttcatctgaatgcagaatagcctccgtggtatggatgtaccacagttcatttaactattcacctgcagaaggacatctggattgcttctagtttttggccattatgaataaagctgctaggaacatttgtgtaacggtttttgtgtggatccaagtttttgtgtttcttggataaatgaccatgatcacaaatgctgggttgtctcagtccgcttgtgtcgctataaaggaatacatgagtagccaggtcagtggcacaggcctgtagtcccagctactcagaaggctgaggtgaaaagatctgttgagcccaggagtttgaggctacagtgggctatgattacacctgtgaatagccactgcactccaccctgggcaacacagaaaaagaaatctcttaaaaaatagatataaaggaagacctgaaactgggtaacttacaaagaaaaaaggtttatttggctcacggttctgcagggtttacaagcagcatgatgctaacatctgcttctgatgagaacctcaggaagctcccactcatagctgaaggagaaggggagccagcatgtagagatcacatacatggcgagacaggaagcaagagagagggtaaaggtgccaggtagtttttgagcaaccagctctcagggaaatgctccaggaactaagagtgagaagttgctcattgctacccggacagcactaagccattcatgagggatctgccaccatgacccaaacacctcccattaggccccatctctaacagtggggatcaaattttgacgtgaggattggaggctattcaaactgtagtaggttgtaaggcagttatatgtttagtttttaagaaactactaaactgtctatcaagcgtgactgtatcattttacattcttaccagcaaagatgcaaaagcagtttaatagagaaaggatagcttttccaacaaatggtgctaacgcagctgggcatacataggaaggagggtgatatggtttggctgtgtccccacccaaatctcatcttgaattgtagctcccatgattcccacgtgttgtgggagggaccaggtgggagataattaaatcacgggggtagtttccctcatactgttcttgtgatagtgaagaagtctcacaagatctgatggttttataaggagtttcccctttcgcttggctcattctttctcacctcctttcatgtaagatgtgcctttcaccttctgccatgattgtgtggcctccccagccacgtggaactgtgagtccattaaacctctttttctttataaattaccaatcttcggtatgttcttatcagcagtgtgaaatggactaatatagaggggaaggggggaaggaggaggggaaagaagaggaggaacagggaagcaagaagaactttcacataaacctcacaacttgaataaaaatcaacacgaaaggaatcattttccccgcatcttcaccagcatttagtgttgtcaccacttgtcactctcatagatgtgcagcgatatctcaacgtggttttatttagcattttccttagagttaatgatgtagaacatctttttgtgtgtttatcagttaaatggctgtccatgtcttttgcccattttccaaatggtttgtcttttttgttgttgttgagttttgcgagttcattataaatgttagataatagccctgttttggatatgtggttttcaaatatttactcccagtctgcagcttgtctttttagcctcttagcagagtctttcagagagaaattttttaaattttgaagttaaactaatcaatttttccttttatggctcatgcatttgatgccaagtccaagaaccctttgcctagacatagatcccaatgactttttcctctgctagtttctaaaagttttattttctaaaagtgttacattaatgttcatgagacattttgaatgaattttgtgcaaggtgtgaggtataggttaattttttttcctaactgtacaatttgttgaaaagtctattctttctctaactgaattgcttttttatttttgcaaaaaaaaaaaaaaaaagaccagtgggcatatttgtgtaggtctgtttctgggttctctattctgttgcatttatctatgtgtctatacttctgtcaatgacacatggtcatataaatattacaagtatgtaagtcttgaaactggatgatagactaattcctaccaccttattctttttcaaatctgttttagctattctagttcctgtgcctttacatatgaatttcaggataatcttgtctatatctactaaaaattgttgctgatattttcataagaattatattaaaactctgtatcaacttgggagaactgacatatttactatgatgaatcttctaacctgtgagaatatgtctctccatttattgagatcatctttgctttctctcatcagcattctgtagttttcaccatacaaattctatacattttttgatagattttcatgtatttatttttgtgtgtgtgtaaaaggtgctgtattttttatttggtatctatctgttgattgctaatataaataaacatagttggtttctatatgctggtctaatatcctggggcctttctgaactcatctattatttctaggattttttaaaaagattccttagacttttctaggtatgacttacaaggaagtcacctgcaaaaaaaaggctagttttactgcttcctttctaatctgtatgtcttttatttcctttccttggctcactgtgctggcaagatcaataatgaaagtattaaaagtatcagaacttgcgtagggggcataaaatactaaagtgttttcctactctcacacactactcaacacttctcacaccagattctccaacagacgctaactgggtatcctagaattcaattcagttcacacattatctacccagagatattgtcagatccaacaggttaggggttcagtcccacaagacagctcccactttggatgtcagttgtgtaccccaggctgtgaagtgtggttctgactggccagctataaatcaggattcctacaacctcctcttcatgttcaagaaatttggtagagtggctcacaggactcagggaaatgctttacttatgcagatatacaaccagatggaagagatggagaggacaaggtatgtgggaaggagtgtagaccttccctctctgggaaggtgccctctctacgagcaccaccctccaggcatcatcacacgttctgtaagctggaaggtctccaaatcctgtccttttcaggtgtttatgaagcttcatttcttatgcatgattgattacagcattggctactgatgatcatccagaccttcagaccctctcccctccctagagtcaggagataaggctcaaagttctgatgcttataccacatagttggttctcctagcaaccagtccccattctgaggctatctaggggccccagccaccagttatcatattagcattaaaaaacactcttatctccagagatttcacaagttttaggaattgtgcacccggaaccaggggcagaggccaaatatgtttattatatcaaaatatcacaaaagtattcgatcttccaacactgtgttgaatagtagcggtgagagtcaccatctttgactttttcccaaccgtaaagaaaagcattcagtctttcaatgttaagtatgttacttttttgcagatattctttatcaatttgaaaacattctcttccttttatagtgttctgtttttatcacaaagtggtattaaatttcaccacatgctttttctgtgggaattgatatgatcatgtcatttttctttcttagcctgctaatgtgtatgaaattagataatttaaacttaaaataagtcaacttaaagctgttagagctttaaatcattctgaaccttgagaggtggctctgcagcctgagtcaagtggcatgcagctgcaacttctggcttttttcttgtaaataattaagaagaccaagcagtgccagggacaggaccccctcagatcattaccctttctcacagagtaataaagtaatcttcctttgaatgtagcaatccataaccaatcaaattactgtggcatgtgcactggtcttgcatggaaaatgttgtaatcctgctggaacttctctgtccctgcctatgtaaatgaaacctcaacagcaccaaattgggctgctgatccatttgtgtagagtcagccgtgacgatcctcaagctctgcactaggataaactccacatttaatcgtattctttgaacctcattatttacggttgacatgcggtagattccattgctgattttcaaataaaccctacttgatcatgatgtatacttctctttatacattgctgaattcaatttgctaacattttgttaagaaattttgacatctctgtctatgaaggatgttggtctgcagggtttttcctactattttcatttggggcaatacaacttcaaaaattaaaaaataaatgaatattcttccttcatctgagagtgtcttgatttccctttcatatttgaaagacattttcactagacatagaattctaagttgacagttattttctttcagtatggaaaaaatatgatgccacttttgcctgcctgggaaacattggctttattactactgggcaggggagaaagtcctaattgtctataatgcctcttctggtatcacccctgagtggaggaaaaggtacttctctactgttggtagaggtgaaaatccaggctccccatgtggactcgttaccacccactggatatgagaattctggctctctacttggctttctgtaataccaacctgacaaggaggctggagtggctcattacatcccagtgacgatagtagttttggctcccacttggcctttgctgttggaggtaggagtaggtaggccacacgtttttcaatgtgtgtatgtgtggtgtttagctggagtagtacagatattatctaaaaattttctctatattgctagactgcccctttcccagtccttcacctacagtgagcaggctttcgctgtaacctttccttttgtctgtgccctctgtcagctaagggttactagcttctttagttccagggctgggatagctaaggcaaaaacaacgtctagggaattcactaccatattgtttcttgtgtctccaggtctctagctgatctgacttctctccacctctcagaatatttttagttttgtcttatatacaatattcaggattttttacttgtcctaaatgagaggaagaggaaaaagtacacctttttcctagaagtgaaagtccccttgttttactttttcaaaaaaactaaaatctttctcttgactgttatcacaacagatcctatcaaagaagagaaattaagaccaaaaaaagtgtaactgagggatagtaagagaatattcacagctttacttgagaagaaaaaaggaagggttacaaagtggggaggattagagtcaaaagactcaagttctaatggaaagatggtcagctactagccttgcatctctaaatatcacttaaatattcaggcagccccatattttgttttgttttgttttttcctgtaagatggggatgatatcaccgaggtgcccttccacagttgtggtcgtataagatgagataggaaatgggatggtgctttgtcaattttcagtcaagatataaataaagggcatgttattgcactccgatgataaactccctgcctacttcccacttgctccaacaaaacccagttgtttccagtttgtcctgtgtttcagcattgatccagcaactattgatccatgtgcacaaactagaaatatgggaggcattttggatacctctgactccccctattccccaccagtcaaaataagaatatcacagtcctgatgttctccttccagatagctctcagatccatctgcttcactccatcagccctagatccagcccccattctcttttacctgtactgtaatagtcatctcccaagtttccctgcttccaaactcatctctaaaaagcagctagatcatctttcaagcacccaaagcatctctcccgagtccattctagattcccccggatccctagagttcccatttgggcttcccgtttctcaggagacttatctgttcatttatttaaaaaactgaaacggttttctcttatttatcctaaaataaaattttgacctgaaagtatgattttaaaacactttaatacctttatagtcaacaagtaaataatatttcataataggaaaataattatgtgacatgtcatattggcattgcttcataaggtcaagggaaaagctggacatataaactagagatagtgtgtttcaccatagccttatgtacgtattactaaagaatgaaaacatcagccataacttgcaaatctgcattatgactcatgaaacaagtacactgtatctcgccaagctataattactgactaaacctaaacttctttatcacaaactcattcagcctcatgtgctcaacccatacacataaactctgttctagaaactgcctagttgatcaattctgacccagatctactaggaccatttcatggctagttctagctcccaaaaccttctcctacccttctccagttccttttgacataccccccagtttccctggtgttggttcacctttgcaacagcaagctcataacatgacttagaatctaaaaattgttctgatactctttaacgggttttagcaaaataagtgattaggataaacattgaaaattttacacctaattttaacagttactaatattacttctagttagaggagaaggactacagagtagggagcagggtgtagaagcacagattactcttatttttctgtaaggactgaagttcaaacaataaaaatgcactcatacatttcctcagaaattttaaaaacacacattaaatgctaaatatacatcctgtcaattaaaaactgtaagagtaaccttataaaaggaaaaaaaagtttgctctcgggagatgattaaatacccatattgactaaatatatttaaagtggttatgattcaatgtcagactaatatttttgcctctactttaattgctttttaaaaagaagtatcaggaggttccaattagaaatttaactgaaggccactttgaatcaatatgctgtgggaattaaatgatgctgtttttatgttttcctttttgaagatattggtcattctttttttaaatttttatctctaagagttcaaggaaagcttggtttttattggtaaggcaagaaatgcagcttctgactaaatgtttatatcttcagtgtgggatgcccttctccctttctctcctcctggcatatttaatcaacagaatattcacagatcttttacctcctacaacaggcctactccaaccctgcataatttctcctatcttagggcctctgacatttatcccgaaaaagacaactaaatacttgattctatgttttaccatatttcttttcttcctccacatctcactttttatttttagaaaatgcctctaatgcaatttagtgatcatcacagtgcctaggacattgcttggaactaaataactatttaaaagaaaaaacaaatatggttgattagtataagcaactactttgcagaactttgaaatgtgacttcccatttcaaaggttgtctttcgtattccccagtcttccaacaatcatatttcactgacgtctaacacatatacctgatttgagaatattctgaggctgagctcctttatcaaagttaattggtagaaagtgtcactcaccagaaaattccatctaattgaaaactggactgaaatggctaggctcaaatgggggctgatctaaatttctcatcaagcatcactttaaggtatcttagacaagactgccttgagctgtaaaaagctttgatgccatcagccttacaccaggatcaaaatcaattttcaacttttattgaaagctttgttaataagtttctcccctgttcgtcacagttatgaaaaacctttaatatttttgttgcatgggaataaagctaggaaggatgtaaatttcagacaaattggaggtacattttaaaaatattgtcatcgagactgacaactgccaaacctggaaaccactttctcccacatcaaacacaccctgaagtaatggtgaattcaaattgatatgcaagcctgtgacagaggctatcagaagaaactatttcttttcacctctaaaatacaattcactaagcatgacatccaaattcctattgtcataggcattttcactggtttagaagaagactgcaggacggctaatgtgttttcgttctcagataaggctaatgggtttcagctctcttgccagtttgattgccaaatgctgcctgtgacacagtaaagaattttgaagttgctcatggactttgtggaggagagtaacacagtctatcagcaacatttaccagtatggcaaagcagcattcactaatgaatctgagccctctcccgttgctggacccatggaagaccatttccagagccttcagtgcagctggacagggccacatgaccagttctgtcccacaggctgtgatcagtgttgatgtgtgccgcttcacagcccatatgtgattttctatgcttctcatccctgaagccttgagataaaggtgccataagacagcagtagacaatcgtgctgagccaccccttggaggtgagctgtcctggagcatcacctagaacctccgcaggctttgcaaggatgagaaatactcccagttggttaagccactgtgattttcatattgtttgttattgcattataacccaacccactctgacttctacacacagctctcagatgagggactggagacaggagtgcccagcacttagaggattacagattaatagtaaggaacactggttcctcttacatttaagacacccacaacatcatgatgcatttccctccaatgagatgggaattcttgtacccttgcacagcttgctttcattttgatgactactaattgtgacctgcaccttggctcttgcttgtctcctttattccttctctccttctttacgtagacacacagatgttctagagcatgcctgatatatcacactaatacatttattaagtatccctttgaaaagcaaaatgaaacattacaatttctgtggctcttttaaatgcctgtgaacacactagcacattacatttttaagtatttcagtcaaggggtcacttgggttagcctacattttggcaagtaaatcaacaattgctgccaattgcatcagaaagattcctttacttttagcagatctctaccaggagaaaaggagcaaatgtattggcttattggagcaaatgaccaccacacctcaggaacaaaagcttatactttcacattgcttactagatgccaggaaacactctatgagctttactggtatcaatgaatttaatcctcccaacaaccttagaggtcatggccacatttactcctattttacagatgagacaagtgtgtgagtttacatgcttacaaaaagcacttatcttttatcatcataaaatagagtttttagataaaacataggataagcagttaatctttagataaataataaaacagttttagtatatgtgccatatattgcatgggacatacttattctaaactgttttttacatttatctgaaattcaaattcagctgggtccctgtactcctatttgctaactctgggaactctaaattagaagctggatttaaaatttcatcaattctcagtatctaactttattaagcaaccaagctaagctgattgtacatctctatcaaacaaagttaaagacaagtttttattaaaatctctgaatctaatctactataaaaataaaatgccaagaagatttttactacaaaaatttgcttttgctttcctactacccagtctgtggcaattgagaaggatacagacattgaatgtagattctgtccgttgtcacattttatatctaaattggtgaaaatcctaccactcgtgtctgtaagccattcactttgtttggattgggggctggggtttgcaagaaaacacagaatattcctttttgttctttttttttaaacttttataacatgggacctgttaagacagaagcatgaatattctaggtcaggcagagatgaaaggacataataaataggaaacactgctctcccaatgtatcctgaagaagtccttgtcaatcatttccagtaaagtgaataaaaaatgcttaccatggcaagagcatacactgagtttgatgtagtggggacaaatcataaaataggtgtagggtgaggccaaattttaaaatctaaggtaccttggaataatatacttccagagattctcaataacagcattttaaattcttcttctctcttccaggttctgtttcatgcagggccatgagttactgccaacaagttaatatctactctcggctgttgattcaacccaaacactgtgcatctccaatctccatccatcaagggcttcaaaacaatgtgtttatctttctacttgttgtgaatattaataaattaagatctttaaactgtctaggaagaagtaagaaataactgccaagagcttgggtacagatgaggtatttacatacattagagaagtaccattaacagtaagtaatggtgcttttacattctcagaatgcagtgcaatagactgtcgatttgttttgaaggtgtctgcagtcataacacgtatctcatgctaaatggatacttagcaatttttaataattttaaactgatgtgctatttaatggtttggtgataacgcacagttttatgaagacggtttttgaatttggaatttttattgaacttgattaaatttaatgagactgcatcacttacattctaccttaattcttaatgtttataaaggtcacaacaactaattttaaaagttgtattttagaaaagcaaattctgtcagttaatgactatacaatttaaaccataattccaagattttctaaagctagcctacatgtagtactgtggtatgtcttcatgaggggtattaaagcgtaaaagtctaagacatatcactgttgtgaaggaaaacaaataggagaattttattaactccagattcttttgactttgtctgacttttgattagaactagagtacgcaaaactcagcagactatggtaaagaggatttacgtcaactcaacttcccaagaagttaaaattaaaaacatatctcccctaagtcaatacatcccgcattatttcactggtgactttagtcccaatttgtttgaggaaactaaaggtaaaagagaaaacaaatttgctttgaaggagtcaaggctatgtggaatagaaatctctgcaaaaatacttaacccagtctgtagcctttccatgaagcaaagaaaacgtaaaacagattttggggcattctgacacgaattactaagatatcacttatatgcctgtttttagactgagaggctcctcaattcctttttctttctgtctgcgtcatttccatcaggaacaactgttcaacccttacttgtagatcttcataatgattcttgacaatacacgtgcaaaattaaaatgggtctctttgcactgcttgcagtatggcaagagagtttacaaggcaataattctaaatataaaataaaaaacaaacacattacatgattttacaaatttaagggaatgtgtagaaggagtactaatcacacttggcatgtttaaaaatacacttggtgctcgtcagtgctcaaagagtacagtcatatcgtttgaattatcaataataataaaatcatggaggattgatcgtgagagtgttttccttcatcttagccacagtaataagacctctatgctgcacttcttttataattaggcaaaaatctgacagaaatcctgtgaaggcagaggtagttatttctgtgtattctttagacttccacattaagaaaaccatgcccccttttgacatgactatctctttcttccccacacaacaaaactgagaacataaaattatggacacaactgggcagctaaatgcagacacgctgactgcaataaggctctcatctcacagaggaggaggcagtacagcactctgtctccagtaaaacatctcctcaaaaacttcaaactttcttaacatctacagagaagtcttaacagaaaagtcagtaaattcgcctgccacacaccatcttgtcatttgacctttgatttctatagttcagcactccctaattccaatagacaagattcaaagaaatgtctgtaatacttcatctgcccgaaggaagacagtgagataatatccacacaagtcttgaacttttaaaatccattctcactgatacaggggaatatgaactggaagaaggattgaatgccatgcttgagtttttaccatcaaataaaatcttcagtgtgttgtttgacaatgatatttactttgagtgtgttttaaaaaatgacacctgctacaaatatcatggatctgtatatccttgatgtctcacaggtcataaaacagcaagggcaaatattttatgagctacattgcattgttgttttgttcccaggaaaagaggtattttctcaaatactaagagaccagtctattcctggggtcagctgaagccagtgttgaccctggacaaacactgggagagagctgtttccctactatgatgatccctggagctcagatgctgtctgtgcccagaccctcaaggcaaccatggccaaggtagagaaggtgaggacactgctctgagacacatgtggttcggcacacacgtgtactgtgataattgttgctaatgatgctgacagtagccaacatttaccaagggatcactatgcagtgagcactgtgcacagtgccttatgtgctgactcactgaatcctcataatgtcatttggaggtaagtactatcagcaacactacttcgcagataagaggaaaacaacggacagtaatcgtgctgcacagcagcaatcttgggagttgaacttgataaatccatgcatttattaagctcaagtcacccatataaggagtcagacttcagtcagtctcagctccacctttactataaccttggccaagttacttaacctcacaaagcctcagtttcttcatttgtcacatatggatgacagtattacttgccttacagaaaagtcatctcaaacttggaaagaggcgattgagcttactgcattccttcagtgtagagttcccactattgggcctgactttctgtttacagggttaactgacaactctcaggagagggaataattagtatgggctgttacagaccaggaggacatcatcctttctgtatctaacccaacactctaccaaattgcacgtataggtataggtataggtgtatgtgtatatatatatatatatatatatatatatatatgcctctcaaatgctctttggactgactttaacgttacattgggtccccccccaacaattagtgagctgaacaaaatcttgatgtgttcattttatatttgcatgagagcatgaatttgcctttctgccaactgtctgaacacaacattgttttaagaattgagataatgcatatgaaatgttcagcataggacctgggttaccgatgattcactaaatgtcatctatcacatcactcctataatcatctctataactgatcaccaaaagtatactatttaaaacttttaatgtgaggaatggttgtttctatttactcatattcaaatacaaacagagagtatttaatcactaactgtgagaatagctctgaaattatatactgttatccacagctggggccactttaaaatctggcctagagagtgattatctcacacatcacacacccagtacgaaaatggagtttttaagatatccactttctaggctgcttggagccttagtgccgtcacctctggtaaacaggattcattagagtgataattgacagttgtttccctttctaagtgattgctctgtagttccattatgttctgtcagggaagtgctagcaattaattaccaataaactaaacaccagctctgcttgcagcggaaggtttggaaccatttatcttgggggttgagggaggtgtttgggagaggggaaaatccacctcaccaaatacataaagtgctgtgtaaaaaccttattacaagggtgggtggggatggttagaggctctgggaggacaagagacccccatttccacttctgacactttggtatattaaaagaaaaaaacctcaaaccagtggtccaaaaagtatggtccattttaacataggctactttgaacactaaaaaaaatacactgcagaatgattatgacagtcccaagatgacgacaaaactttttgtttaagccaaaagcatagcaaggaaatactcaagtggtgtgacagaggactttttaccttctattaaagattttctgtgcattccttctactggaaataatatataaactccaaattgaggctttttgtgaaaccctgagatccaagggtttgagcttcctctcctcagtaagccaacagactctgaggtcagattcttctgcaaaccatctgagatcctataccatagttgcttgcttcctttcctgtttaactttttttttcaatatagaaccatgtggtggctttttatatagatcctggggatacatcctcgcagctctccaacttcctctatcagctcaagtcgctcccacagccacaatggtctctgggttccctagattctcactacatattacttactataatttttaaaatatacttaatcacacgtgctttcagtccacttcacattcgagtgtctcatttcataagactgtagctccttgaggacaaggacacgtcttcacagggtaattaacaattactgagcacctgcctgctgtctggaatcaggtcatgcaggcagagcaggcaggcaagaaagcaagtaaacaaaggcaacctttatttacttctcccacatttctctgccgtgggaaaggcaagtcaaagctgaaagaaaaaccaaaatggatttcatggatttcaggtctccacagagcccatgacctgttatttgaaggcttttgacccaccagtatgtccaaacatctgttgacatctgcctctctgttctgtggtgtttttcaagggatgctaggtgttcttcaaggtcaaaagggaatggtgctctcttaaagaaactggtgctgaaaagaataagggtttagttacctggggcaagaagtagaacaagaattgggtggaggtcaagaaaagcctaaggccaagtgagaaagaccaacagaagcaaaggagacagacaatcaatgataaatttcccccaccctaggcctaggggtcagtactgataaaagaggaacagaccaaaaaggcacaggtgcaggaggtgaccagtccaagcctctccagttggcttctgagagagctaacagctactggggaaaactggagcctccagtccaacctaacctggccttaaaaggcacaacccccaagacaaaagcactctacgtattcctgaaacacacaaggacacagattagaggaaagaaagaaaacaaagggctcatttacaaatgaaatttgtaattgaaattattttgaaatttatttcaaacttatctacatggtccaagaattagatgagtacaggggacaactgtgtatgccccagattcactggttattatatttttccccatctgcctatcatttgtgcactttcttgcttgctttctctctgtatacacactattttttcctgcttcctttgaaaataaattgcatttagcgcatacttcttaaaactaaaactaaagatattcttttccaccccagtacagttactaatttcagtaaatggagcattggtacaatattatatccagtccactgtcttctgtttctcaattttgtcaattaacccaacgtcatcccttttggcatcttcccctctttaatataaaatccagtataggatcttatttagtgttcctaactcttaagtctcctttaacctcaaacattactttgtctttctgttttcttttttaacagtacacctccatgccccaaacccctctaccccaacgtgtgtgtgtgtgtgtgtgtttcattttgtttaaatagaactattcctcatttgggggttctctgctgtgtccttgagtttagattcaggttgtatattctggacccaagtaccatattggttatgcttctcagggtactgcatcaggagacacacacatatctctttgctcatgaatggtgatgtgaattctgatcacaggtcaagatgttgtctggtttcttcactatatggctactgtgtttttccaaacacaagactgcttaatattctgagtgtatattaggcaggcaaagaatctagctcattatattttagttatacactaacaaagtacgcacatttataaaagcttacagttgtattttgtttgtctaaaataatgacacattaggaccaatgcataattgctcactctgtgttgtctaccattctgagctataagcttttattatgcaaaggctgtggtttgtgagctatcatttgtatgggctccttcaggccctctcaataaaatgacacatacaacaaccaataaacatgcccttttcttaaacatggtcggggtggactttcacatttcatagagcatctcagggctgttcaagctaacagatatttgaaatcaattagtccaacccacacatttttacagttgagaaaatcaagacctaaggaagaaaaaaacgacttgcctaaggtaatacagtataatagttctttataaactgaattataaaatcaatttagtgggccgtgaccagcatgttttaaactgaaatacaatttttaaaaaaatctgagtacttagcatacagcaagggtaaacactgtttggtgaaacctttaattatatatgtgtaggagtatagatgctctcctgtactaatgggataaaaaaatcttttttttaagatgggggtagcccaggctggagtgcagtggcatggtcatagctcactataacctcaaacacctgggctcaagcaatcctcctgccttagcctcctgagtaactagaattataggcatacaccatcatgcctggctgattttttttaaaaatttttttgtacagacaaggtctcactatgttgcctaggctggtctcgaactcctgagcacaagtgatcctccttgccttggccccccaaagtgccaggaccttagccatgagccacctcacccagccacaaaatgtatttcttactgaattctgtggttaaaatcctttaaagaactccattagaactaacccaaaaccagtggtcattctaccaggaaagtgtttttgcaaagtttagtgtgaaaacaaataaaggttgaaatgcagcttctgatttaacagttctggtatggacctgagattctgcatttccaataggttcctaggggagatctaagctgctcctgccagcctatcaactacctttgagaagtatgattaaaaaacactgcatctgagggaggacctactttatttttaacaacgcctccctgaagtaggtactatgtatatacatacgtatatacacacacacaatttttttgctaacaatttgaataggaacaactaattcttgaaaatgtttaaaaataacaaaacaaaaccttccacaaagaatcacctcaattcactacagagaaaatgtgctaattgtgatggtaataagagcgctggtatttactggtgttcacaatgacacgcatgagaccgagtgcatccataacccagttgattcaggttgatatgatttcccccagattacagatgaagaaacagacccaaattagtttattttctccaaggtcatcttgcttgagagtggagggacacagattagcatccagccaattaattcctaaggccatactcctatcatactcactgactcacagatgtatgttatccacacacctatgcacatgctctaaacattacatatgatataaatacatatttagatacgtgcattagcaccttggcatacacttttataaacactctacaatattcaggagtcagggatcacaagaggaaactaatatgtaaaaacccagttctctaaaattaggtgccttctcaagtaggtcaagcaaccgcatttatattgtctacattaaagggatctcttgaaaacagtcacattagcagaatacaggggctgagtgagcaggctggcaggggaggagtgtgagcaggctaacgactagagctacaaacaagattccatcacctataacttagatttcatgtggtatatttagttcaaaccctgtcactttatacaaataggttgtcacgtaaagtgcaaacaactctcttttgacaaagtgatactgctgtggtgctgggttgatggctttatattccacaaagctttttaagtgacaaatgatagctgagtcttgaaaatatggtgatatgaaatgactgcataaatcctttcaggcttcccggggggagcaaaagcatagcattttgcacattaattaaaaaagaaaatctgagaggatgaggttagatctttctaatcttgactctgtgcaaacggactttgaagttactggcacaaaattgagagatggccccagaaaagtcttcaaatgagatgtacaatgttgtttaaagatcaggctcaagtgctgctcttggcccaaatgaggccaggcaagggtgcaataattatctctgctagagactgttggtgcactggcgttgaaatcttttgatatgttggataatgcagattttgtgtgcacacattgctttcccaagctgtctacatcagtgtcatgttcaaatgaagccgaatagtttaaaaggctcgctttcacactggctttatttagcttgcataaacattttcccttcaatctcatataaagtcttgctgcgtaaatgcagctgtcctgctcttgtgtcttaatacagatctttacaaagaggcctgttgggcaacatatttctggtagatgattaataagagatataggatttcttttaaaaaaaatcatgctctgactacagagggcaaattcattacccataaatcaaaaggagtaagggatttcagtagtatcagaagccttatctggcttcaatctgacagttaactgtaggccgtgaatgattaaataaaagtctaagttcacccgagcctggataaaataaaactcaaagcccagaaacttcaaataaaataagaaaaaatcataatttttcacctcaaaaggaaactgagaagagaagtatgatgtgacagaaactatgatttcaaatggagggtttcttttgttgtttgtttttcagaactagactcacattttacaaaaggctccctacccataaggaagaaagttttgagagtaatgaggttgatctgaactgttaaaaactttctaactgagatatagcaacatatggtgtggcagaataaaaatggccacaaaatctttaacattccttccatccagaagtgaggggtctatgttccttctccctgagtaaggtggggccactgagtattttcactaagagaattcagcagaggctgggtgcggtggctcatgcctgtaatcccagcactttaggaggccaatgcagcaggatcactcgagtcccaagttcaagaatagcctgggcaacacagtgagagcctgtctctattttaaaatttaaaataataataataaaagaattcagcagaacttactatgcccaggcctcaagaaactggcatttctcttcaaacactagctttcaaatcctgaattgctctaagataagaagtctgccaccctgaggctaccatattatgaggaagcccaagacagcatgtggcgagagaaagggaaagatgcccacccaacctccagctatctgagtcatcccagctgaggctccagacattaatgaactgcagtaagctattcatcctaatgccctgtgggaatctctcacccacaaccttgggagacataataataataaattgtcttcagctattgtgttatggagtagtttgttacacagcaacagatagccagaacatacaataaaatgggctaatcttaagtgtatagctctgctcttttgcatatgtatacacacgagtaaccaccacctaggtcataagacatgtttccagaagcctctctctgaccctacccagacatttccctcaataaacatccccatcctacccccacacaaataagaaaccagtatcctagcttctattatgatagacaagttttgtcagttcttgaatttcatgtgtaggaaatcacatagaaggtacgctctagcatccagcttcttccgttcaacatactatctgtgaaattcatcactgctgctgcacagggcagtagatggtatgttttcattgctctgaagtgttgcattttgtaagtatactacaattatccattctgctgctgctgatggatatttggttgcttccagtttggggcttttatgaataaagctgttatgaacattctcatacatcttcctggtggacaaatgcactcatttctcttgggtatatacctagaagtaaagttgctggatcgcagggcagtgcactcatttggtaaagtattagttcatattccaactactcaaagaattgctcatctgggccacgttatcattgttttctcccctataactagcaaatattgaggcaaaatcatgctgcattaaattaagcaatttatgatttgtccttccatattgacctttcctgactaactacacaatagtattgttctcaatgatgtctactgtcatgaacatgacattgttcttggaaaaatcctatcaggcaaagtcaacctctaaaatagcattgtaataaatatgcagaaatgtcactttttgcattagcccaaaggttttgtatagcttaaggatacatgcagtaagctaactataaaaatagaaacttgacagtggggatgtatgtgtgtgtcaaaataatattactctttctgggtgtatggcagaaaaaatgacactacatccaccagcatgatttttatagatctgcctctttgccagatgtcaccttttataaactgctttataaaaacatgacagtataagtgcaatagtgtgtttattgcttgataaactttagtaataaacttaggataggttgaaaattaaagccttagagcctattcattaagcatttaggacaagtgagtaagcaaaaaatgcaaactattaaatcctaaatgtatgcagatcaagccactagcagcaagcactatttctcaatcagtatgtcttatggaaatatctgccagtttccttgtcattgagctaaatgcattacagccacatctaaagcatgccatttgcattgctacaaatttgaatgaaatccagaatgttacaactgccacaggctcactcaaaacagattaagtctttttcaaaactgttctgtaacttagcacagcatattttacatatggcaaaccatggttccaacaactacttttctgaaaagacttgaaaagactttaaggaatttcttaaaataatttcatagcacacactcaatattttgattactgatggattatacacagcaatgtagtgtggtctgaggactttggattacctgcagagcttgttaaatagagcgatcctgtagtcctttcctaatcgattgaaataaaatctctggaacaagggacccaagaactaggattttattaagtaattccaaatgatccttattcacaataaaatgtgttaaccatagctatacagtaatctaataaaaagaaactttacaggaaagtatattggcccagaagggtgtcattttaagtgaataatgtattcttacattcttaggttcaaactgttactcaacattatatttttaaaaattcaaatggcttatattagttcatattccttttttttcttgtagttatgtatgaacacccacaaaataaaatctacttaagaacttttgaaaatcaatccctataacaagtgcatatataactaaattttcctgatgattctattcatcctggactgacaattgttatctttgtaattgataaatgaaaaaagcagtaaaataaaacaatccctttaccaaatggtctattagaattcctctgatgctcatcacatttttccactgcttactattcacccccagatctcataaaatatttcagtagttaactacagcaaagctactaacatgcagtttgtgttgggtggatcctcacaaaagtgatgctaatatattggaaatatatatacatatatcattatatataattatatatatcattatataatcatataatatgtaattatatatgtgtgtgtgtgtgtgtgtatatatatatatatataatattttccccattaacaaatcagtgtgccaacatgacaacaagtaggagagactgtcaaagcttcacagttgctacagaactctagtactgggaagtactagttcaaaattccattctgggcaagtttttcttctttttttttttttttattttgagacagggtctcactctgttgctgaggctgtagtacagtggtgcagtctttgctcactgcaacctccacctcctaggttcaagtaattctcctgccttagcctccctagtagctgggactacaggtgcatgtcaccacacccagacaatttttatattttttggtagaaacggggttttgccatgttggccaggctggtctcaaacccctcacctcaagtgatccacctgcctcggcctcccaaagtgctgggattacaggcatgagccaccatgccccgccccattctgggcatcttaaacaaaagcaaaaacaaaaaaccctgaacacatcatggtataatgcagtgataaagcaatgtagggcttttctggacattaaaatgtttgaaaataagcaccaagaaaaaaatcacattaaggagcaaaaattacagtaactgcttgcctttttctttggacatcaaaagaaagaactaacaaaaggaaagtcttgctcgatttctgatcattttatttatcttattgtgaaagaaacaacactgaatcaagagtgaaatagaaatcaaccaaatgaaatgacagcaaaagttgcaaagaaaggcatctggggggtgaaaaaataaatgttccttcacagaaagaaaccagttgtttaaaaacaaaacagaacaaaacaaaaacttacaaaaacacagaaataggtcaagcaaattctacccaaatccctcttcctttgggccttgtcacaacaagtaaacctcatcagaggggtcaagaccacaatgactgacatcctgatcatgtgatgtgatggacagagaacttgactccgagtcagcagaatcgtatagtccagtttgacttcaatactcattaattcaccttttaaaagtttctgactctctgcattcatttttgattgctgctgtaacaagttatcacaaactgagtggttaaaaataatacaaatatattatcttacagttctggaagccagaagtacaaaatcagtttcactgagctaaagtcaagttgttggcaggctgattctttctagagattcggaaggaagaatggatttccatcttttccagcttctagtggctgcctatactccttggtttgtagttctttccctcatctccaaagtgcatcctccagtttccgcctctgttgtcacatggcctgctctctgattctgaccttcctcctgccttcctcttcttacaaagacactatgactaccctgcacccacccactttatccaggataacttccccatcttaagattcttaacctgatcacatctgcaaagtcccttttgccacataaggtaacattcacaggtaccaggaattaggacatggacatacttgggggccatcactcagcctaccataatctctttggattttcttcttaatactagttcattctttgttcatttactcatccacccacccactcacccatcaccctcactctacaggagttggccacagcttcccgactagtatggcagaacaaaacggtgtgttgtaaaccttcaaaggatctgctgacaagttctgatcaatatgtataattgatttttgctgcaacagagtacacattctgacagggtgatgtttttaagggaaaaaaaaaaaacaacgaacagagtagatgatggaacggtatatagattgggataactgactgccagtaaaagggcagagacattgattcacattaaggtgggaccaaagaaatgtatcaggttttctggaatgtgcagaactgtgtttacaggaagatacagaaatttgtctcatgagcacatagaagtccgtgaccagaacagcaaacagcccaactcaaacagcagcacagccacaatgaaaccgcacaaataaagtgatcaccgtggaagcttccagagacactgaggggggctgtttctccccagcagtggttgcactgtaattaccatagttcgtttggggttgccgacttttggtcttttcatgccaggatggactcctggttctgagggtagaatcatctttctttaatttcatgggaaggggtagggtaggtgcctacacaaaacagggttttatcaggaagaaaaacaggaaaacgacctaagaggatgcacaatagcagctctcacaaaaccgcagtcactgggggctctttcagtacctcaatttaaagcgctccgtaggatgacaacttatatcttaatttctcccacacaaaatccctctaaggtgagtttctttaggcaccatccagaccacattttaagttacaccatttaaaataaactttttaaattcagagaaaactatccaagtacgttgacactcttacgttgtttatgtataaaaacaattacaacgttaagcttcctcttcatttcaaatttgtttattcttacataagcttctagacaaaagcatactctctgaaggaaaactggggcagatgggggtggcgcaggatagcggcagcgttattgtgactaggtggtggttaagaaaatattttcaagacaacaacctgaaaatcaggcttaagtgccagaagtaaaccaaaaagaagcaatagcaagtgacaaaaatggctaactggagaggaaaaaaaataggatttcaattaaatcataaacgatggctaataaagtgcgttttaacagctgtaacgctaaacataatgcatcttactctgttttaattcaaatattaatccttgtccaatcactgtaatgggagaaaaatggtatgctctgaatgtcacattcgaattgggtagcaattatcttcctggtatcaatgtcagacattcacataaatctttaaaaaatgataaacttacccaaaaacatccaatcaaataaaatgaaaagatttctataaaacttgtgctataatttatttaaaattacaagtaacataagaaagatggataattacaattagggagatataaatttgaaatggaggaacatattaatattttaatctttctgataattctttaaaattacctaatatttttatatcagcaaatattgcctcaaggactcaattgaaacccaaatcgtaatgatcactatttaactaatttattaaataaaacatgttcaattgtacactaaatcaaatgacatggccatcataatggcagagctacaaattttaatgagactgaagaaaacagtaaaaggtctttgaacctgttatccatgtgatcacagataccgaaaacatgcttgtttctctcctttgtggaggctcagggactccccaactctaagcaacagttataataatatttactacgtgcttcccaccctgcgaagaatggacaggcagtatctcattacattctgacagcaggccaggtacagtggctcatgcctgcaattccagtactctgggaggctggggcaggcagatcacttgagctcaggagttcaagatcagcctgggcaacatggtgaatccccatctctaaaatacaaaaaatagccaggcgtggtggcatacacctgtagtctcagctactcagtaggctgagacaggagtattgtttgaactccggaggtcaagtctgcagagagccacaactgcaccactgtactccagcctggtgacagatcaagactaggtctcaaaaaaccaaaaaaaattcttatagccacctaaaaggttatcttcacttaagagatgcataatcaggcattgaggggttacaaaacttgcacaagatcccagaactaaggggcagaggaactccaaagcctgtaggagaactgctgaaatctgaggatctcctctctctgtatatatttaaaatatgatttctgtctcagtctattgaagctgctctatcaaaatgccttaaattgggtgatgtataaataatagaaatttatttttcacagttctggaggctgagaagcccaagatgaaggtgctggcagcttcagagcctggtgagggcttgctctctgctttaagatggcgccttcttgaagcatcttcagtggtagaaggggcaaggaagctccctccaacctcctttaagagggtgctaatcccattcatgagggcagagccctcgtgacttaatcacttcccagaaggtcctacctcttaatagaatcatgttgggtattaggttccaacatataacttttggaagaacacaaacattcagaccttagcaatattcatccatgcttctcaactctcattttacagcagaatttcccatggaattttcaagaaacacatttgtccaggtacagcccatagaaataccgtgggcccaacagcttattttcattatgcttttctgggcaattatgatgcctgctcaatgtgtggaactcctgctctgtgtatttcaggagatcctggagtatattagcactaaaatgtctctttttctaatagtagtacatcacattggttttataaatacttataatacatgacatactacaatgtgaaggtggttttgcatgtgtcatcacatgtgacatcccattaacttaccaagagtcacagggaaagacttgttattatacccaattacagtttgagtcaataggcacaaatgaattatcaactttttgaccttggaggccatctccaactttatattacataatccttttgctttattaacaagaagtctaaggtccagagagattcactgacttttacaggttcacccagttggtaaataagggcaccggacaagaaaaacaagaattcagctcccacaactgatatgatgtgttatttgtaacacctcacccagaatgtctccagccacctttctttgaaacctgcacttgcactgttaaactgggaaaagattaataagtacaatcgtatgatcacatgggtagtcacaacactgtaatctgagaaataatcattatagatgataaagaaagaggtagaggaggaagtactatttttgtgcccttgattatcacattacaaagacagaaactgcgacgactataaaagatgatcagaggaaatgatatcccaaatttgaaccgtctgaattatgaaaaaaatacaatgtttaactagaatgttccctaaacatgtcacactttgaataaaaggagcagaaggactgtatagaagactggcaacaaagacatacaggaaatgtaagattcactatttaggtatgagtttagatttttttgtatggaagtagagcattctccccaccctttctcctacttccaacttcctgcaaaaatcctacacagaggcaaaatatataaaatgtcttaaaaccaaattgttaaggccctgtctcctcctactggggcccaaagtacctcctccctcaaggggacgcagggctcccaggacaccaccgggaatcactgtttcacattcatgaaatacgtagtcagtgatgatatctacataacgtcaagcgtctaagtgcttgactaaattttcccattattttcactttgccaactacatggataataaagaaaaaaatgagaattttaaagctaaaagactcctactggccaattttgagtacttcctgaggatgagacactttccacataagccggttagagagatctcagtgagccagtgtcccaacagaacatggaaaatgaagcccagggaggtcatacaacctggtatatggtacaacatcgccctgcaggctggaaacaaggccaggtcacactgaggtttccagactccacagggagaggaggaaatcctagggagcagatccccatctgtgttgatcttcatgattttgctcacatccctgtgcctcctgtactatcattccggtctgtcttctttacatctgctcagttcctccttaaattactttgacttaaatggaaacattctatctgtaccataaatggaaaaccagtatcacttgccacagatagacagctaaccctgttaaccttgaaacaaaaggatattaaactgtagccggaagggatccctgcctgaggctctgagcctggggcctgcccacgctttgttataaggaagattagcaaatactagaaaggtgagaaagcttccccctggctaatgagaagggttgaaagaaatgaaagggaataacttcccaagcttgccagaaacaccaaggtagggcagttttttttaaccctgctttgaggtctagaatcctttgttgaaatgaaatcttattaacaatagaagcaataatgatgatgctgataagaaacagctggttgtattaggatacaccaggcattcaaatacaagtaaactcagtacttagaagtattaactcatttactcctcattaacaaacttgtgagacacagaaaggtcaagtaatgggccccaaatctctctgctagtaacagccaaaaccctggtcctataaccccagagtccctgtttttaatgaccacccagactgcccctcaagattccagttactaaggccgggcgcgatggctcacgcctgtaatcccagaactttggaggctgaggctggtgaatcatgaggtcaggagatggagaccatcctggctaacatggtgaaaccctgtctctactaaaaatacaaaaaaattagccgggcgtggtggcgggtgcctatagtcccagctgctcgggatgctgaggcagaagaatggcctgaacccaggaggcggagcttgcagtgagccaagatcgccaagcctgggtgacagagcgagactccatcagaaaaaaaaaaaaaagaattccagttactagcaactgacaatagagttgtggttgaaaagggattaaggagctaaagtgttatgctaagcatggttatgaacaaaaggcagaaaaagaacaaatgcgtccactatatggcttgatttgattacttgaaaattattcatttgttttactctttagctctttgcttcctttaaggtaatcacttttaaccctcttctcatattacttggctgatgatataccttggtgtactgttttctttatttgaacaaatatggttactgtgccagtaccttcaacagattcaaatctttttaagggtaaaaaggcttttctatttttcttagactacaaataatgactaaagtaattcaatgataatgagcattctagatatttctgaaggtttctgaaggtcacacaaaggtgactgtttctactgtgctaatatatccctggaattttcattcttaatattttccaaagagcaggtcaacacttcacagcaaaaaaacagagtgaaagagaaaacaatttttttcatattattcatatatgtttttaatagatgattaaagaagaaaaacataccctggaaatgtagaaatatgaagccatgctacatatttttataattatgttttattgcgttctgttaactggccagagggtttttaaaatgccaaaagattccaaattaaattaccattattaagccccttaagcctcatattgagtttagactgtcactaaaaacttttgataaattaaataatatgcagtatgagtattagagtttgaaatgtttaaaagtttctttacacatctgtcagcataacctaagacataaaatggcttacatacatttttttcaatgatagtgttttgttttcaatttgttttttagaaatgtaattaatgaaagctacagagcaataatctagcatctagaaatgccttcagagttgggtttttaaactcttctctaaatttattctgttgctaaaaatacattcattacatttttaatctaacaggttttagtgaataaaacaatgatgtagatataaagctaaatttctacagtacaagacatttcaaacatcataaaccaaggcaaaagaggatttacaatacagagtcaaactacaatggacacttcagaataaaattcagtcagtgtcctctgccctgccagcagggcatttactgtagtggagaggaccaggaaggagattcgctttataggataatcatgttatgttatgcttttattgaatgcacttacattttggactacacaattgttcttgaaatgtttccaaatgtgtgtaatcatgaccgacgtgatggcagggatctacttaatttccgcattcaaaggggaacatgatgcaaatactatcaagcgagggcacttcctgtcatataacacagaagagataagaacttgaccatgagctggcaataaattcatcaacatcctaaaccagcagtcagtccccaacctttctggtaccagaaactggtttcatggaagacaatttttccacagatgggggtggagtggggctggcaggggggtggtgatggtttcaggatgattcaagtgcattacatttattgtgcattttatttatattattattacattgtaatatataatgaaataattctacaactcaccataatgtagaatcaatgggagtcctgagcttgtattcttgtgactagctggtcccatctgggggtgatgggagacagtgacagatcatcaggcattaggttctcataaggagcgggcaacctagatccctcccatgtgcaattcacaatagggttcacattcctatgagaatctaatcctgccgctaatctcacaggaggcagagctcaggcagtaatgggagtgatgggggagcggctgtaaagacagatgaagctttgctcaattgcccactgctcacttgttgctgtgtggccaggttcctaacaggccatggactggtccatgacgcaggggctggggacccctgtcctaaaccatgtttgcttctgccccctcaccctttcccagagtgaatggtaattactgtgtacgatatttaaaaaatggacgatgtccccttaacagtattttctgcctgagtccagagctactagtagtagtgactgctgactaaaggatgaagctggagtaaaacctttcctgtgctgtgacccacatctccccattgctgaagaagagaaatgtaaaaatgctttctggaagaagaatttcacaaggttatgttttccctcagctttccatgatcacagtaatcgaaaaataacactcttagtttacagatttcaatttggcagtatctggcaatgttaattatataaatgagaagagagagataagaggtgggaaacaggaagtgaatgccaggaaaatgaggatccaggtctcctcctcatggaggtcgtccccaggcttcctgcaccagtgacagcacctgccaaccacaacatttcctaggcttcttccctgatttattttctccctagagcttacccctctataacacagtctatgtttcatattccatcttcttcatcagcttctttatcccccacaacaaaatgtgctccaccagggaaggggtttgaagttgttttgttcactgctgtgtccccaggactggatgacagaggatgcccaccttatttaccaatatattcccagcatctagtccaagggtctgtcacccttttcagtaaagtgtcagagattagctattttaggctttgcaagccatacaatctctgctgtgcagctacttagctctgacaccgtagagcaaaaacagccatagccaataaatatataaataaacgggcatggctatgttctaacaaaacattatttacaaaaacagccagaggaccagatgtggcccagagctatagttgccaactccattgtagaccatgtcttgcatatggtgtgtgctaaatatttaatattatgaatgaatgtgataactccaaaccagccaaccctcctatttatcattccagaacaaagaagactctcataaaagacaaccactaccagatgttttaaggtaacaggtattaaaagcagaatgggtaagtaaaacatagagtttgtcctcagtgactggagatggtctctgctgtcctgactaaatgacctatattagggtcccagtgggaacctaattcaattcagatggttcaaatgaagagactctaataaaaggcttattaatggaggggctggcaggcgaaggaaacaagaagggaggtggaggcactcagacaagagcaagagcaggaggtcatggcatccctcaaagggcaaggggaggccacagtgatcccagagccctgtgagagctaaaacatggaggaaggactatcaatgtcaaatgtaatgctcactcaatcagggaagaagcaagaaagagaaccccaacttccttctgctccagtcctctgattttcagcctagccaccatgcttgtcaatcccagatccaatccaactgtaagggagcacaggcaatgtagtctattggaaaagttggaaagggcaggcactgaacacagagtaaggcaggaatgagcagagacagggatctagatgagagtggcagactgagcaactaacacatggatcaattaagatcaaaacaaaatcattgtattagttcattttcatactgctatgaagaaacacctgagaatgggtactttataagaaaaagaggtttaatggactcacacttccacatggctggagaggccttacaatcatggaggaaggcgaaggaagagtaaaggcatgtctgacatgacagcaagcaagagagcgtgtgctcgggaactgccctttataaaaccattggatcttgtgagacttactaactaacaggagaacagcataggaaaaacctgcccccatgattcaattacctcccaccaggtccctctcactacacctggggattatgggaattacaggatagatttgggggggacacagccaaaccatatcaatcatcctactgagtacagaaatgaaaacttcagattccatacacttgacatagattacataaaagaccaccaataataagattgtgccccacctgtatacaatgagctgttccaagccaaaaatgtgtcttgattaatgctgtggtctttaccaggagcagttttcccacccaggtcacagtcttcacaaattggaagcagcattacctctagagtaagcaataaatgaaaatggtgcctttaatttcaaattataaggtaacacactgatggataaccatagcatgattagtcgattcaggacctcaatacacaatagaagaatccatccattatctgctcaaagtaattctttcatcccagcaactttaacaacaacccaggaaaattactgtcccttagcaaagccttttgaatttcatatggatttaattagttaactgccatctcaaggatgagaaccatgacaaatagttgttcttttcaaattagaagaatagactgttcaatgagcaatattgatgtttcccctcacctatttatacaagagattttctacttttttttttctaatttagctaaccattttaacatttatcgaagcttttgtgatcactgttctctagctgagtgttctagccattagccattagctttaaaaaacagctgaaagcagcctccctgtgtacagaaaataccgtgttcctcactagagacccctggcaatctgaaccactactagaggattctaacaagacattctttaccagtggacagaaaagcaaatagagaatattgttcaatgaacaatgcaactactaatcataacagtgctgtatcttaacctgtagtcatgaacctaacccagctgcttgaggcaagcagacccctctttctttttaactgtggaacaatctatagcatgggaaatgggttaagatttggaaaagaagttaggtgagtaactagcagcagaaagccaagcaccgtaagactctacctattccatctgcattcctgccttttctcaaaaagatctcaaagcagaaagaagcaatcagaacaaagccagtcagctctggtagcttgctcttacctctattctagctacatgtcacctcctgtgagaccctctgcccctccagacagtttaagaaacttctcagaagactagacacacactttgtggctactagtgaacaatttatatgtgtgtttatatttctacagaactttgaaaaagacttgcatctatatggtaagtaaatgctcctgatgtagaaaaaagacaaacaggaaagacaaaaccattttatttggtatcatcaaattaaaaattaattgccccatatgttcaaataataacttatagccgattgtggtaatccaacatattggatgttggctttcatgatctcaccaatacatttagcaaatggctgtggaatctggcaataaaatatttccagtctctaagtcttcttgataattcactctgtgttttacaaacaactgggctcccgggattctaagcacatcactcagactgacagagcaagtattccagacaattggttcctggagggtcaagacagcaatgctcgatcaggattcaaacgggtcataaacccttcatggatctctctcaagtgggtggtgatgtctccctagggctgctcatcatttgctgctacagtcaagcacttgtcattatagacaaacaccccatcagtcttaggtcctcatccagcagagtcttactgccaccggtggagacaaccaccggtataaagaaatccaaacaaaaattcggcatgtgtgcccatccaggcatgactgttcactgtgcatttcacttctacgtctgcactttcagcatggccacgaaactcagcacctgtttatctgccatgatttcaggcatccagattgttctggaaccatatatatcaaaagctctaaaacaccaaacccgtttctagaaatttatcctaaggaaataattggacaaatgcctaaaagatgtatgtacaaggtggttccctgctgtgttctttacagaagtgaaagactggaaatgcatcaatctcagtttggttgtctacagaacgggattgcaaaatctgatttacacgtgttacaattacatcttgtcacctaatgccaggagcagactatatatggctttaagctaaaggaacatcaaagtcatgagtgccttggaaaacagagacaggagtgtgcatattttaaagcagaagctcccaaccacagtcttgttcacatccctcagttctttgaaaggcagccagacctccatttctaagggacaaatgtgaccacaacctctcccttttcaagattcttccaaggcttcctcctgtcaccagaatcccctgcatatcttagcgtggagttgaaggtcttgtgcaatcttaagtccaactcacctactgccacttttctcctcacctacactatgctctagacactctggatttcatgaagtacccttacctccaggcctgtgtacatgatgttcatccattctgcctggaatgcctttctttactcatccatcagcttagctagcctcctagtttcttgcacctctcagtgccctttcctgatttttttttccattctttccatgggtggatataggttcccctctccccacatgtccctaagtgccaagtttcatgtttcctctatacattataactgcccttttcatatctctttcccatcagaccttagtcaccttggggtcaggaactttggcttattcatgttttagatgacaaagaacacaattttaggcaatctctaactctgccctcatgcctgccctaggttgggaagacttggtagcttctttgtcactccaattctttaacatagaaatatactcggtccgggtatggtggcttgcgcctgtaatcccagcactttgggaggctgaggtgggtggatcacctgaggtcaggaattcaagaccagcctgaccaacatggagaaacctcgtatctgctaaaaatacaaaattagctgggcgtggtggcgcatgcctgtaatcccagctacttgggaggctgaggtaggagaatcacttgaacccaggaggtggaagttgtggtgagccgagattgcgccgttgcactccagcctgggcaacaagagcaaaactctgtctcggaaaaaaaaaaaaagagagaaaagaaaagaaatatactctactgacactccaggaagcatgccctaagatctgtacctcatgattctcccacattattaaggtacaattgtcctgaatgcacttgtccttcctcaccatttctgtgtaccatgtacacaaaaatgaggggtgtatccaacaagggagctgcaaactagaacaagtgccactagattctttcattaatgctaattaaatatctattctatactaggtactgtccttagctctttacatatattaatttatttggtattcacagctaccccagaagcaatgtcctactattaacctcatttgagatatcagaaaatggtatgagagaggttaagaaaattttctactatctcaaaactcctaaatgataaagccagaagttgaacccaggtagcctggctgcagcatctgtggcactgctgcctttccaacctacccaagatgactgagcctcctggcctgatcaaggaggtatgcttggctatagagtatctgctcagacactagagtatctacgatggaggaaaattcgagcagacagtatcatcacagaaagaaactgattatgaatgaagaacgagctaggtgtcaaatggacatgcagcaacagaaatagacaaactagctggatcattcttttccccagagggctgtgggatctaggaatgggtgttaaccatcacactacttctgaatctcatatacacaggtggaacctgtgggaacctccaaaagactgattttccctcttaatgctattattctgtccctagatgtgaaaaggcaactattttggggagaatcgttttcaacaatatgaggctttatataaccagcttctactcttctgagccatcccttccttgatttcccccaccactccatccctatcacaaccaagaatttgttctccagaaacaaagatgacagaaatcaagttagggacatagagatgctatcacagccaactcagaggaagatttttgccctcccttatctcaaaacctgcattggccgacattgtgtctgctcctagacaccacttaacgaaagactttaaaaactttaggaacaatttatttaaagaaaactccatttccagtatactatgactgtattccaaggtaataaagtataaatgagaacaaggaacaagctaataaactgaaatgaaggctgcatttcaataacaaggtttgggagccatttaccagccacgtgtatctcactctcatgacttataacattggctgaattacttaacagaaatgaaagcgcatattgcttctgttatccaatgctgaacaatgtgacatttgcttcagagcacttgtatctaatcgatacataatgctaaatgtgatttaaaatcaatttaattgtgctcttgctctcccatgagtcaagggggaaacaaaggtatcatttgagatatgaaaccattaggctatttcccaaagaaatcatagatcccttgcttctaatggagcccaagaagtagatacagttagtttacactaaaaactccacatgtgaaaaacagtattgctgaaacagttaagatactgtgccctaaaaggcatatttgaactgtttttttttttgaattacaaaccaattgaacttttaaaaacttctttatttgttgtgacctttctacaaattatagcaaatttaaaaagaaaaaatataattaagaaaaaaacataatattgcatgtcatatatatacttactttcctagattacatacttttaaaatatctgtattcctacatattgaaaccaaccaaattgtcccatagagctaatgtgtatgatttattttaataaacatagaaattgattctcccagtcttaaaacatgagaaagttatgtttgtcttttctgagttcctttctcaagaaaccaaccgtcaggcctcccagataggatcaaggagctgaaactcaccagattactgtatttggacaatgagatgtcagatccctcacccatcatgattgcctaacagaccacctgcttcctgttgatcaacttctctcccttacccctccctaattcctgttttcctacacatggttacatttcttctctgcctacataaacccctcattttagtcagtgagagagatgggtttgacactgacttcccatctcctcagttacagcatgtgattaaagccttcttccttggcaatacttgttgtctcagtgactggctttctatgaaacaaatggaaggacctagactgaacccctggtgtttcagtaaccatgtaatattttctattatattgtttctctgaaaataattgtatagttatatgctgagccaatcctgagtgtgtacaaagatttggacttggagtcacttctagcatccatctgcctgaccaacagttactgagtccccagttggcacaaggttgtattacttatactcaaggaaatgaggctcagaccaattttaaaggagcaaattcaggactcaactaataatacaagagtctctagactttactttatatgaggatgtttaaacaatccaaaacagtcagtaagttccacctgaattgcagtacttgggttgagtgtctcacttttaaaaactgatgtattggccagcacagtgactcacacctgtaatccctgcactttgggaggccaaggcaggtggatcatcgaggtcaggagctcgagaccagcatggccaacacagtgaaatgccatctctaacaaaaatacaaaatattagccaggtggggttgtgtgtgcctgtaatcccagctacatgggaggctgagaaaggaaaattgcttaaacccaggaagcagaggttgcagtgagctgagaccacgccactgccctccagactgggcgacgcctgggcgacagagagagactccatctcaagaacaaaaccaacaaacaaaaaaactatatattgattaaacgaactatctgtgattaatgtacagcctgtgtgtattttttttctacctgcattcaagaaattgtatggctatagtatataagaaacagaatctttttaaattattttcctaacaacaactgaaaatagtcccatacaatgtacccaacaaaacttcctttttcaaaatttgctttaaatggacaaaattatgtaatagtgaagtaaacttttattaaaaagaccaaattactagttgaagttaattgggatagggttgttttataacactataacaaggacattcacacaagataatctctgatttgtaaaggaaaaaataaagtagttcacaggaaaatagtcaattttatggctcttgtgtttaaatagagggaagaatgtcaaaattcctataaacttaaaatttaaaatatcttcagaagttgccacaacttaaaaaaaacttgaattgcaccaaaaatatctagaaaaattttaagcagtaagtatattcttataaacatccccatattattgtaccttgtcttcccccttgaccaaggttttagactaaattcagttgacaacaggtaacatagctgataaactgaagatctctgcttggcatttgatagttcatcatttacatgggcaaacaacccacataaattcaaacactatgattcaaacatacagattcaaacactatgccaggaatgagcatctacagtgtatgcggttcaggagggtaaccaatcaccacacatcatcattgggtacttgatacagggttagcccaaatcgggtgctgtgttagatatgtcctggatttcaaagactcagcacacacacacacaaaaaagtaacacaaaaacctcttgtttttatattgaccacattttaaaatttattagatatattgggttggataaactatattaaattaattatgcctgtttctctttacttaaatgtaagaattactttggtgacctactttctattagacagtgctggtaaagaacttaaaaaaaatggtatgctccaagttaccactaagaaaaatttttaaaaatacattaaattaccaattacatttttttctcagatgaaacatgcatatgttaacacagaacatattctgacagatctgacagaaaacatgaaaaagtgtgctttctatcataatgattatttttcagataacaacagctgttggcctgtacaagcaagaagctgtttttccacatactaccaagtattagcattcaatcatgaaagaaaactaattctccatgggctctctccacatgctttacatcagcagcaagctgtgcactcctatgtaatctgaaaagccgaaccaagttggggctgcttcttggctcactgctttgccacttctctctaatatggcaaatacaaagcactcacattttgctgattcagaagtaaatgaaacattcaagacctgcacaaaaaccctgaccaaaaggaagtctcagacaggtgagcgccattttggctcttctttagttacaaaggagattaaaagtaatcagtctcttgaatgcctatgaaaagagtggttaaaagtcagctgttaaagaatggctttattctagaacacttgaacatagcccaaattttggaacttgaaaatagtttaaagttcccttataaatttcaagatctcatttatcacattttgtgctcaagaatcacctcagctgccaaaatctaaatagatctgtgctatccaatatggtagccaccagccacacatggctatttaaattaacaaaactttagttaataaaaattggaaattcaggtcctcattgtccatgaccacatgtggctactggcatagtagacagaacagtggagaacatttccagcactgcagaaagttccgttagacagcattgaattagataataacatacagtaagttagcaattcagaaaacttaaagagagaagcaaatagggcagaggaaggcatgtgactagaatgcagactaagactatttaaaaaaactcactgcagttgcattatgtcaaagtaagcaaaaaaaaaaaaaaaagttctttgtcagtttgatgagtgtatctgttatgcttgaagatgtagacagagagaaaataaaatcagtggacagaaatttcatttatatatactggttacgtacttgccacgaccacacacaaactacaacacagaccaaaattcattactgatgaattatggttttgcttttctacaagacggaggtaagcttggcaacatttattcttgggctaagttcacaattgagacaacaattctttccttaatgtgataaattatgctgctctacattagggaatgcatacttttttatcgaaaggtaggaaaaatcgcaaggtgtgccttctctattttttttttccgcccactaggaagacatgaagttctatcagggagttaaaacagttaaataatggttaaaagcctgcttctggaatctgaaaaactcggtttcgtggctttactactttctagctatgtaagcatgtgttctgactgtctcctcatctctaaaatttaaatgaagtaatgcctgaataattcttggtacacaccatttctaattaaagggatgcttaatgatgcaatcattcttcctttgctgctaattactaattttgaaatacatgttatgttttgtcatgacacatacaaataagcataacttaagtgacaaaaccataaacctatggcaaaaataccacagaccactcatatccctcagaggctttcatggtggacaagttagccgtgctgtctcgtacaccccactgcactgagttgctttgataaactgagttatgatcctgggagagagtactgaaataagacagacacactaaaggcttctgggaaaccacatgacatacaggtgtacctggggtttccataaagcccagagatggcagagaaagactcttgggggactggaatgtctgaaaatcccataaagaaaacagtttgcattcctggtcactgggtacaatcaaactcaggaagtactttgtatgggcaccgaagtgtatcctggaatacacagtcacacattactatcaagcctgggcatttttaccagttcgaaaaatcgaacacccaagtttccatttgtaaggtaatttttcaaataatgtttcttttcgaattttttttcccatttatgtagagaccttgagagaagtgtcatacctgagatgcagcaggggacaggatggaatgcgttttctagagaatcttccataaagggaagcatacatatattctgcatcactaagattaatcagaagaaattgctcaaattccaccacattccactttaagactatagctttcccattaatcgctactagcccgaagacctgtccaatgctataacagtgtatgataaagcatatatacctgatttttcacaatcatctataccacaaaaactctattcctgtaaatcatctaattatttagagatcctatttatttatttacttatttatttgagacagggtctcactgtggcgcccagactcgagtgcagcggcatgatctccaccaggccttggcttctcaaagttctgtgattataggcatgcgccaccatgtctatgtctggtcccagtattttatttacatccatagtatatatgtcagattgtttcttatacctagaattgatagaaatcctttatcacatgctgccttccaaaaaagagttcaaaaagcatggttaccacataaagacttgcagttactagaccacttagatgttgcctgagaaagatagagcacatgtggttttctgcatggtatgacatatctgaacagcaccagtgaatacagaagaccatggcacataatggtggtactgtgatggggaataaactgcctatttatttattagagcacataaattaccaactgatacgcaaaacaccaactgcaaattaagccttccctcagaattaaagagaaaagaggctggggaatggaaagaatcagatgggcctgcctcaaacctcagcgcactacttaatagctgcatgacctcagtttccttaaccctgaaatagacataacaaggcctcctttacagacttagtgtaaaggaggggacccacagaagataccatctggcatatagtttgtaaaactttacatttgctatttctgttatgtatttatgaatatacacatataattttatgatatctattgctataatatatgcaatatgtaagtatgtatgcacatatgcatatgtgtgtttatatataaaatgagtgatttttgctctttgatcttcaaatattttctttggatgtcaatttttctttccttttttttctttcttgatttggatctcaggatccaaaagtaaactaactttcctaaacctcttcagtattaaagagagattcattttgagccagcacactatatttctagtccatatctgaatccatatctgaaacaaagaccacgtctaaaagtaatactcttatttctaattctcacctaacacacccatggaagataagaaaattaacttaccaggcagcagtaacttcttggaattctatgctcacactttgctcagcacacataggcgttctgttgacagttggctctcaacacctcaagtacgtgtcagagggacgcgagccgatcagtttacccaagctccttacttattctcatttaccctctagaattttatttcctgcctcagaaagaagaatcccatctgccagaaggaaatatttgtagccaacatgacaaaagtggaatccctattttgtaacagctgtgaatcaaaacactagtgactgaaattaactacatcgtgcttcggaacagatgtgtgcacagaaaccaactcaagctctggtgttcctgggcaccatgtgtaaatcatccacagacaacacggtgggccatgttctcaccttgttgctatgcacgctcatttttaatgttctcctgaaccattgcagactttgagatttttttttaaaggcttagaatctttatttccaaaagaggagattctgaaagttgccaatcactcactggaagacctaactaaacagatgggttttgacacctctggtttgattttaaatgcaaacatgtcaaattatgctctggcacaggttcttctgcctcaaaattttatggaggggtgtttaattttttttaagttttcttctctgaactcagttgttccaccattagcaattaaggcaataaaggacttattacagaaacagtgatatgattgctgtattttaatgcagcagccttaagtaattgaaaatcattactaaaaactttaggaaataaatttcaagaacagacatctgcaaatgaagttgaaggtaaggtcacatttttatataaataggaagcgagaagaaaaacatatggctttctttggtgactcttcccataatcaacatacatgtattatctcctacaaccgaattagaagtaagtggtacattgcctctgatcactgttcttgggagcccatggcagacaatggtaatccactgcagcccttccaccatccatgcccttcagatgcaaaagacttgactagctgctctgaacagatacaaatcaagggaggacttgaacttcagacaagtaactatatggttagaaagattaaatatacacaaatgtaatcacttgagaacattttaagcaacatgtcagaatatgcaagacgatgggctgcaggataattaattattgagaatatacagttgacccttgaacaacacaggttttaactgtgagtgtccacttatatgaggaggacttttttctttttttgagacagagtctcactctgttgcccaggctgcagtgcagtggcgtcatcttggctcaccacaacctttgcctcccaggttcaagtgattctcttgcctcagcctaccaaatatctgggaccatgcctggctaatttttgtatttttagtagagatggggtttcactatgtaggccaggctggtctctaactcctgaccttgtgatgcgcccatctcagcctcccaaagtgctggattacaggtgtgagccactgcacccggcctatatgagaattttttttaaatgaaacatggattaatagtatagcattggggaatatgatacctccatatttggatggctgacttttggtatctgcagatccacagagccaaatgcgggacttgagtattcacggattttgttatacgatgagtatatccttgagtacacagaaggatgactgcgttctcattccaccgtgggggtgtgttgttttgagctggatatatccacacagcactttagtttgtaaggtatacctatattaagcctcatcgttgcatgtattattttgtaataatatgttgaatttataattttaaagggttaaataaccagtacagtttaaaaattgagtaaataaaaactgagaaattaaaatctgttcaaataagcactgcatttaaaacccatagatacacaaactctacagaagcctggagaaccaggcccacgtggagacaaaggcaggattgaatgagaaaaatgtgtttctatcacaaatcataattacttgtagaaaatctttttactgcgttctaagctctgttgggatccatgccttgaaggtaacacaccattggttgctttttcctgctctccctcttgattttttttttaatagactgaaggtaggaaatgctatatgcttatctctgagaagatgcctctatgtagtctctctgctttataattagcaacagtctttcccaaattctacacttagattgacttccaacttaacagatgttacagtgaatttcttttttctttttgtgtcttcatgggtattttagtgcgaggtaaccaaaggctgtgtgtaaggctaccagggaaatattcgcaccgcctgggtcagaaccctgtacgtggcatgggtcttagtaatcttgcagaattttgttccttagttcagccaaaacgaggttcttgtcacatgaccagcgaggattagaaacgtggacacattgaagggtaagggaattggaatttattgggtgaaaaagaaaaaagaaaaaaaactctcagcaaagcaagaggggatcctgctaacaggccatcacctcacacattgaattccaagccatacacaggacctgaagatgccaggctcctccccactgcacaggaggtgaacttcccctggcttcaccctgttctcccaataatgtgagggtgggtcagagattctccaggaccctccttttatctgcatcctgcatctatcagtaagtagttattgaatacacaattgcatgagcaatgtttaaggagcagagagagctctttgcatagcatatcaggcagctgatcactcaataggatttaaaagtcactgaatagactgctaggttccatagtgtggcagatataacacagggtctgagattctcatcctaggtttatgaatgttttgtgtttggacaccaaattctgattttaaaaagattactgtgataaaacctatttaacataaaatttaccattttaatgtttaaatatacagtttgtgtctttaaatacattcacattattgtgaagcttttaatagattgaatattcttctcttctgatcaacagcaagatgatttacataattctgtaaaactatgagttggcccattccctcaagtaaagcatgaagacttaaaagcaacatggaacacagaaagagaaaaaactttgagcccaacaagattttggctttgaaagagaagtaagatgtttaactaagactcaatggaaggaaaaatattgtctggagatactgaaagttgagaattataaagagtgattacaaatgcagaaggtaaaagtattggagcaaaaattggaaatctgctcacatttactggctttttaagcaagttctatcatagaggatctctcatccaaccttcccaaggaatttgtcatcactctaatccacagctaattttggcacagaaattatattagtaaactcagccatattgtcttctcacatgaagacaggactgatgtcctctaaataaaaaattagagtctatagcgatttgtttacaataacaactgatagttacaccccagggatcttctttttgcatatcctggtttttaataatgaattataccttctatacattctttcaaaatgtaaatcaatatactaaaaaaactacagaataagtcaacataaattgccctgtgtgagggtgcctagtagaccaatactaatattttggaggagatttctactttgtagaatctactgagattctgaaagctgcctgcaattctgcaagtgtagggaatgggggaagagacagggcagaggaatgaagcaatggacttatctaatcaaaagcctgattaaaacactccctagcagtctctaagatagaactatagggaggcagcaggcaatcaaaaggaagaggtccagctatttaagtatagctcatatctattcactccgttgtttgattagatttttacctgtaccaagtctatgtaggtatgatgaagaaaggtggtgtattaaagatgaggaaaggtggtgtattaaatattcctaacaccactttccccagatatgctactaataccaccccaaattttccactacgctttgccatcatgccctttgaaacctaattaataatgtttcatttttaagatgatagtctaggctgcaattttaaattggtaagactaatatcactatctatagtagaatacctctttcctccacccacattctgatgcactgtggatacatctgtccacaacaagagattaaaccatccctttctgtctttacttctcctttaaaagccctggactgtcttaatttttgacagaaactaacttctttcccaacagtggtggactactagaattccatgaagcatgcttttggtggctcatgttgtaaaaatcatgtatcactttctcttgtgacctgtcatcaaatgtgacataatttaatgcaacagctccaattttaaggatggcattttgcactttgctttcaaactctatgactacagttatccaacagaagctggccgacctcagtggaacagacggggatctgttaacaggttgccaactttaaattactgctgagtagcttagcatatctctagaataattcctttaaaaagtaattaatcattatttcaaaaaggtcttcagtgaagtgtattttctatattttactgatgggtagcatttgattggaaacagctaatacttctccattctctgtcttgcatttacatttttactgttttcaatattgctgtttttgtttgatgacaactagggacaactcagggagcagactgagatgcgtccaacaaagagaatatgaatagcaatctagaagagtgaacattaggcagctaatgcatagaaatacttgtattttgtatctattttctccatatttcaactgaagattcttgcctcatgttggaaacagattgagaaaagtcactcgtgtcagtactacagagaacacattccatgagcccatatcttcagcaatgtgtttgcatcctagaaattatttcagattatgctctctcttgaggccataaaaggcaaacactggaggaggaacagtgaggagaaactacataaatagctacaggctgtattttagagacgcctccaaacttgttagaagataacgtgttgacttttagggtttgtcaggaaagttaataaagctagatttataagtatctttcaagatttttttttctaattgaaaaataagccacacgaaaactgtattctaacactctttggaaactggtatcaaatcagtccatcacccacttcaaagaattttattagccaagatatcataaaagtctacattttaagattttttctttttatcataaaaaatttcaaagacatagaatgatataatgaatcatttatacctccactatcactcacaaaactatttaaaaacaaatcccagatgttacttaaggcaatgtcattagcaaatttccctttgtataaacactataaattgctttaaagtaaactttatgaaaatcatatgctttatttaagattaggaacatcctaatcccttttccccatacttcacaaattttaaatcatttgtgtcatactggtaatgaacaaattactaagtgtgtacaacagagatgatatatgttgtcctcctattagggacatccagtacgtgtccatgacaagtattcccctggatcttactacaggtccctgttgaagctgggcagggcctcacagtgagttccaacacagcacaccaggtaacactaactcatcaattagagacagcatgagaactactgaccttcctggtctacagcttactgtcaaggaatctcatagccaggaataagcttctttaccaattcctgctattgttaaatacctacaatcacactgttcaactaggaggagaactaagtattcatgatggcttggacctatgtggatactctccttgcttttcaagctcacagagaatggataaattattagatttcagaaaaccaattgtagactagaacgagaacctagaatgatctaccaaatccagtttgtgactaaaagatggcattgtttccattgtcaaaatcatgaaagtagactatcgtctcaagatagaaacaccatctttaccttccattatggaccttttaataggaacacagtgctaaattcctaaattacaacagtttattgaatcttgaatgacatcagtagtaagacctaccattattttatgcactttaagaaagaaaatgtctttttgaaaactatgacatgctatcaattataagaaacacctggtttcacagttactaacatatttgtatatacacacagatgcattctattaatttgtatttaagctaacatttcttacttgaagatgcattggtaatttattgataggaaaatcacttccacaactaaggatagtttttcacctttgttgctctgcaaagcttggtcttatctattcttccttttaagatttcatttccaccatcaatcccaagggcaactggtttaacgtaatagagaaagtcctggctagggaagcagagtgtgttccctgccaacatttgcccatgtctgcgcccaaatacacagtgactccttagagagtcctcacgcaatgtccatcaattaatatttttattattagagaggctagtgctctttacagcattggaaacctagaaattctaccagcttagccagcttttgctacctataagagtagtggaaaaataacaacatggtaaggatatctttctgttttcactgatctgaagtcacaagcctataaaaccattcaattataaatgtgaaaataaataatgctaataatgacagctcttgtcaactggacatgcccaaagcagactggagccagatatgtgcactgagggaagtgggtggagccacagggaatttgcaccttacccaggggaggagcctgtgctcttcagctcatctgtgtggcctggaatcgatctatgagatgaggacctgttagcaggaatcccccacgctttgctgagagtttgttttcttttttccttttcgccaaataaattccattcccctcatccttcaaactgtctccatgcctaacttttcctggtggtgtgacaagaacccagttttagctgaactaaggaacaaagctctgcaacagttgcaactaaattgcattaaaacaagatgtgcaagatgagttttgagacctacatccttttattaaggcagaaaaattcaagtccataatgaagtcaatatgaaaaggacctgaatttaggtttctgtagcaatccattttatggatgttgctttcttagaaattttatgttttaaaatagatttttaaaatttattaccttaaagattttttcctgtagatcatatggacacttaatttcttctatcaggcgtatcatctagaaatataatgcttacatgggaaatatattatcttatgatttgataaaaaatagatggagttgcaaatatacttttatgatattcttgaattttttttttccaatgcaaagattcccaatctgcctaccaactgaactgttttggtcgtgaaacattaccttctcggtatgtggtatgcctatcagcagaaaagtagtaaagaagaatagactaactttagttattacatttgcattgtctacaaagccatttacttaatggatgagtctcattagcagtccaaccacaatataaagaatacaatgatgtgtttcataggttcattaaaataatatttcaaaggagtcattagaataaaagaagctgaagtttcaacagacagtaagttgtctgcaaataaatgagatggaaccaacatgttttcaagtaagttaagagacatgtttacaaatacattacagccattaaaaaaggaagcatcaacttagcaagtgctggggggacgattactcatgcaatttactaaaacaaaactgtaacactctcacatcaatagttattgtagatgcaaacgcctgtaggtacaggaaaatgtgtcttaagaaggaaaattcattctacagccccgagatgattctccacttggaagcaaaattgaaaacattcaatcctgtcttcagatcaccactggtttggggggggggggggtttgttttttgttttgttttgttttgtacacacttttgtgttatttgccccaaaccccaagcatgcctatcttttcatttttttttgagacaaagtctcgctcttgttgcccaggctggagtgcaatagcacgatcttggctcactgcaacctccccctcctgggttcaagcgattctcctgcctcagcctcccaagtagctgggattacaggcgcccaccaccatgcccggctaatttttgcatttttactaaagacgaggtttcaccatgttggccaggctggtctcaaactcctcacctcagttgatccaccctccttagcctcccaaagttctgggattacaggtgtgagccaccacacctggcctaccctttcattttaaaaagaaattcatggtaaattagtaacatgaataatcctgtaagggcaaaaagtatactgaaaaaaaaattgtgtctatttgtaattatctaaccacacctaagaattgacaaatgtttgtttaacaaatcaatggatgaataaatgaatgaaaaaagcaattacttagcaaaggagagtttttagattaggttgttaattattgctgctttatcaatttttaaacccagtatttccacctgtaagcaaaataataaacagcttgtatatatgttcaataatgttgaaatcttttcacaaatagcagtgtcaaattttttttaaccaagatcatagagtttatattaaaactaaggattttatttttgggtttttttttcacaaagaaaattaacatgtagaacaaaataaaaaccactaaaggaatagagattgccatttatttattaactttccttttttgaaagagcttagatttataattctaagaaatacaaggtaagacacacacatgtgtaagtatacctgggacttggcaataagtcacaggcacctagaccacagctcttgtggcagagagcaaaaatggccccatgtaatttgcaatgtcttcccactctgcatcctgactcacctttggatgcttggcttagccatgtaacttgacttggccaatgtgatatcagcaaatggacttggaaagagacttgaaaaggctttgtgtatttctctttgtgctcttcctatttgccatcagcattagaacatgccagggatagcctgctggcggatacaaaatatttagagcggagctaagtcattcagccaagaacagcctagatcattgcccagccagctaaccctgacatgtgattgaacttagccaacctcagcacatttgcctaggtgaccccagctgattgtaggtataagagaaataaacatgtgtagtatggcactacttgacatccaacagattcacatataagctttgtactttgcagtaagattattctccaaatagaacatcaggttgcataaaatcaaagtagtactgggttttattaaagtaactaataaaaaattattcattttctattttttaaaagagaaaagacaaaattaaatttgtatgcacagtctgaattttgaagtgctggaagcttactcaacaatacatctactgctgaattcagctcacaagccaccaagtgtcaacctctgttctaggtactgagaagattccatgatttcaagctgtttacggattttgtgagaaggacagacacatagtgcattacataaaagaaattaaaactattatgtcttaatgcttaccacgtggacgaatataaacaatttggatttccagatgttttctggaatgcttgctattttgcctaaaaggtaataatcagaccaatccctacaattaaggagtttactctctattttttaaatatataattgataagcaaacatattccaaaagattcattgtaagtctaagtttttcagaaggtactaaactccaaaaatatacaagcctccaaagataaactgtttattaataaacgtatatataaggacttcagcaaacatagcttcctgagaaaaagcaattcaaagatcaatatttccttttaaattttacacaacttggacaaaattttctaaagaaatcacaattttaaaaatgttggaaagccagttccattgctgaattcataaggtaacttaccgtaaatcatatatgattatcatatttataactaacatcacatagccccttccagactgtcaactccatgagggtaaaacctagttatgttgacatctgttttctcaagcagttagaatttcctgattcattctcttgtctatctggctggaacagctaaaattaaggcagtggagatcattagtttgataaaacaatagaagacaattggtattggtgtaggagccactcaccagaaatgctgtaagtaatgactaggttctgcagaaataaaattaacagattattacagtacacactcccatacctacatcaggagtgaaaggatcaagcaccacagttaaaataataatgtcagttgcaactggggaactgagggtcctggagactcccaactcagatgcctgaagaagccagggcaggtatagtaagcaagcagggaaaacttggtaatagtgtacatgtgtacttggcttctgagtagtgggagatggcactgaactggcaagcccatatcccaactaaaagtgggtttcagctactaatctctaaccaatatttgccatgtagaagggtagagctccaaactcccatgattttatatatacatattaaatggaaccacaaatagcaatttctacatattatctccaaaattgtacgtaacgtcacaatttttaaaaccattatgtagaacaaataagacacatgtttaagcatttgtgctttcccaaagatgatgtcacctttgttcctggtccaggaagctaaaaacaagtaagaggtgacttcctcccatttcttctccctccttcctccctgtattccaccaacagtgctacttaaagtatggctatggaatattgccactccaaaacctatttttttcttttttggtctaagataagcgtgatgaacaggtaaactccatgatccagccccctgtattcatgctcttgtgtgtaatctcctctcttgagtgtgaacagtgtcagtgatttgcttccaaccaaaagaaatgcaaagatgatagaatgttactgctatgattatgttatgtaaaactccatcttgctagcaaactcactcgagagtctctctcccttgttggctttgaagaagcaaactgtcatgaatcctacagccacaaagaaacgaagtctgtcaacaacctgagggagcttggaagtagatcccttcccagtcaagcagctgatgagaccacagccccagccaaaagctatattgcagcctggtaggacactgaagcaaaaaaaagccattaacccatgtctgaacttctgactcacatgaactatgagataataaaggtgtgttatcttagcaccactaaatttggagtaatttgttatatagcgacagcaaactaatacaaggggcctaccccttaatgttaattaactgtatcactaggcacattgtttagtttgactgatatttattttttgtaatagtactttctcaatgaaggaagcaatacattgaattacactcagacgcaagccacctcatctcacagcagcccaataccttgagttctacagttgatgggcatagtggaaagagaggtctggtgtaactttatatgcagaaaatgagaaaggcacattttcttcctttgacttataattttgtctaatgatatatgcaacagaggtagtcaagagcagggtcagggaaatggagactatggtgaaggagttattacctgtaatacttctaagttgcatcataaaaatttgctatcactacagataaaagcaaaggatgagctaactgataatacctgtaaaatgctgcaaacaccaccatgatgtggtgaggaaagcaagataaacattcctatagaatcctcctattactacttgccctggggccttgtgaaaatctagagaatctaatagtctagtactcagctcgcaaggaaaccagtcagtcatctttgtcattctctgctcatatcttatttcctaacacaacaaaatcacttatagacccatgcagaaaccatgcccttccttctcagtcctagacctggctaacccctgtgccctctaaagatttaattagctagctcttaccctgaagaagccttctttgataagtttgttcctccttatagcttgctaacatcctgtgcaatctccatcatttcacttcttgccctgtatcgtaattagctcttccggtgactgtcttatccactggagtaattaattgctacttaagataagaaaccatggctctcatttttgtatttccagcactgaggagcatgccttgctcatagaaggccctcaataaatactaagtgcagagaaaataagtgagttattttactagaggctgcataagagccaagagaagcaacttaattatgaggcaacaataagcttggatgatgcagacaaaaatatgctaggagattttaagcactcagtctgtcagtggtgagcctaaaacaggttcctttaaaggtaaaagattcatacaaaacaatacgaaactaagaattgtacaactcaacacatgttaaaattgaaagaaatatcacaggtactcactatacccagatgtcaaattctttcatatcttgcttcaagcagcatgtgtatattaactcatatttaatacaaaaagctatgctttttctaaaagcatttcttttttaaaatttttttttaagagatggagtcttactctgtcattcaggctaaagtacagtggtgcaatgacagcttaccgcagccttcaactcctaggttcatgtgatcctccggcctcaggctactgagtagctgagattgcagttgtccaccaccacagtcaggtaattttttaaaatttttattcatacttttagaggaagggtcttgctatgttgcctaggctgatctcaaactcctagcttcaagtgatcctcccaacctcagcctcacaggtcactgggtttacaggctcaatgcaccatacctgacctaaaagcatttcttatcagagtcctacttacccagttttgtcaggtgccaggaaataggggagctcttacctaggagctccctctggtcagagtggcctcgcattctcagtgtgggggattcagtcctacatttatacctcccttggagatcaattccttaaagcaaaacaggtggctcactggatggcattcactttcagttgatcaattgatttgtttggagatcagttcttaacatttatttcaacagtttaacaagataaatttgaaatcatttttcctaaaaaaatttcaaggtgatcttaatattattttaccaacttcaactatgaccccttcttcagacttaacctaattccttctgaaagccaaaaattcagacccatttaccatgaagctgaatcctccactgcttctctaactacctcttccatcggccctaaaacattaaaaaaagtggggtgctgcttctctttttctgtaagatgcccaggcctggttggtaaaagtttaactgcttaggtgattattatgcactatacaaagtatactacatatcaagtgctctgcccagtagagggtctactaaaaaggcttaagagtgaaaactgccaaagggaatttcttaccttccctcagggcacacagaacctgaacctcagtaccaggtgttccctacatctccttctgctggtgagtctaaacctgaattactcttctttgtctaatcaatttagacaacaaattaagcatgaatactgcttggcatagtagccttaatcaaacaaaaaagtgagattttttatttttttaaacatctatgcaaacatagagcttttgttagaaaaagttacaaattaataacattaaataaagccaactctttagaaatgatacagaatagccaattcccagaagtatttgagtggctgaaaaacaaatctgtaaaaaagtcaatctcaagcaaaaatcaagttaaaatgagacagacacactttcaaaattgcagtaatttttaaaaatttataagaagtgtgtaaagaagttgacattcatacagtcctgttcagctgatagcttttttagagagaaatttggtaatatgaccccaaaaccttaacaaattttatatatttatcctatctattctacttcttagaactctaaggaaacaagaagagatggccagagacttatgtagtaggatttttctatcacgatgatgggctggagaatccaaatgtctcacgataaaaaagtggcaatataaaaaatggtatgtgatacaatagactcctatgctataattaatttttatgacatatgacatgcttgtaacatattaaatgaaaaatggcaccaaaattgtttaaaatacaattattttatttttaaagcatacataaactcatagtaaaaaagtatgcacattaatagtattagtcattacctgtgaaaggcagactgattagtgacttactttattattcctatccttattttaaacttttccaacccatatatgtggcccatcagatttgtaaaaatgaaaatccaaggcataggatttgaaggcatacattcctataccctgctaaaaacagactcagtttagtatctccttaggttctgatataagatgattctcgaaaaagccccaagccaacccagtctgaagaaacagatacagagtagttatcagaacaagaattcaatgccagttaagtcacctttcccaaatttaattctaataataagtccgtgttaaaaagcaaaggttcaaatattttagtgttattgagaggattagctcactgctgagagtgaatataaaaaacaattctatatcaaagccaactaattcaatcttatttttaaatgtcaccaaatatggcttctctcaaagtacgccggtccaattggtaatatctgatggctgattctgcttaactctactaaatataaaccattatcttagggaatcagtagtatactttattcttgttattctttagtattttgttagggatcataaaattggacttgactttgaggacaggactggctaagccagggcagttagtcctatggaccttttcactccgggagtctgtgactacttatccttaaacatttccagtaaatttatgttttagttatcaatcagttatctgtaaactagaactttaaagaatcctaaaacataaatctttttaatcctcaatgatttagactctctacatttttaaataattcagtcaaacaaaagaagggtaaattagtcattttgtgtgtcagataaaacacacatgcatacacagaataaatgttttttgttctcaaaggattttgttgtaacctccactcgtcatgtaacactggaacaaaatagttaggctaattacccaaaattaagttccacttctcgatttacaagctttccattttattctagcaattcttagctgtcatggactcagaaaattattactgccatcaattggaagattgttttagtggtacagatggctgtccttttataggccaacttaatgacttcttcttatctaatctgtcatctgttatttagttgtcattatgaactttttgggttgcatatcaatccattttccatgtttactaaacagatggctttatttgagaaaaaaaaaagcaaagcaagaaaatgacattgcatgattaaaaaatttcaaaaggctgcatacaatttttaatgttcctaaatgaaatgaaaaattgctattaaaaaaactaaatttgaagtcaaagtgaaatagattttaaaactcaatggacatgcaaagaaacaatcagcagcagctatctacaaatagaacaaattacttccaaaacagcaataggttattcttccagtttttgtcacaaatttttttttaaatttatcttgacaaatagatgacaaatgtcaacgaagtaactcttcaattcagaagctctttatgttgtaattcacaggtgtacctcctttgtctagtatttgtaaccttatttagagagtaggtaatgacataaatacttccatttagtgaaaattgttccttatctttgtctccttatgatgattttgtttaatcactgggtcattatcaaatcaacacccaaactcaagaagcgtaagggaaattgtaaagggcttgtatcaatgagttcagagatccaaaaataataactggcactgtgccatgaaagaacactgtagttcacactgtaccagagaaagaacttgacaattattagaaactaaaatacataatcatgaaataattttatgttacatttatgagtggtatttaaaattgtgtttgttcaggaaggatatttaccaagtcttgggatttgctgtatcagcctataacaacgctgcaaaagtaaccgagcagagccttctgaaacagtttcccatgccatactaagcacatcctccattgtagaacagattgagttcaactgtggtttttttacttgcccaagttcaaggctcctgagcacaacaaaaccaacaatgaggaagagcatgatcgcataattttttatgttcttcagacaatgtaggagaacttaaaatggacagccaatttttcaaaaaggacaaattatttgaaggatttcttttcttatatgataaccacagtaaaatgtaagactagtgtaggtaattgtcctgccactccattctaagctgtgagtgaaagtactccatcagcttaatgagaacaccgtgaaatataaaacatctatttcaatacaagttattgagaagctttaacaggctttcgggagaagctaccaaaagaaaaccgaataccagatacttgatttgagactgacaaaaatcttctattctttcctacggaaaattaaacaaaatgggctattatatagcaggaagacagagacaaaaaaaaaaaaaaaaaaaaaaaaaaacggaagaaagagtaaattgtatgaatcagaaacttggaataataattctacctcaaatacttctcttaggtcttctgctcacatctttcaggcagagaacatctatttgatgccaaatgtgtggctagaactgggccaggtgctttacatgtcatagatcaataccaaacaactagtgaaatcagcacaaattcaaccaatgaagctcttaaaacaataaggtgaaaaaccacattgttgaggagagccatacaatacagtcaggttctagttcaaattacgtttctttccttgagatcttctggtccatgatatgttttgatctgtctaaaatattatgtaggcattctcaagtgattaagaaactccggattgtttcaaataatcaggtcttccccaggcaaacactggagatcacttgttttttgtttgtttgtttgtttctgagatggagtttttctgtgtcgcgcaggctggtatgcagtggcataatcttggctcactgcaacctctgccttccaggttcaagctcaagcgattctcctgcctcggcctcttgagtagctgggattacaggcacccattcttgagtagctgggattacaggcacccatcaccacacctggctaattttttgtatttttagtagagacagggtttcgctatgttggtcagactggtctcaaactcccaacttcaggtgatccacctgcctcagcctcccaaagtgctggaattacaggcatgagccaccacgcccggcccaatatcactttcaatgggtcccaacacattaaatgatgatttcttgacaaagttttacacactacttaaggatcaattgacatcaaccctaactcaaagccaggaagcttaatccaacatgaaaatattctgtggatgttgtacttaggcatattattctctgtagtatatactttcatattgatacacatatttaacatattgcaaagcatattttaaaagcattgatctatgttctactggtaattttcacaacgcttaatcacatggccatcatagtctttgcataagactaccttgttgttcaagaatggttttagcattccatccttctccatcatactggctcagaggtgagaactgaccttctcccagtagataaaagactctcataattgtattatgtacagcagcatcagcatcacctgggaacatgttagaagttcgaactatagacctccaacccaaacctctggaatcaaaactcaggagataggccttagcaatttgtgttttattatatcctccagctgtctggagaaccacataagttttgagaaagaaggcaatgcaccttatcattcttcaaggcaaagttcacttcacttagcttggtattcttcactgcacctagcaccctcaacataacaagcacttaatacatatttgtgacataaaatagattaaaatattctaaagacagaactcattttagagaacaatcctttccagccactatttggagattttgatactagagatgtatttggctgagaagtttcctttccttaacctattgctaggttctgtgaacttgccatgaattgaaaccaaggatggactacagtcagaatgaaggaagatgaggaagaaaaaagcaaagaagaaaacaaaaccactctattccttctgaatttggcacaaagatctcaggtgttccttatattcttaagacgtaaatcacaatgaattatgatcattgagcaaatattactgtgagcctaggtcaaaaagctaaggtcatagtgttctgacataaacaaaatcagctttatttcagaaagagcatagtgaaaggctaataaacattgctaagtaaagaaggggctgataacacagatacaacatggtaggtctatactttctagtgcttatccatttctctgccagcccctgcatttatggcacatcaatcaaaagtcttggttttggagccaggtgaactgggttataatctggctcaggtcttcactagttgtaggtctttggggaaattattcttctcctttctgactgtcttcatctataaaatggagtaataatggtaactaactcatagaattgatggaagatttatattaaataatgtgtgttgtaaatgctcaataaatggtagattgtttttctttgtctataggaggtgttgagggcttgtagtctacttgttcaagcaacaggacataaaacaaaagctcattaagtcagatgtggtatcccatcagcacttgcccagcactgagaatacagcaggtattccagaagtgtgagccaaatcacatgcattataccacagtacaaagaaaccttccccaagagtcatggttgagaattacacagcagagattttccacatcacagaacagagtagactggcttgacttcatgatatttggatacaaaactgagaaaattagatttccaaaatatattattacttgaatatgaaaatatcttttttttttttttttttttttgagatggagcctcgctctatcgccaagctggagtacagtggtgtgatcttggctcaatgcaacctccgcctcctgggttcaagcgattctcctgcctcagcctcccaagtagctgagattacaggtgtgtgccaccatgtccagctaatttttgtattttcagtagagacagggtttcaccatgttggccaggatggtctcaatctcttgacctcgtgatccacccgccttggccgcccaaagtgctgggattacaggcgtgagccactgtgcccggcctgaatatcaaaatatctttttcgaattctgtgacagcccatgaccccttcaccagagcaagccaaacaccacttgttttcgccaaagagacaggagcaaaaggttctggtatttatcatctgggctttatctttttctggatagattatgaaattccagtgtattccagacaggtccattttcatggaaccaaccactgtcttccctaaaagcataacagcatcacaggcaaaggtcccaagataatagaattttatatatcaggctggctttctaagagaagtcaataaaatccaacaatgatgggaaatgcaggatgtagcagagatccttaaaagcaattagcagagagcagggatgaaaagcaattatgcaaacactagaacactaggacattcaagactttttttttttttttctttttttttttttcattctgtaaggaaaggacagatccctgctttggaaaaagaatacaaatgtgcaggtttgaaagttccccattaggtgcatctaccatttctattatattcaaatactaagctttttaggacttatattaaactccataatcttaatatttatgaccacaacttaacaattaatcaaactattaaacactaaaagagtcaaaggctgagtatgggtggggcaagaaaatttttttttttgagatggagtctcactctgaaacaatcttgaaaagcctccagaaggtacaaatttgctggcactataaaagacaaaggcaacttaaggaggttcaaggaaaaaggaaaataatgctaagaaagagaaaacatgagagaaggcactggggccaataatgcacagagttcagatactaaatagtgaagtgatccattcagcctagaagaatgttatggtagaatggaaaaatgcaagtctttgactctgagagccctgggttttaattctgtctttctgtgaccttgggtaaggcatataacttcactgagattcactctgagcacccacaaaatgagggcaacaatagctatcctatgaaataggtaactaataaatagcagcaatatttaataggcatgcaaattcttttctcttcccttcaccaagtcataataaacctgttctttaattcaaaatcaatatggccaaagccaaattcacaacatcttctcacaagcttcccttctcaaacagcctgtcttatcaatcgagccaccatgtctccactgacccaggcttggaatgtctgactgatagctgcctcaacttcaccttcaaaacaaatgtctgctcaagttatatccctccaacacgattcattttgacctctttatccctgttttgtcaaccacaacccaaatctaagtctgaattattgaaaaagccttccgtccgacccatgtgattcctacttttctccccacaaattcatatacctcccactgcttagcttatctatttcgaatactggtgtaatacatcctggtgatggctccctgtttcctactactcagtgatatattcatccgttcatccaataaacagttactggatatccaccaaataccaagtactgggctatgtattggaggtgcaaaaatgagcaagtcatgcctttgaaagtccagtggggagaagtaaacagatagattataatacaatgctataaagaagagatgaaactagaaattcgctttataggttgaacgagacaaaatctcagatcagagatggtgctgtattggaacagcatctcaagagaggagaggtgtttgtcaggcaaaaaaatggaaaagggcactattctttttcaaaggcacgtacacaaaaaaatcctgtgttttataagtaaaagacacccccaccaactgtagaggaggttgaatggatttcttgcagcagtgagtgtgtaaatgagtgactagctaggatgcaagactcccctcctttgaccaagcaagtaaacaaaggatggattcttcatagaagatgcaatggcaacaggtgacaagtttctttgggcaactactgagtcagttatgtaggtaaaggggtagagattcaagaatcaaacaaacaaaagacaacaaaagcaatacaatatttcagacacagaaccccactggccagagagagagacagattttacccctcaatgacagtgaacacagaacttagaccatttgaaataaaagttcttaccatatctctcctgactcgtacaaacaccaaagggcaatagtaaaggaggataaatctttttgagggaagtgagctgtactatctcatatctcacgggaatccattcatgagaaagtcaaatccagaagtctgttccacttcagctctcatttacaaaaaaagttttctccttcctttcttaaatcaagtgacacaagtcaactcaagatgtgcagcatcacatcgtcactcaaccaaactgtgcacacatcttctgccatgggtgtcaccaatcttaaatctcagtgtttaatactgagatttaaaaaaaaataattttattgtgtgcatttgaagtttatagcatgatgttatagaatatatatagatagtgaaatggttactaagtgaaccaaattaacatatcatctcacatggttatttcttgtgtatgacaagagcagctaaagtctacttccttaaaaaaatccctaatacaatacaattttattaactccagtcctcacattatacattttagatctttaaacttagtaatcctatatatctgctggttgatattgagatacaatacttagaagctaaaagcttatcaaacatgaaggcttttctgttcggatttttttttggagagggttaacaaaatgtgttgttttaatttcattttcagaacaaattaatttatctcaccacactttttgtttctagcaagcatgacaccactaggtatgagctgtgtgcttattgtggataaggacagtgtgttagttacctctttatcccatcacagtgtctgccacttaagcattcagcaaattaaatcatcaacatgagaaacatgagatacatttttatcatgtacatgagatacatgtcctgtatttttatcacctacgtgaacagagctgaacacctcacctattcaatagtaactccaattttattaactttcccttgactcattttcttcatcaataaaacgtggatcagattgccttccttatagagttatagtgagggataaacagggtacagtatacaaaaagtcaaatgagtcttcaataaacggcagacaaatcccaaacaaaaagaggggcaaaaaggcccgtgtcagagaaatcagaagttaaatcaccataacaatgaccataagcagcagagaacttcagaaggtatccccagccttttggaaatgtcctttaatttcttcatgttgggtaaatctagcaattgaaaaggaaagacgctgttaagttcaaatgtggatgttcattataggagctgaatgagagacaggtaaaagtttccagggaagaaaaaggcagtatgcaacaaagagttgggtatcaaaaaataaaaataaaaagaggtgcagaaaacaagctccttttcttctctaaattcgtggtgctcctatccaggtcggcaaccccacatcagtccttaccattgctctacccagtttgtgtccccactgaatcactccccagctccaagtgacgtgtgtgtgtgcctatgaagttttaaggaaaaattacctataattttgcttgatctttgtgaatctctgtagcaacacggaaaactgcttaacttttcaaaacaaatctaatcaccttatcattcttttatttcaagtaatggctacaatgtattgagcacataactaagcactgtatgccagacactgtattaattgctttatatggatctcatttattcccacaactctgacttgtatactgccgctatccctgttttacaggtgagtaaacctggagatgtggagtggttacatcatttttccaaggttatacagctagaaaataagtggtagctagaacttgagcccactgaattttaatggtgtcactgtaaagcctctgcgctgtgtatctcctgtccccatcactccccactctgctccactgtgctctgtaccccaggagtctggcctccgtgaactccaacaagcttccctggcccccctggcccccctggcttcagtgagtttgtgtgatagactccaggcaggagatgagaaggagggaagaacagttcaggatatttattcctcttggtccttcctggaaggtcacctcagtctagcttcctcaaaggacggtcaccatcctctaaaggcaggctcttctccacacttctgtcctttgaggttcccacaactgctacctccccttgtccctaggtcaaggggtggtcacagctctgccgttactcatcccagtaactcatgcagtcactataacatcatctgtggtttccctgcacccagcccacaactttgtaaacagtcccattgtaaatatactctttaatatatgctgatttgaatgtaccatctggtccctcttggaactctgatacagcctttctaataatgcctttggtctaggaataacaaaataattgttctccagtcattccatgcttttctacacctctgtgtgtgtgtactccatgctgctttcaagtgaaatgctcttcaccactttttctgctggaaaattctaactcctcctttataacttatgaaggcagttattttattcaaacctcctttgaccccctccttgccatgggcaaaataatgggctttttctatcatactctgtaagcacctacaacttagacaatacattatactgtatacatgtgagactggcaaaatctcagcatgcaccactgtacctggtatgcagtaggtaaaacaaatgatcactgaaggcttgaatgaatatattgctgttacatatattctttattctgttctacccaggaaattaatgtcacaggcattccattgagcaacacagaaggctatatgtgtacatgctggttcattctatgtgccaatttgactgagctaagagatgcccagataactgataaacattatttctgtgtgtatcagtgagggtgtttccagaagagaatagcatttgaattggtgaactgagtacaacagatatcctttcctaatatggatgggcatcatttaatcaactgaagggctgaaagaacaaaaaggtagaggaagggaaaattcactctctctgcttgagctgaaacattcaccttctcctgcttttggacactggcactcctggttcttggaccttgggcctaattagattaaatcataccataggctttcttggttatccagctttcagagaatagatcatgagacttctcggcctccttaagtacatgaaacaatttcatatatatgtttgtatgtatgtatctatctgaatatatatatatatattctattggttctgttctctctcatatattattacatataaacagaacattatatatataatactaagacctatatatacagtatatattatatatgtatttaatactatattatatataatactaagaccactaaaattgggatctttctggaaaatcaaaattcaacataaatttattatttctttgtaaaaatgcatatggaggagagggaaggcaagttaaccagatatactttgaatgtaaggttacatgttccctttaatcacttgatttactgaaaaaatacatgcttaaacctttgaaaaaggaaagttgtttttcagtagttcattatatactcactgagttttaaattctatcacaattcacgttttaaaatagatcttaacaccacacatatttacattaaaatagtaactgagtcatacttacctaaatagcctaatgactcattaaaacaactttcttttctgttaagtcatatttcttccttcataattcagttctcataactcattagttatttccaaagaaggatgtatcacagtcatagaccacttctgttcttagaacttaggaagccatctctttcagatcaaaatatctaaaatttctatgaaaattttcaatgatttaacatcagtgttacgtcttaagatttattattaagacatggtttctcagaaagtcaactcctggtctagtgtttttaaatgatttgactctgaatgttcagtaactttagttagctctcaattgatttcattatggaacatttttcttcctctcatgaaaatacgtaacaacaaaatatacctgattaacaaacagcttgatccatgcagcatgtaacattcatagatgctaatgcctctttgaagcatacttagtatttagaaatcattttgccttcattgaatgaccaaacaactggtgttcaaaataaaatatatgcctgactataataatatggcaagtacatatttgtcagtaatgggtattgctttgcatgatttatttttgttttcagaaaatgagtcctcgagaaatcctacaaatcactttccttgcatagaactgaattttggtaaaaggaaaaaggcgctatgttcagtccctccgcctttttgagatggagtctcactctgtcacccaggctggagtgcagtggtgcaatctcagctcaatgcaacctctgcctcctgggttcaagcgattctcctgcctcagcctcatgagtagtagagatagggtttcaccatgttggccaggctgctctcaaactcctgacctcaagggatccgcctgccttggcctcccaaagtgctgggattataggcatgaggcacagtgcccagcctgctaaccccttttcacatgccatctcatttgacccttgctatgttttgaatatcccctccaaaattcatactgaaatttaattacaggaggtgggacctctaacagtgattaggttatggtgctctaccctcatgaatggattaatgctgttaccacttatcatgggagtatgttagtgatgttgggaatggctatgttataaaagcaagctttctctcacattctcttgcccttctgccgtccgctcccctgccatgagattaacctcaccagatgctgacatcatggtcttggactttgcagcttccagaatcatgagctgtataaatctcttttctttataaattacccagactgtggtattgttttacaacagcagaaaatggactaagacaatcctatagacagcaaccctaccaaagtcagaaaggctaagggactagctgaggctctgattcctaatcccatgtccttcccattaaatcattttgtcaacttatataggttgaggctatacctatgctaagtgaaaatatccatctgatagattcaacttgagattctactttgccccattatatttgttctctgaggagagtgaagaagaagaaaaggagaggtttttgtgttaggccattatcaatgagactcatcaatactcaactaatctataaaatgagctcaaccttcccctaagaatactaaatactcatagataatgggctggccctttgattttaattctcagaggatcagtgtttttaatgttttatcattagttcctttcaattaagtcaggtaataatgctgcctggacattcaaacccaaatgaatggcttcaattatcccagggtctatttctcaatcaggagccaaggccctgggaccaaatagctaacactcctcaaagtacctctagattattttctgaaaagaattcaaagattattacattttagtgaattttctagagaatgcactgtttttattaaacgggagtttttgctaattttgctcctttctaaagatgttggaaagtctaagaaaactcttactcaaaaacgaggaagtgggaaaatctcaaactaaaccctctcagattatgttcttactcaaaatacatttgatgtatttgaaacacttgatgcctttatgaacaaatttgccttgatttattatgcaaagtcataattagctattttaattcattaactgcttgtttttaaaaaatatccaatttttaaaaacaacaaagcaaaagttacatggtatgacctatagaggttttacagtggatgaattttaacaaatgtatacacacatacaaagctctaatcaagttatcgaatatttctaccactctaggaagttctccagtgctcacctgcagtcaagctccaccactttcatggaaactgctgttctgatttctatcaccaaaaataagttctgcctgttctttaaatcaatataaagtatgtacactttggtgttgaacttctttcaactatttagagaagtccaccatgcacttacaggtattagaaatttttcttcttataggtgaagtatcttttattccatgaaatgaaaatccaacattttatctatgcttttgatggactatcggattatttccagtttagaatctttacaagtaaagtgactatgaacatttgtgtagcaaaacttctgtggatacatactttccttttgtaggggtaaataccaggaaatggaactgtaaaatcataaaacatatctttttaaaaaaaaaaaaaaaaagaaactgaggaactgttttccaaagtgattgtaccatttcatactcccactagctatgtttatgcatttctgttattccatcatcttattcactggatgttttaattttagctcttcaagtggatctacagtggtatctcattcctgttttgaatgtgcactttcatgataaataatgatattgaacaccttttaatggacttattggcatttgaaaaaacatatatataaatatatttatttctttgggcactctgttgaaatatttcaccttttatgttgccttaaattgggttattatgaagcattttagaaatatatatacatatatacacacacatatgttctgcatacatgtcttttgtcagatatatatatttcaagtattttcctccagtctgtagcttgcctttttattttctcaactgggtcttttgataatcagaaggtttttattttaatgaagttcaatttattaacttattttttcttttatagctagtgctttttgtgtgctctttaagaaatctctgcctgagactgtaagatattttttctctaatttgttatagaacttctacagtttttgcatttatatttaagtgtgtaatacatctcaaaatagttctttttcttagtcttttttttcctgtttagataatttctattgatatggctcaaagttcactgaccttttagcatgcagagactagttggctgttaactccattcagtatatttcaatcatggcacttttcttttctctttgtttttttttcctgagaccgctcactctgtcacccaggctggagggcagtggcatgttcagaactcactgcagtgtcagcctcccaggctcaagcaatcctcccacctcagcctcctgagtagctcaaatcacaggtgtgcaccaacacgccttgctaatttttttattttttgtagagggggtctctcaccatgttgcccaggctggtcttgaattctaggatcaaacaatcctcccacctcagcctcacacagtgctggaattagaggcatgagccaccacacccagccatggcactttttgatcctagaatttctatttgatttttatagcagtttttaggtaagattcttcatctgttcttgaacagcatccatgttttcctttaagttctttaacaatattattatagctatggtaactctaatatcttggtcatcttccatctgtttccagtgactgcttgttttcttcattagttgtcttcttcacttgtataataattatgaatgatatatcccaaggtgtctggattatcttttcttcccttaacatattgagtatttttgtggcagttaaattattggcagattctcttgatcctttcacgcttgcttttatactctgttagagtgggcctatttggttttattcttcattttagattgtgattctcctaaggtaggtctccttctatagccccaactgagcttctaggctgttaagcaagaccttctacactggctgcgacaggactccaatatctctcagcattgtgtgaccttcagtgcctctgttaagcattcagttctgcagaaggcaccctctactgtgtcttacagagtcccactctgtgaatatacagcctagccactggccaatggcacacaaggaaccctcattaaaccaatacaaagacaagttcaacagtattttacagaaaatcttttaagccaaagagaaaaacagtcatgattaactatgttggcaataattttaaggtacataaaaaaagatatttgtaacatatctgtattatcctaatagacaaaagtatccgctataggagtacatgattcgctgcctatgtccgagagctttgaatctcaattcctcacacctggtgccattttactcataatatgtaaaaggaagagctgctagaaaaacttacgtcacctgtgttaagtttatagatatacacttgaattaacaatatttttggccaagattcataaatacactttatgttttatgaagcccaattcagttagaacttgaggtcaagcaaagaaatcaagtgtaagagctgacataaaaacaggtttccttttcaatacactttcagctatcttagaaattaactgttcggagtgtttttctattcatactccagaacctctcgcccaataaaattatctcctcccagggctttcactagtgtcaattcactaaagatgcccgtgtcaacatttcaaggtcgcgcctcctcaagagtttaaatattcatctagatatccaccttgaattcaaaaaccccacaacagaattccttctcttgttcccgcaaaaatctgtacctcttcctgaatctgcattctggctgcactatgtacctagtcaccgagaggtggacttatacccctcttctctttcaccctttcatctgtctgatgcatcactaagccccaagagcttcctcctttaattatatctgaagtttgtccctctgtttccatctctgctctaatgcaattttttaaaaatcactcactctattcccacagccttcaaactggtctcttccctcctatccattcacaacacagcttctaagtgctcttcttaaaatactcatttgataacatagtttcctgttttaaaatgtactaagtattcccacacatctctagaaaaaagttcacattgcttttgtgcctctcactgccttttaattcgcttctctaataatttacatcctagttgcccagctacaccaaaccagttgaaattgcttggacgtgtcatatggtttcagaacctaagccgtttgcacaaggcaaaccatccacatgctcatccttgggtctcagatcaaacatgaacacctgagacagaagactctggtttttctgaccgctgtgttgttccaatctgtttattttactggactctatttgaaatgatccatttgtcctctattagactgtaaattccctatgtggagggagcataacaaatatatctttattctcctgtgtctagcacaatgcttcaccatatttgcaataaatcagtgtaaatgtaattgggatatccaccaccttaaatattcatcttttttatgctacaaccattttaattattaaatattttcttctagcttttttttttaagagatggggtctgggctggagtgcagtggctattcacaggcgacatcataactcacggcaaacttgaactcctgggttcaagtgatcctcctgcctctgcctcccaagtagctgagaatacaagctcatgccactgaacctggctctcaagtagtcggtttttaactaaaaatatttacaggttactacaaggctcttctttttatttttcaatcttactggaatgaaaagcaataacttctaacattagagttatcattctgctctatgatgtaacttagaaaatataataaaactgcaaatctatttccaaagcacatttaaaaaatacccccagatagctgagcattcataaattgattttatggtcatttgcaaaggtagcaggacattggggaagtaaagagagagagcaatgattgattatttgagaagttaacctcattttagcagatttttgtggggttttttttttttttttagctcaaaatgtttatctaacagataaatcaaatggagctttctgtacatacctcattacaattctaatttattttcccaacagaatcttcacaattatgtaaaaattggcacggtcctgctagtgacacttcctattctttcataccataaagcctgagcttataaacaagctgcagagagaggcattttcattacatacatcactgcattgtggcggtatctccagaatggcttaaatgcatcatgtacttttacccaaatggtctctgaacaagagtgttggaagagatgtcagttcttgggccctgacaatgttgtttcctagcctaaaaagtctgagaaatgtggaatattcctacctccttctgtgagaagtcagaaaatgaagagacgtattcatctttaagccaaccttccaaatttacctgagcatagagcaccaccccttcaccaccaccctcttttctttcctttggaaattcttattaacattctataggacatcattggaaggttaatctgattgtggcacatccataatttggctatttagaacattatgtttaaaaacagagttaatgtcatgagtctgtctgcttatctctatctcattgtattttccgcttatcttcctggtttctttttcttcctgaatctccaacacatgcccacacttggattttaaattattggtccaagacaaaaagagtcatgagtacaagttcgggccgatctacttcaatgaacaaacaatcgaaagctctttacttcctgatggcaaaaatatataaaattagtgacatctacttcagtatgcattaacctctttttaaaaagctgcctcctttatcttccattctcaatttgctttaggatgtcttttatttcttccttatctatggctcctactttctcacagactttttttttaaaatgtatttggaggctgatatgatcagtgtacttcctctgaaattaaagtttcttttgatattgagttcagtatattcagagtggaaatcaaatgacttaggctggttacaaagatttaagttaatagagatgaatttaatccactggtggtgtgttcataatcaaatgaaggactcatttctgttctagagcctaccaaataaaaatgtcaaaataattggattaaaatcatatgaaatttatttatttattcaacaaatattaaatgtttttatgtgccagacaatattgggtgatggacatactgatgttaacactgagaccctaccttgccttcaacagcctctagtttagcagagaaggcacacattaattctgtatttgtgtgtgccatgatctgattgtaattgtgataaatgtcatgggagagatgatagggctgatacagcccagtccttgggtggggaggctgggtaaggatagggtcagagaaggatgacctgagaaagtgacgttgaagctaagatataaagaatttgaaaatggcttggtaaagttctagataaatgaaacagcatcaaatgcgaaggttgccacatttgagatgagagcaggtcagtgtggttgcagtacagagagcaaggcacgatagtgtgagactaggcagagaataagcagagccaccatcataggagctcagaggccatcttaggacatcagaactttctgttaaaaacaatgggaagccaagaaaggtttttaaagcaggaaatggacatgatcaggttgagtgtataagccgtctccctagctcagtggagaaagcagactcatcttggtggtagtagggagaccagcaattgtccccaaaatgtccagtcactactggcaaaagcacccctaaaaaacatacaattgaggaatgcaaggtgcaacttcattagaagcccctcggcttacaacgtctatctaaccagaatgccattcttaaatcgctcctattcctatttcaaacttctggttcaaacagctctagtagccatggaagaaaagattaaaggcagaaagactggtagcagaaaagccaataaggaggttttagcctaggcacttggttctggtggttcaggaagtagagaaaagtcaattaaaacaagctacacagaaggcggaatctctagtatgtggtgaatctggttattgcaattactacatgtatctttttaaaaaagtaatggttttggttcctcttgaaatttacatgacactggaatatcctcatttctctgaattatttttcttacatataacacatatatgacatttgaccttgtcagatgcttaaaacagaagaattaagccaagaaatatttctatcaatctcaagtcttttaggaacctaactaaaggagaattaatagtttaattataaacaattctttcctgatcattttaaaagacccactgagaatgtgtgccaggcaaaatagtctagttttagttactttttgcaacctaaagtaagaagtctctatttttttaaacaatatttgatgacttagggtgatccagaattaatttcctccgctgctaatgcaattctgtaagtttttactcaattctactctgcatcattaaacaggactaaaagctttacatttagggaagcatatcacttggaaaaaaaacacgttaatgtgaattataacaacaaactttggagactaaaggcatgactagtaggatcttccaccccagattttttatatgctaagaaaatgaagaaagaagcacacacacatactagattacctacaacacggcctcttaggcaaagcattgacatttatgtagaaggacttcaagcgtggagctagagaatatgcatattcaagtaataatttgattttaaaacctgtgcagcccgaagtcaagatcaaattgcatactcaatttttccaccaacatttagaatattttctcaacgttgagacgtgataatagttgtgtggctgtgtgttttttaaaaagtctattaagtagaagagactgctaatcactgaaccagcccttgcagttttctttgctgctctacagtcagttaacaggatattacaaaataaattaagaataagaaacaggccaagttaatgcacatgataaagagttgagtcagggaaggtttctgcaatatttggagcctgaaaggagagactctaagggtagcagtggtgtatgataatgagaagagggagagaaaaatggtaaaatactttatgctcttcaagaatcattccttttgctccttttgaaaaaaaaaaaacaaaaacaaaaaacaaaaaaaacactttcacggtagcaatttttaaatgcttttcaataattgtgagtgccagattcatgattctgtataggaacatcttaatgtaacatccttaagtagaaacccagtagaacttggttttgtatcattacatcaatattgaaagtatagcctgggtgtggtggctcacacctgtaatcctagcactttggaaggctgaggtgggaggatcacctgagttcaggagttcgagactaccctgggcaacaaggaaaaaccccatctctactttaaaaaaaaaaaaaaaaattagccagatgtggtggtgtacaccagtaaccccagctattcaggaggctgaggcacaagaatctcttgaacccaagaggcagaggttgcagtgagcagagatcacgccactgcactccagcctgggtgacacggtgagtgagactctgtctcaaaaaatatatattgaaagtataaatactactataccattttaaagtacacatacatagaggagtagcaataccattctgtgaagacaactggttagttgtagttactttcatattctggagctgtcttctgcctggactattctcccctcaatcacaaattttcactgggtcagtgcctgctcagatatcatatctaggcttaatcaactgttctgtagaaagaccttcccagatcctatagatgcaatgctgtcaaacagagctctctacaacgataaaaatgttccagatgtgtgttgcccaatatggtagtcatgagccacatgtgaccactgagcacctgaaatatggtagtgtgcctgaggaagtgaacatttaattttattcctttttaattaattcaaatttaaattaaatttaaatagctacacgtggttagtggtttccatgcagaagcagaagaagacagctcctgttcttctatttcattcatattctgtgtgtccccttgtaggacttggcatatttgcagttacatagtgtttaaaattatttgtttaatgtccatctttcccactaaattattgagattttaagtagagtaactaggtctgtcttgatcccacaaaagcccatgcttgacaccacaagcccccatgcttgacacatagtgtctattcaaagagctgctgacttaccatttaaataaagcttttaattatcttaaacatataatatcagatattaataagttggttaagtgaataccaaaggttcatgttagaagactggaatactgtttacaaggtgtgaactttctggaaaagtccagaaaatgccaccagaaattataaaaatcagtggtaaaatgtggttgccacagatttttcataaacacaaacatacatacacacacacattctcaaaacacagctgccttcagcaaaagagtcttctattttgctctaaaatctgttgtggttgtgaaaatgatgacacttctctgcaaaagaaaaatttcaatgcaaaacaaactcacaatttagctcaggatgtatgaaaaagttgacacaaagaagctgtcctttcctggtttaaatgacacattttatctttagattttggtagctaatttttaaaaaaatcctttaaaacgtattaccttttccagggacaaatgctctataatgttattctctgccatctttgaaaatgaaataaacatttattaaaataataccatacacgacatagatatttttaatacccccattggaaatggtggcatagagaagtggacagtgtgtataaagctacgaattccagagaacactggttataattcagtgggaaatacagttagtttgtcattgtttggctgatttgttcatccatccatttatctctctctccatatgtaatgtttatcctttcttactttactaaaataatatctttcatcatgaaactcacagtatgctaggaaagttgaaaaaatacacaggtgactgaaatataagcccctaaagaaagctgtgttcaggagaggcatagagttcatccttggaggagccatttatatgaaaacagttctgtttacatgcaacagagaaagccattaagcttttttttttttttttaatggagttttgctctgtcccaggccggagtgcagtggtgcgatctcggcgatgcctcagcctcctgaatagctgggactacaggcacgcaccaacacgcccagctaatttttgttttagtagagacggggtttcaccatattggccaggatggtctcaatctcttgaccttgtgatcctcccgcctcagcctcccaaagtgctgggattacaggcctgatccaccatgcccagccaagaattcttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggcccagccaagaattcttaagaaaatatcctagtgagagcctttctttttaatcctgaaatgcatctgattgaggacacagggtttagggagggggcacaaaggaaaactgaacagtacatatgtgttgcataaattcatggactaatgattaggacaattaatgaatggtttaaatatgttagacgaaagctcattttgtaatgttctgaaacacatgaagcaatgtgagagactattattttgtttgtttgtttgtttgttttttgagacagagtctcaccctgtctcccaggctggagtgcagtggcgcgatcacggctcactgcgagctccacctcctgggttcacgccattttcccgcctcagcctcccgagtagctgggactacagacgcctgccactatgcccggctaattttttgtatttttagtagagacggggtttcaccattcacaggatgatctcgatctcctgacctcgtgatccgcccgcctcagcctcccgagactattcttaaaaacgcccatagtttccacacaaacaggctgattatgaagagtgacagaaaagccaacaattgtaacgtttgcctaaattttcttcaggtatgttcctggtttttcaggaggcactctgccttgcagatagagcttacaaaccaagaccatcagggtacatgtggcactttcatttttcttctcagagtagatctagagacatttaaattaatcatttggaggttgaaataccaattccttggtatttcaaagataatgtgccaagtcctattatcatttagcaataatttaaggaaaggaagtatctttcaaaagtacagaacaacctacacagatttaacatgtcaaactaatatgataaaattattttgctactatggtaatttcaagatgggtgtgacattttgcttttttgtcttctaaaaaatgaaaaatgtctttgaatcttgttagcaatgcctgaccttcagacacactggccatgccagggatgcagagttcacagtgattactcctacatgtacctgggcccaaaggccaagcctaggaggttcatttcattatcataaagtaaggtgaaaaaagatcaaacgtggattcaaaaaaaataaagcactaacaaggaggagaatatagcccgttgcaagcactacaatcaagtaggtggtacacatccccagtccttgaagaattgctcatgtgccctgtctaaaactggttttgtagactctgacttttgtctttggttgcacaatgatgaagaatcaattttatcccagaccagtgaaaatgagagcacattactactatgaggagaaccgctaaaggttaattgggttttagatacttagccctaattgttcaagattttatcataatatcaatttctgcattaatgcaaggcaccctgaggccatatgaaatagatttcattctaaatttaaatacatccttccatccaaaaagagaagcattcttcccagataattcccacaatcagaatccaacttcctagatgaaataggtcaaattaaccaaacctcccccaaaatattgctttcagtcagtgatgactgacataattatctagttaatcctaatacttagatacttaatgtagataatctgaaacattaattaaatatgaaaatacgttacatgatttttcctgggaactatattttagtaacactaacacttctgtttaagaagttagagatagttttctttccataactggaacattgagtactgttggttcaacaggaacaagtttggtatgccatttatttcggtattcagagcaggtcattaccaaaatgaaaattaccttaagtattgttaagccattagggcacagttttgtataatcagacaacatcttaatagatactcctatttattgtcacaataaaccatctgttaagttttagagatccatttttgaaaaaaggagatacctagttttcagaacacctggtataggaaactcttaatttacaaaataaatgaaattgagggagactgatgtgcgttgcaaaagaatacctaggttgaagaaaaaacaaaacacctacctaaatattctttgaccagtagtatctctagggcttctgtgtttcaatttacaattttgtttaacatataacctttaaggtattcaaaaacaacagcatcaataataatagctaaaatttagacaggaggttatgtgatccattcactattctagaaactttacatttattatctcacttaagcctcacagcaatcctaaaaggtaagtgctgatatagtttggatgtttgtccctttcaaatttcatattaaaatgtgatccccaaagttggaggtggggcctggtaggaggttttaggtcatgggggtagatctgtaatgaatagcttggagccctccccatggtaatgagtgggttctcactgttagttcacacaagaggctggctgtttaaagaagcttgtcccttgtcactctcactgcctcttgccatgggatctcccagctccccttttgccttctgccatgatactaagtttcctctggcctctgcagaagctgaacagatgttggtgccatgcttgtacaccctgcagaaccatgaaccaaacaaacctcttttcattataaattacctagtttcagatattcctttatagcaacataattggtctaacacagtcagtgtcgttattttcattttacagcgaggatactgagactcacagtaacttctgaaggttgtacaaccttatgggaaaaagagggtacagattttaaaagcaatggattaaaatgagtactgctgtgaatatctacatgtctccgtacacgtccaagtttagttgtctcactgcatgagtattttccatcttttcagacctatattaaaaatgcaagccaaatatcgattattatcattaccagtttctaacacccctgagcattttgacccggtaaggcaaagatgaatatttcttagaccattttatccatcataggttattctaccagtgaatagctgtctgatatcttggtctcaacatgactagaggctttacaagcatttataaatcccagtaatagtacatcttcttgagtggctgcctggttccactatgcgaacatcatggcaaccgcgtaacaaaaaagccacacagagtgttcctagtacttactgatatgaccaagaccttgtagcctttgaaactccatgatttttaacataaccaaaaagttcatgaataagagcttggtgcttcatgtcacatataaatgattttatattacccatatattgtattcccgcgattagccccaaagatgcctccccaatttagcagaagtatattgcttaggagggaacatacaaacaaaacaggctgggcacggtggctcacacctgtaatcccagcactttgggaggctgaggtgggcagatcacctgaggtcaggagtttgagaccagcctcgccagcatgttgaaaccctatctctactaaaaatacaaaagttagctgggcatggtggtgggcacctgtaatcccagctacatggggggctaaggcaggagaattgcttgaacctgggaagtggagattgcaatgagccgagaccgtgccattgcactccagcctgggcaacaagagcaaaactccatctcaaaaaaaaaaagaaaagaaaagaaaagaaaagatcattagacataaaacaacaaaaaaaagcacatataaagctgttctattgctcagataatatttcaaagaacaggaaagagaacatatttaaaagtatatatctgcattgactgccaatctctctttcgatagtagagatgactatgtttgatattaagcttctgtaaatcaggctttcctactttaactttctagtatcaactggtatatacaatcattactctttctttccttttttgttttttttctcctatcctctacatggatagactagaggcttaatagtgtgatgataatggctctgtaactctgtaactctgggtatggcgtgttcagaacacccacagtaaacaatcccaaatccaaacatgtgtctcagaaaatgtgtctcaaaggcctagtgctgtgctgtccaatatggtaggtggtaactacaagtaggtatttacattaaaattaaataaattaaaaattccattccttagccacatttcaagtgttcagtagccacatatggcttaatagctactatactagcacaaatatggttccattggacagtggctagcctagagtaacattttctaacttaccaccttgaccagggtttaaatcaagaccagccaatggattgtgcctcacatgtacacctacttaattttaattggcatcctggagtagaaaaaaagtacagtgtttggaatagacatctcttgcggacatagaattgcggagtggtgcccacatacaccaaacatggctcataagaacttgcattagcagcagtataaaactacaaaatactaaaaatgcaacaagagtgccacatctcataaattacacgtgtctttccacgtgccatttcaaaataagccatgagcgaagtgtttttcttcaggcatacagagttaaataaagtcctgaatacgatccgtaatcacaatctgggtctaatctgagacaattcatcttcttattcattaaaccagaaaacttgtatgaattggtaatacaagtaacaccgataatttttttaaatgtccattttacctacatgtgaacctgatactctgaaaatcactgttgattcttgtcaagtaaacaactatgccactgataaagctccattcttgagtccatattattccctgatagaacccaataatctaatcagaggtttttttacccccacttaggaattgttttttggatactgtgactccaatagggctttcattaactaaaaagaactgtatacaacatatcaaatgcagcatctggtctagtctgaatttctaaatgacaagcacagcatgcatttggaattacatagagaacgagaaatcagacctctatcattagcaatctttttccccaaacactgcttccacttcatgcttcaacacctttaccttccacagacctcttggtaatgtcacgactagcttgtcaaatcaaattcagcagcacacaagcatctgtattaatacttttgcattttcattcactaggaaaaaacaaactctacttagtaggcagattagccattatctactgtaactctaaaccatctgagttacattactaaaatgaattggcattgaaaacagagcgacagaaatgtttaccgatagaaaaatatgtagggaatgggagtttcttttgcgcttacttgccagtgacttcctaaagctgtaatgaggtcaaaataagctggtttatttcatctgtgaccactgggtgagatctcattttataatggccttaataatttgccacttatgattacgataataacaatattttttaaaatcactggaaactttaattaggtatttccaaatcgctaggggttattaaccaagggtcaattttgctcccccaacccccacccagaaatatttggcaatgtctactgatatttttggttctcataattggaggtgagagtgctactggcatctagtgggtacagaacagggattctgctaaatatacttcaatgcactggaaaacttcctgcaacaaagaattatcccacccaaaatgtcaacaacgccaaggtgaaaaaaccatgccctaaagctacatatgatcactatcatttaaatgattattccaggacttctatggacatgagctactgaaaaaaaaaaatcattttgtctttcacagatgtcaagcttaaccaagtccatgtgaccatttagagagttaggaggtacatctactataaaaatagcatttttcaacagaggctattttgttatttgtttcatccttattcatcctgtctctctaaacaacagcaaaatttttaacccatcatcaacctttaaatactgttgggtcaagttctcactgtcaaaaaagacatattaattgcaaaaaagcaaaaacatgaccatctttacagtgctaaatcacttctggaaaatgtttatgtcaaaaatcagcttaaatttttggagataggacaggcgcaggtggcccatgcctgtaatcccagcactttgggaggccgaggtgggtggatcacgaggtcaggagatcaagaccatcttggccatcatggtgaaaccccgtcgctactaaaatacaaaaaattagacgagtgtggtgctgcgtgcctataatcccagctacttgggaggctgaggcaggggaatcacttgaacccgggaggcaaaggttgtggtgagctgagatcacaccactgcactccagcctggtgacagaccaagactccgtcttaaaaaaaaaaaaaaaaattggagataatttttaatagagactattactaatctaataataacttccataatatcttaagtttcacaacagagatgatgatataaagtagaattaagtggcagcctaattattaatgatgttctttgcctttgagataatccagttatacactttaaaggtttggtatctttagccccatgcgaggagagagtcgtatgtttttctttctctcacacacactccaggaaaggaaaagcaagcacagtagttaacccctgatagtttattagtcattcttgctttgtcgctttattaccacgaaactggtcagtcatggacataaacaaaacgtgcaaggataaggcaggctttcactcacataaaaactgccaagggccaaccccattgtgaatcactacagaaaatcattacaaaatcttaaaacaacaacaacaacaacaaaaacccagcactttgaatcatagtatctcttcaacagatacactacaaaactttatcagaaacactatgtgagagatgaacagagctaggaggtattttcacattagtaaaaaaaaaaaaaaaaaaatctcagaaatcatttatataaaaacctattgtgagaagtctaaatttacgttcaatgccttccctttctttcgctctatacagttttaaaatatgttcattttgttctaactgcacagtaataggcatggccttctaagcagaaaaaatatattatggcaaggaaaaatgaagagatacgttgctaacacaacagacttttgttaaacaattaagaggaaaaaaatgcatacaatatagcatttgctatataaccataacctctcccattcctggtgtcccactctgaattctacttgattcaacaacttaagatgcaatggaaataataatgtctattccagcagattaaaaaatacaaggcagcagtaaatgttatgaccaccagctaatgggctatggtggagaagcatccactgtggattaagctctcaagtactcaataacttttaaaaatgccttaaatcacccacaaaatgcagtatacatggctttgtgtatacaactgttaagtgtacaaatatacatcaggtgcaggaaatcaaaagcagcctttgtgaaaacttagttttatagtacttattactacaaactagacataaaggtgctgaataaaataattaagaaaaaggaaatagcaactttgaacaatcttataaatcattttatataagttagttatccttagagtatgtatactataattctgagttaaatatttatataatacaatttttgtaactgaaacaggatctcactttgtcatccagtctagagtgcagttgcacgatcatggcctactgcagccttgatctcccaggctcaaaggatcctcctgcctcatctacctgagtagctgggaataaaggcatgcaccgccatacccagtgaatttttttttctggtagagatggtgtcttactacattgcctagactggtcttgaactcctgaactcaatggatcctcctgcctcagcctccccaaatgctggaatgacatatgtgagccactgtgcctggtccatataagattttagagtattactctaagagattaaccctaccctggggaatcgatgtcaaaagttgggaatatctttcctaggtgaaataatagaaataacgaactctttagagctgactatgtagcaggtgcttctgagtgccatacccagggtaactgatccatgggttacattagaggaaattgaagcataaggcaagtaagtaacttggccagagctgcagagcaaccatgtggcagaaccaagatttcaagatttgagccccggcagtgtggttccatagacgctactcactggtctcttctgcctctggaagactctctccttccctgccttcttgtcacccctcctcccacccactgactaccactgtacagcgagggtcttaagccagagatcctatgagccgcaaccaccatctgtgagctgcacattttttgaggaattacctttccggcagcacatttgagggattcaaggacttagaacaacatgaaacaattcaacaataatgacaaggcaatgactatcgaagtgcagcttcacctcacaatatctataaaaacatccatggttattgcaccatccacttgttcctcttcctgtactcttgtcattgtttcaatagaaaccgctgactaccctgactgctctcatatatacccagaggacaaggtttgagcatcttctggtaaacagcaatctttcttcatgctggcatgacctcacactccacttcttgcctcttctctaaacaatttcttctgttgtatacactactataatcatagcacacatgggtcaaaatcactagtctaatctcagtactctacctgcaaaagagcagtacctaacaaagaaaccaacctacactctcatttgtgaagggcctactgtgtgtgcgttccagacgatatgtggtaggtgctgaccactttacatgcatcaactgacctttaaacagaactatgtccactatagcgtaaacacaatgagggctcagagtggacaagcaactggtggtccacaattccatagcctgttagggttaaagctgggattctaatctggtctgctcttgaaagtccccacttggtaatatttctctttctctgcctttgcctaaggaaattctatttattcttttttttttttggagtgcaacagcgctatctcagctcactgcaacctctacttcccaggttcaagcgattctcctgcctcagcctcctgagtagctgggattacaggtgcctgccaccacacctagctaatttttttgtatttttagttagagacagggtttcacaatgtcagctaggctggtctggaactcccgacctcaagtgatccacccaccttggcctcccaaagtgctgggattacaggtgtgagccaccgtgcccagccaacttattctttaatgtctcccacactaatctgcattctccctgcaggcagggaccatgctttgttcacctctgtttctattatacttcctaaggaatggacacttaaaacttcccgaactgatcaaaataaatgtgagaggacagtgcctagcatctaacaggctccttggtggttgcggtctaagtggacatgtacaggtgggattactcgaattctaagaatggctggatttaacacaagtcaaaagcatttggaaacaataatcatcatcctgaattcccaattctctcccccctcacctttctgcctctgctctaccccttcttctccaaccctatgtctcagtctgtctgtttctccactctcttgacttctctctctgtccctctcacaccattattgtcaccacaggcctttgaagcgactataccctcaaacacaccatacttatcttccacaatcacatctgaaatattttggctatagtttgcttatggtttgtttggccttgctgagtctcatgttgaaatctgatccctaatgttggagttaaggctcgatgacaggtgtttgggtcccaggggcggatcccacagagatggtttggtgctattctcaaaggagtgagccctccctcttagttccttcagaactggtggttaaaaggagcctgacacctcccacccttctctgtcttgccatgtgatctgcacataccagttctccttcccctcctgccatgagcagaagcttcctgaggccctaccagaagcagatattgttgctatgcttcttgtacagcttgcagaacaatgagccgaataaacccctttcttataaattacctagtctcaggtattcttttacagcacacaaatggactaagacaatttctaaccacatctgagataaaattaaccccctaaataagcacacaaatggtattgatatgatgaataactcacctcaaatgtacttcagatagccttctgcacaaggcacgtctcttgagttaacaaaccctagccaggcatggtggctcatgcccataatcccagcactttgggaagctgaggcaggcagactgcttgagtccaggagtacgagacctgtctgggcaacatggaaaaaccccatctctacagaaaaaatacaacaattagcagggcctggtggtcacatgcctgtagacccagctactcaggagactgaggtgacaggatcataagcccaggaggtggaggttgcaatgagcagcgatcatgccactacactccagcctgggtgatagagacccaatctccaaacaaaacgaaaccaccacacaagacctaaacctgatatccagatctgagaagacagaaaatattttcaaatctctcacatatatatgcattcatacattgctacttactttcctctttgtgtgttactgatgtcttcaagtaatcacacagctctctgcacatgccagctcttgtgttccaagtttccatgcagcatctcatggaattgcctcaacaactccagggctagggactactgtcatctgtatctaacagacaaggaggctgtggtacagagggctcgtaaagttagcacagtggagaaggcaggttgctactcagacatccattcctagagcccacattcttagaacacacagcctgtctgtccctccagcaccaccctgcctacttttagtcatcctggtgtcgtctggctgtaagttcctgagaattaccctagttgctaatgtactggaatggcatcttccttattaaaggcactcaatttagcaatgcatttgcattccctgattggttttccatataagtggttcacaaaatatggtccctctgcaccacttgggagtgtcttagaaatgtgtattctcaggctttatcccagacttgttatgttagaaactctggagcaagggcctacctgcctgtgatttcataagccctccaggtaattctgatgcatgctgaagtgtgaggcttactaccctgcatgatatttatggcaagttttaggtaacggtgcctttgaacactaactttcagaaatagaagatagaaaatgtgcagtaaggcatcttgcttcagtaacacccaagggcacattctgtctacagttcctcactctgtcatctgtcctcacacgtaggctttctgcttatacactccaaattacaactacctaacagcttctaaaatgagtgtctggcttggaagatttttaaatgctatcagagaatgtctgtttcaggatttaacttgtccagtgcaaagaagtgaggctgggccacaagtgacccatcacttcacctgtaagagcaaattaattacccctcaacataagtgttatatttatgtgccaagtatggtcgataatgaggtctttaccgtgtagccatatttcaagccattgttcacttaagtaaacacattttaatcactgtcattttattatttattcttgagtctactatacacctgtcagaacattttgtgtttgactaactgtcatctccttgtatctttcctgcatcatatataaaccactgtccacctccacatttttccctcttactgaagtcaagcactacacaagttcatggggacttagaggcaagtgtgacggctgaccaccccaatagtttgcaaagcctttcatctgctcctctgaaaacgcttttcacacattccttccatatatctctctgctgcaatctctctgttgcaaaactgttgttgatgaagtgacatttatctaagcattgtcactttgaataataccaaagaaagaaaatgaaaatcaatgtaattgcaagctatcaacctcaaattttattcacttgttttaaatttgtcaaatgaaaataatttgtttatctgagtaacaatatatgggtatcagtatatggataacaatttttaaagcttgatttcaaatttggatttttaatattaaaaagatgaaaaatttttagtccaattttccctagagaactctaacaatagtcatgtactgtataacatttcaataatgacagattacatagatgacagtggtcccttaagattgtaatggagctaaaaaaaaaaaaaaaaaaaaaaaaaaaaaaaacccgtaccctctagtatttattacaaggtacttttaacgattattttagagtctacttcttctatttataaaagagaaataaaaatgtaaaacggcctcaggcaagtccttcaggagttgctccagaagaaggcgttgttatcacagaagatgacagttccatgcctgttactgtccctaaagaccttccagtgggacaagatgtggaggtggaagacagtgatattgatgatcctgacctggcgcacgcctaggctaatgtgtgtgtttgtgtcttagtctataacaaaaaactttaaaaagaaaaaaaacaaaatctaatatttaaaaataaaaaaatacactaaagatataaagatagaaaatatttgtacatagctgtacaatgtgttttaagctaaatgttattacaagagtgtcagaaagctaaaaaaaaaatttaagtttataaagtaaaaaagctacaataagctgggcacagtggctcatgcctgtaatcccagcaatttgggaggctgaatcgggaggatcacttgaggccaggagtttgagaccagcctggccaacatggtgaaaccttgtgtgtatgtgtgtactacaaatataaaaattagccaggtgtggtgggacatgcctgtggtcccagcttctcatgaggctgaaggacgagaattgcttgaacccaggaggaagaggttgcagtgagctgagatcacaccactgcactccagcctgggcgacagagtgagaccgtctgacaaaacaaaacaaaaaacaaacaaacaaacaaacaaaaacaaaaaagaacaagctataataagctgagattattgaagaaagaaaaatatgtttaaaatttatttttgtttatttattttcttttttagagacaaggtcttgccctgcaagcccaggctggtcttaagctcccagcctcaagcaatcctccttcttcatcaatgtttttaaacaaatttagcatagcctaagtgtatcatgtttataaagtctacagaggcatacagtaatatcttagcccttcacatgcactcatcacttatgtactgactcatcctgagcaacttccagtctaagctccatccatggtaagtgccctgtacaggtctaccattttttacttcttatactgtattttaactgtaccttttctacgtttagatacacaaatacttaccattgtgttacagctgcatataatattcagtacaataacatgctgtgcaggtatgtatagcctacatgtgcagtaggttacacccatctagatttgtgtaagtaactatgatgttcatacaatgatgaaatcacctaaggacacacttagcacaatatatccccttcatcaagcgatggatgactgtattcataaaaatctggatattgaggggctgcctgataatgcattattatatgtattaaaatgtgtcttgagccaaatgctaattaactcttggctggtgcctttccttaatgtttctttcttctttttttctttttttaattctgattactctttgggacaaaaaggtggtgctgaaacaagatatcatttatgatcaactcaatacagagattacttaatatttatcacattatgcagaggcttcaataagttcatcaaaatatatgttccaaaatcctatgcatagatttcaaacttttcttccatcaaaataaattcatactaacttgttgtaacatgtctgagtaggatctagtttgaggcactaagaagattaagacatcagtttgaaaagatcccgtatcagagcaacatgaataacatgaattctgctaatgttgaggcaagaacatgcatcaaatttatggcgaagcttggatggaagaatggtaaagtcgctgatgctttacaagaagcttatgggggcaatgcccaaaataaaccagcaatttacaaatggataattcattataagaataaatgacaccatgtcgaatatgaagcctacagtggcagaccatcaacatcaatttccaaggaaaaaattcaccttgttcatgctttaactgaagaggaagaaggactgatgattaacagcagaaacaggcaacatcgtagacatctcaactggttcatcttgcaccattctgactgaaaaactaaagctgaacatactttccactcagtgggtgccaaaactgttgcacacagatcagctgcagacaagagctttctactgaaattttaaccaagtgagattaatgtcctgaagcattcctcagaagaattataacaggagatggaacctggttttacccgcatgatcctgaagataaagcataattatagcagtggctaccaagaggtggaaatgggtggggcccagtaaaaccaaaggtggactggtcacaagtaaaagtcatggaaacagttttttggtatgctcaagacattttgcttgttgactttctggagggccaaagaatgataacatcttattatgagagtctttcgggaaaggtggctgaagctttagcggagaaacagctagggaagcttcatcagaaagcacctctccaccatgacaatgctcctgttcattcttctcattaaatgaggacaattttgtgagagttttgatggaaaatcattagatatccactttacagtcccgatttggccccttctgacttttttcatttcctaattttaaaaagtctgtaaagggcactcatttttcttcagttaataatgtaatcaagattgcattgacccccaattctttagggatggactaaatggctggtattattgcttacaaaagcatcttaaacttcatggagtttatgttgaggaaataaagattttttttgagaaaaaatttatctttcaattctattttccacaaactttttgaagtcctcttgtactatcctcaaactttgtgcactaattgaaaaaatatatatatttttgtaaaattatttataatgttacatatataatatataattttacatataacttatgtatataattatatataaatttgcatgtaatttttacatatatacacttctacaaaggaaataagtgaggaccaattttttctaagtggcttaggaaaagctgaccaaataaaagatccttcctcacacactgtggagtccttccattgaagaatgtggacaacacactccatagcagaagtcaaaactggtggctgctctccatcatattttatttcttcctacgttttttttatttaaataaattgtcaactttaaaaattcaagatcttacatctaaatatctggatttccattacctcatggaaaaaatgaggcctctggcaaccatgaactcttatccccacatggcaacgattgcatggtactaaataataatgccacctatgccaggcttggattctcttcactccagtaagttctctgtctggctcctgtgggcctctgcatttgccaccctgctctgcgttcagtaataactgcaagagagttcttttgttcccagcttggattgatccaggaagatgtctaaagaaagctggaccaagagcaaactctggagaatggacgggaaagaaaatgagtaggaggggaaaagaagagtctctcaggataggcttatggtgtaagcaaagcctcaggggtgagggtcagggtatgggggaaggatgtgtaagatagagtaaaacactgaatgtactggtttgactgggtcagaggtgtaggaatgggaatagcaggtgaaaaacttcagaaaattcattgaagagagactgaggagagccttgagggctaatccaaggagtttctgagacattctctaaattacagttcttaactttctattgagaaacagatcaacccactctctatgcaatttcaggtaagctaaatgcccacttaaagcttaggcagcatgccctgcctctccttactttccattctttaaatcaaaaaacagtacctacaaatgttatgttaatctgggagcaacatgcccaaaatcaaaaggactgaacatgcccaaaatcaagaggactgaaagcaggaagaatgctttggcacagaaggggaaaggatgaagcggcagtggagagccatggttaaggacacaggtacctgcctgggttcacatcctgaactgagtatatgcaccatggtcttctgaaggttacttattatctctgagcctcagttttttcatctccaatggaggaaatactagtacctacattaaaggtctgctgtgagaattaagtgagttgatacatattatatatgtttagaatagttcctggcacaaagtaaggtctccacgaacattaactgtgctgctgtcagcatcactaccactgttaccactatcatcatcacttaaaaaactgcattaagtccagaaggatagtggctgagagttcatctgcagccgtggccataaaaatagaagtaaatacatgacaaagaagttgtgaaggaagactatataggacttggtaactgcagaaatgtggggaaaagagctatacagaagtatttaaagatcactgcatgaatctgaagctagatgatacaataaaataacatggacaaaggtcaaaaagaatgtggcttttggagaagtcacatttaagatgaaagcagaggactgcagtgggactattcagaagtagttgaaacggcagaaatagaattgagtagaaaggtcaggctagatgcagatttgacagctggtggtgctttgtgaagctgataatttctgcaaggcaaggggatgaggaacacagataagccatatcatcatgatcattgtttttagataccactgcctggacactttctatgttctaggagctgtcctgagcattttatatggactgtctcattaagccatgattatctccccattttatagatgcagacactgaggattagaaagtttaaaatccttgttcaaaggcacccagcttttaggcggtatgaattaaaaagtggaatccatagccttcactcttaatcatttactatattcctttccacagtaaaagaaaagtgagatgtaaggaaagggaataatctaagaagtcgagagacaaaagcgaatgagtcatgcctctgaggaagaaggtaacgagtttatgagctagatagagagtcttccaaaggctaatttgtgcttcatgaatagagaaaggtttttaaaaggaagaaagaaaggggcctaaaagggaaggagttacatttgatcagtcaaatactagacaagaaagtaattcccaagatcaaattccaatttcagtttgaatgcaggacaagtggcagggtttcatttgcttggcatcaccaaagaaatggataccagaattctgatttgacattcatttacaatagaattttgcaattatcaattgccatttttccagcttggacagggttattaactttttcttggaaggtgattagtgcttagattccatccttaaaaagacacagactacagaggtacctgtccggtggtggtaaataatgtcaactccacaacaatggctacaaacaccacatcacagatcaccacaccaacagctaacacaccaagccttctacctaccaggcaccacactagctggggctgataccgcacttgctacccagaactacccccatgtgacaggtattgtcactcgccagttcagtctacctctggtgcctactgtctggccctcttgttgatatttgggtaagtctcctagaatttgaaacttccatttactccctcaaaaaataaagaacggattatgttttgatagctactgcagctttatatagttgatgcacactctgtgtatgttctccgtcactcacatatagggatctagagaaaacagctatataacgttaggggaaggagtaaatccccttgttttctgataagtttatgagcgagtgacaaaaaggaaaatctttcttgtgcttcagaatgagacagcgatgaaaaacaaaaccacttctgtgcagggtgaaacaaacattattgccaaggccatttttgattgggaaatgaacagaagattaaatcatagtggctaagtgaaagaaaccagacacaaaaagttaatatattgtacgattccatttatatgaaatacctaaaatagataaacccatggagatagaacacagattaatgcttatcatgggctggagtggatgggagaatgaggagaaactgcttaataggtaagaggttttactttgggaatgttttggaactatataaaggtggtagctgcacaacattatcagtgtactaaatctaacagaattgttcacttaaaatgattaattttctattatgtgaattacatctcaataacttatttcaaaatgaaaaaatagaaagtttaaattcaaggatacatataaagaatttttttttgctttttccccagaacatttaaagaatcactataaaaaggaaactttatcctcctcatatctaagtttaatttgggaggatgtgggaaggggctttattattactgttacttctttgcttttcattgtccacaaaatcacatataggaatgcaccaggcaatcaagcattttctctacctgggctgtagccactgatgtaaactacatagaaaatgtattatacagataagcaaattcttcactgtgaaggtagtattctctctactcaaaagttttcaaagaataaactgcaactgtagaaaagaagggtaacttttaaattaatttagaagcagagctcagcttgccctttgcattagctcaggttctttgaccaaaagacacaaagtcagcattagacacctaggagattactgggggaggaaagcagggtaggaaggaagaacttccagaccatgatgctaatgcttgtgaagcagaggaagagataggaggtttgggaagaaggagtcttaggctccagggtacttccaagagaggtctggcaggccaactaggagtccttgagcccatgttccagtgagaaagtctcacatgtaaaaggaaggagtctatgctaacagctcattcactgactataggaagtttggacttgccatgagacagcagtggatcaaggatagcagtagctgagttcttcagccagttatgctcccacaacaagagacctcagtggcccatttttatggtgccacatcagcctactgatagcgacaggaggcggccaaatgcctaggcatataaaggcaggtccccagtgcaaccccacttccaagctgaaaacagtttaaagcctgaaaaccaagctacaggttaaatgcttggactggattgagaacttgtcttcctgtttggcacactttcctctgattgatcctcacctttcacctattttacatatacctaccctttcctaattagttgtctacactgccacgcccacctttgagtagcgtctttgctttaaccttttttgcatactcacagaccaatcagcacacactccctttactgagcccataaaagccacagcctcagccatattagagaattttcccactttcgggtaggggaaccgctccccacatcccctctttgctgagagctttcttttcacttaatgaattctactctactaactctccagtgtccacgagcctaattcctcctggttgtgagacaagaactcggacctagctgaactaaggagcaaaaaaccctgcatcactatttttcaaagtctctactatagatctggcagtacattaactctctttctcctgtagctatgaggaatgggaagctgtggttatcggaaacctgaaaataatacctacttttattttaagcaagagtttctgcaacttctctcctgaaaatctttgaggtataatgctagaaagggagaggaaataaaagactcataaaggacaatgccagtgtccatgctctaagaaaaatttcagccagcaagaaactaactagatgagaaagtaataatcgtgtgtgtaacccaaaaagggcaaatctgatcctgcctatcaagtgtgacagtttattaacattgattggaaatttaacaaatacacagggtcagtcacataggtattaatgccacacccaccctccacaatcagttataagcctgttctgttaaagcagtatgaatactttataatctgtattcatcagttttgcagaattgtaatgtttgtctgaaatctagggtgatacttagtaaattacacacttaatatgttagaaaatattaatgttaccatattacccaataatccaaattttgtggaaggaataaggtacctggaaggaatctatttgatttcataggagttaagaaaataatatatataccacataggtggaaaaaaaatctatgttttgggaaaaactgacaaactctggatgtgttacaagaaaatgttttaaaaataataaaaaaaatttatgtatgcatatacacatgtaatcttaaaaataaggaataaaaggtggaaagtctatacataagaatgaaattttattatatattgaaaagcaagtactgtgattaatagacttttttgaaagatgctaacataacctatttttgggccagataatcagtctcttttagaataaaatgtgctttctatcagctttttggtcactgtaacaataatttgctggccaagaactaaataagtggcttaaagtacatctgaaggtatttataacctataaaaagtttcctcttatcatcatatctgctttattaacttcaagggtttttctgcagaagttctctcattttctttttgcactgggattttgtccttcatagttctaaaagaaatatcccattttctccctttcttaaccctcaggatagaagaagtagtatcttctcacagtgtgtgaagactcattctcccaaaagatgagcacaaaggaatagatgctgagaatatcaatgcctgtgacatttgctgtctcccataatgactgccatgggaggacttgggaagcggactgcaatctgatctcaagtcttctgactcacactctattttggactgcttttgtcttggatctggagtatagaaacacctatttcgtggtcggtaggcagtttaacaatcacatacacaatgaagcaatcagaaaggtgagcaggtgaatattctctttcagaggataaattactttttctaggaaaatgattattggctgacaatgaggtggtaatttacttccctctagactataataaacaaaaatacaaagtaggacaccattttcaacagctgtgtgggtgattataatcaccttttagccttgaaactagtccctatctcattagctatgatacataattttttaaaaaatcatgccttcaaaaagaaaaggttttctgtggctgagttaggctagctgtccatagtgccacctattaccaaactttacagaggatgagatttcttttaagtaaaccctgcttctgaattcagagtatcctcttgctcccagcctccaggaactagtctgaggcagtcagttctattacaggaagaggacacaagaggtgcattatgtaagttagcaatgactaagccgggtgctctatggggatggcagtactctggatagtgaaataagtgctcttttaggtaggattgctttagttggtctttgagttacttaagagccaagcctagagcagaagaggttgcaacagaatgtgacatgagttggaatctgtagaacaggaattcaggagttgtccctagatactatagcagggtaagaaatggaagcggagagcacatcatggagacatggagaacagaggaggtgaaagaagccctgtaatgtgaagcacgggatggaggaccctggcagcagcctggggcctgcagaggaaaaagctccaagaggagctccatataagagggtggccaagttcgtggcatcagactttccactggaaatggattcctgctttgtcctataattaccctcttatctctatacctccaggaaaagaatgttctaacaatgttggtgttagaaacaccaaccttgggttagtagagcactggggcttgtagggatatgtaagaaacatctgctggtcaccaaggggaagagctgagcagaggtgctggcatgcacacagaagcaggaatccagagcaagagatggcagaagagcacaacagaaactcacacgtgtctgaaagtgctggggtagacagttggtctccccatggtaagcaggatcacaccatttgcacttagatcattagagaagctgaaaagactgaggaacttagggagtacgaaatctctctaagtgaaatctcagtgcgaaatctcagtgagaggattttgttagtctaaattcaaagtctctaaaaaacaaaattgaattagctgccaacatttaaaagtgagatcattttatttttcttaatccaaattctttggttaaaaaaaaaaattagacaacctgaaaatgttaggcttaaattccttagtgctgcatagaaattggtgcctttacagagaacagttcaaaacagacctaccacctagatcaatttaatcattgatacggctggcctgcccctggagacacccaattctgcagcccctggtagcacctgatttaaaggatctatccatgactaaagacattatctatgcatttgtaaaggttatttttgctttgcttgtagtgattgctcagaagatttttagtgaattccttagttatgtactttgaagtgaaatccaagtttcacctccatatacatgtgatctccaaagtggtttcatgctcatgaaagacagctgtgctggttattcctcattttccaccagatgcattctctttccttcctgatctgcatcctgggaagttatttcctgtgtacctgccagactcactgatcctctgacttactgttaggttcggccagtgagaattatctgcaacagaatggaggccaggagagaagagaagatgggtattgactcactgtcatggttctataaccctccacccccacaactcccattgtgaccccttggataaggtcagctcttatgtggctctgataacacatgatcccttctaggtttagaggtgatgccagcttccctccactgttagtccccggtgcttccccaccccatgtagtttccttaaccctatctataccttataagtaatcccattactaaaatacctcccattaaatctgattatacaatctgtttcctcctggacccctgactataagtcaaatttgaacattccaaattctggtacaaaagcagttggacagaaaagataaaaggaaatagagtaaatttcaaatgagtcttgaaaacaatttggacaagcataatcttgcagattggtccttacaagccctacttgccttaatcagatacctcaacagttgagtgttctgggtcatttcttctctgaagcctttcatttcatgcgtaattagaaacatgccagtctgtaatgatggcagcctttaaaatggtcagtctgtcacttccatggccctaactccagacacaaaatgcatgcttgattactaagagtcttattaaggggctattgtttcccccatccctgccagctcctcctacctcctgatctttatcatcttgcattctacttaaagaaggatttaaagagaaaaaaagaaaatctcatagacactcacatcagattgtattaataagcaaggtaaactacatctgggcttgtcactcacagtttttcttttcctctctaaatctaagaataacatgcagtcagttgcaaaacagggagcaagttttccaaagagcacgtgggtgggagaagccaaccatgaagtaaattccaacatcaacagtctggttggattccactgtggcccccactaattttcccaactttttgggccatgaaatttattattatcaactccaggtatagttataatccttggtaaaactcctctcagacctggcagatagtgtcctttaaagagtacactaattctaaaaactgcttatttctatattgactgagataggaaaaaatagccttcattttcacaagtgattcactctaatcatttaatacctattactgcaacaacatgcaccagatttctgacagacacctgtttgcaaattatctaagtttcagagcagaaagcctggtttagaaatacaataccatctgtaataaagtagcactagcactcatctggactattttggactaaaaatagtccaaaaatgaaacacaatagaattttagtttcttgaggattgggaatatcagtcactgtatagtcattgcttcaagaacagtacccagtacatagtagatgctcaatccacatttactgaaataaaaagaatgccttaatagcccactgtcttggcagactttacctactctcattccagcacttggaacaattacctactttcaaggaccacctttgtacagtcatgctcatgcccagaacaaaattcttatttcacagagataccaatagtgcaaaacaaaggttttgactggttctctgctttagcatatgaataatacactctagtctacagagaagataatggaagccaatagtccaagcgttcaagtggtacttacttcatttaaaagtaaaagcccgggatagacaaagacagaaaaagcagcattgaaataacctgtgtgagaaagcagaattttaacaacagagctgggcaaaggaaaaagcaattagtaggtttgtcttcatgcagcttcaagagtactggttgttaaaattatcttaggagctggtggtgcttggatttcctttcaacagaccctgaactatgcagtgcttaacctccttttctgagaactatccagggacaccaaataggaatggatgtgcacatcgctgctgtcagggctcagaaagataatacccaaaatgaaggcctcagaaacaaaagactcttggaccttctccagccctcctctctctagcctctaattttctccccataggccagccacaaaacctaaaaatattattctaatccctaccaccttcctgcataataactggccatgaagaaactatctgacctaccttgcttaattataggtcattagacccccattccagaaagcgtcctgccccatacccagaagcaaggaatgctgctgagaggcaaagatgaatgcagacacaccttgctgggttttctcagtctaccaggattagatcacattttttgtccaatcatatttctatatggctctctgtactttgttgagcccaagtacaaaattggacaatttcccctgtatctttgggtcatcattctgaaggctcccatgtcatgtaaaattatgatcaaataaatttgtatgccttttcttctattcatctgcctcttgtcagtgttttcagcaatccttcatagagtgaagggatcgtgtattaggattctctaaaaggacagaactttgcaaacccccagcttttctgcgtggcagataggaaattgaaagtacatctgcttggttgctgtccacaaccaatcagactgattgtgggccaagtctgcctttgcacagaagtgcaactttgtaaattcactttagcttctgattggttgctttccacaaccaatgagaatactttcgttttcaaaaaatccctactttttttgcgtcattctttccttgctttgtgtgttttgtctaattctttgttcaaaatgccaagaacctggacacactccaccagtaacaagaacaatggagaaggttcaaaatgtcagattttaaacaaaaatttcgaggctatttattacctagaaaaacaaacaaaaatgtgcagtttaaacaaacccaaaaagagacagagaatctattatttcaggtcactgagtatgtactactcagttgtctcgggatgtgacagtagctaagaccctctttctgacctagagaaaaatccttcattcttcaaaataaggtttgaagtcacttcctctaggtaggcttccataaacctagtcagatgctcattcacaggacttttacagatagctctttgatcctctctccaccatagaacttgtattacactgctcttacatttgattctaatgagactataggcttcaaaagaactaggaccacacctgtcttttgaattcccagccctgcaacagggcttggtttataggaacactgaaagaatagcctttggatttgttgaatgtaagtttttaaagtcagggaccaggctttacacagcccataatacaagctcagtattggagatgtttccagtattatgggtcctaactcaccaagacagaaggaaagacctcacttttccaagttcccattcagcaagggcaaggaaggagtaggaagcaatacaggaattcagtttctgaacgatcattaaaagaaggatgtccaggttgcagcagcagcagaaatcctataatatatttttgtttttcttctcaaatgagctagaaaattggttctcaaactggtgattttgtcctccactcccatcccactgatggccacaggaggcagccaaatgcctaggaagatgggataggggtaggtaccaggtggaaccccacttccaagccaaagacagtttaaagcctgaaagcctagctacaagttaaatcctcggactggactgagaatttgtcttcccatttggcacactttcctctgactgaacccacccttcacctatttaacatatagctaccctttcctaattggttttctaaattgtcatgcccacctttgagtggtgtcttcactttaaccttttttgcttactcacacaccactcagcatgcactccccattctgagtccataaaaggtcccagacccagatacatgggggactttcccgccttctggtagggggaccacccgcatgacccctctccactgaaagctgtttcaatgctcaatgaaattcttctctgacctcctcacccttcaatgttcagtgcatcctcattcttcttgggaataggacaagaacttgggaaccagtgtgcaagccagacttggcccaggtgggctgactgggcagggcgccccctgtggcaggtagagtgccccaagagaagcctcctacatcgctagccagaggtccccaactggcaaagagaccaagaaaaatcctgcataccaccaaacatctagcaaagttgggagacattttgggctatcacaactaggagggtgctacaggcatctactgagtagagggcagggattgtgctaagcattctgcaatgtacacagcagcccccaacgacatcaactgtgctatgcttgagaaaccctcagctagacaactctttgttgtctgcagctaaaaatgaccaatctcctttctaagctccaattttcccattggaatcatggcaacaataatcaaccacttcttatatgttaagtggtgaggcttaagataacaaatgtaaaattcatagagtatagcctggcacataactgctcaattattattagatatttgtagtaatcattattataataaaagccgcatgtctgcacataatatggaggtatcaggtactatgctaaacatcttttaaaaagctgatattatatatgctccaccactcaaaacatgcttggtaaaagaataaatgttgacatatgcttgcttattaaatgattatgtgcataaggcaaatataaaggacataaaagtgtttatcagggcacaatactaaaaacaataaattaaattccttttattccattaagaatgcttttctctaagaagttcctgatcctgagaaccaggcaatcttacatgcaaactcaaagctgttttatccctctcttcagacaaaatacaatcaaacaaggcgtggctgaaacctattactgctagcctggcagaccactggagccaatgctgccactaattctgtcctgctatatgcaggaaagcgaaagagacacacggcacttcagagaaatcaatttcctttattagcttcctttctttatcgtttgctttcactgtatgttttgtggatcaagttaatcattttcatgtaaagatcaatcttaatatggactttcatttgaaagttgttgtcagattttgtggagaagccaaattctagagaaggatggtggggggtggtgtggggtggggtggggtatacacctgacttttgttgtttccagcagcccaaccattccatgaatttttggtaatagtatcccaaaaccttcttccctaatgttggcaactgtttagttcagatgtgtcgtagccaaaattgggcacatttcccaattcaggccaattagatatttctccctaaattctgaatcttgactaaaataaacagaagactgaaaagaactgaaaattatttctttaaatcgtggtgtccttataagactgttcagtagcacttgctatgcataaaccccaatctactctgctttctgtcaattctcaagtctcattctcctatatcctttagtctatatagtgaactactcaaagcctgccaataatttttttttttttttttttttttttttgcttaagctaaatagaatctacttttgtttgcttataatcaaggcaatgctaactgttactggtaaaaacactgtaacacactactgacaatcatggatctggagccaggatatgatatttctgtttctcttttatttagtcatttatttaatccaccttgtgcttcggttgctaagtctgtgaaggaaaaaatgtcggaaaagcctaccaattacagatgcctagtaggtccagagggttgctattacagtttcttattcatcaattcaccccaaaagataagtaattgaatcttttttaatcccctgagatttatctagctcacccacttgttaaggaggatgcatgtaacttctgagttaagaaatataggcaagtttagataatattcaatgggaataggatatgcaaatgtacatactatattttttaaattttatttatttttatttattgttgcccaagctggagtgcagtggcatgatctcagctcactgcaacccccgcctccacagttcaagcgatcctcctatctcggcctcccaaatagctgggattacaagtgtgtgccaccaggcctggctaaattttttgtatttttagtcgagacagggtttcaccatgttgaccaggctggcctcaaattcctgacctcaaatgatctgcccaccttgggctcccaaagtgttgggattacaaatgtgagccactgcacctgacccaaatgtacatatttatgtgtaaataaacacacataaatttttcaaataggagcccctacatttctcttccctttgatgaactgttgaaccctaataaaatgaagagtatcacacaaccattactggaacctgttaaagccactaacagagaaagtcatatttcaagtatcagttgcatactaaacgaaggctctaccaatgacagcacatgcctcattttaaagctatctgagaaaattttcctcaagtcttttcaaccagcactcaccatgtaacttttgaaaacataggtcagtttatatgtgtgtaacacacaggcacattaattctataaacattcttttcaaggaagctgcctggacaagtgctaggttgtaacggcccactggactaaccaccctgcacgtgctgcccagtttcaacacacttcctcagccgagacttgagatgcaaattgagggtaaactcagcttccaggcatagacttgaacatttaatgccaacaaagtcccattgtcagacccctcctgcaactcctaatccacatatgtctatccggcatccactaggacaactacctgcgtccacaacattaacatgatgtggacaccccagaagtccactaaaacccagtggggcaaggaatgactgtactagaaatgtgtgaaaacaatgagatttgagggtctttactgatcaatgatagaggatgaggaaaaagaagaaaggaaaaagatcagtgaatgtctcaagaagacaaaaataaaggagattaggagagacaatcagggagagaaaagaaatgttgacggttaagaggagaaataattgacaacagaaaatgaaggtcagtcatctgggccaagtgtatcatttacttatcaacttggtatttcctaagatctaatgtgataggagatactacagaaattagaatgaaatatgactttaatattgattaagttctatcctggcacttgccctcaaaggaaagatcaattaccataatcagggaatagacttttttaaaaacaaaaaacaaaagccataattccagtggctttcctgagagaatttatgagtattgccatagattaaagaatggatatcctccagcagatgacagcaaaaaattctgtagcacagagtttagggactcgagtctggagtcagactcgggggctcaaacgccaactttgcagcttaagagttgggtgactcctgcaagttccttactatttatttgatcctcagtctccttctcagcaaaacaggagagtacagatttcattggattcttgtaaatactgaatatgatagtgtatgttacaaaagtaaatcataagcccaaagttcttttacttggccttgattaaaattataattaaagcattggctattaggttcagagcatttaggggtaaacttctaagcaaagaaactgttaacccaagcactactgaaaacataaatcctggagtaatcataaccctttgtttagagagaagaaagaaaaggtctaaagactatttaaagtaaagtgaaatttgagaccaatctgtggagttcgtgttcttgtaaagctgaatataggcatcatttggtttaccagagctggcaatgatctatcgcacaaattgaaagatttactttaactgtgaatctgtaaccttggactctggatatttatagctgtaatgagaaattacatttgttagaatgtttgtattaacttttttccccacaggaacttggtttgccaactaaccttgtaataaccatagactaagatgtcagtgatctagttacagtttactcaagccatttgaaaagctgaacattttcttgctgaaagtaatacatctaaagtcatacttccctgagagaataagtcattttggagttaatcaagaaagggacagattatcatcaaaatacaatgcaaaaatctcaatttttcacaacaatgcaattcattcagcaaatctcaatactcccatgctacacgaaccttctttagattttctcctgggtgtatctttgaaggagcatgaggaatatttgctatggctcaaaaaccagatatgcattccatctgtttaaaagcttatagggtattatagatgaagcaagcttctaaattcaaccttaaataatgggaaaatcgaacaaaaacaacaccctaacagatttattttaataattctggcaagaagtacaaatctaaggaaacagaagcaaaatacaggataattcagaatactaagaacctgctattgtttaactgaaagcataggtaaaagttacaaaaagtgatgccacgttttgatgctgcttactggctgcatctagagagaggcaaggaggtatcaggcatttctgccaaagctaggtgaggtattaaccactgagaagataataggaatagatgagcaagttatccagatggtacaagatggcaggtaatgtatggataattgcaagcctctccggagttaagggtactaaagaaaagaaagtctatgtctaaagaggagaaaagaagacagacaagctggttacattggagatttttatttataagactgacacaggttaatttcattcccatcaagcaattattaataaattctcacaaggttttatcgtggataaaagaattgtaatacgtgattttaaatattttaattgccaaaaataaatttccaaagtattcacagcatttttttactttgaaaagtaattagcataagcaaataacacctcctgggtgactacttaacatatatactggctactattcatgaaattgtatttaaaatgcagagtcaaatttccatatgtaagataaacagtatattcttcatttcatttttaaaaatataagagattaattagctaaataatttccctggaaaactattaagtaggacagaggattcaagaccctaaaattaatttttcaaatgttaagaggtttatacatccaagctcacttccattctcatattgcttatttaatgacttcctgcaaacacagacaccacagcccaagatctttctctttcctatatggagtaataagacagagaacttaaagttttggtctttgcaaaatatgtgtactttcttcttgaccattaattcttgagccctgaggcagatagaaaaattggagtagtgtgccaaatgtcaatgtaaaggagacaaatttgacaggagatggagaagcattaaccccttatacctatatatctaaaatggtatgttatatatgttaaatacacataaaggatttctgtctgcaccatcatagaacgatctaagattcaagcacccaaaattacatgatactgatgccagtattctttacatattagaaaaatcttgaactagttcttaaatctgatgacttgggtctccccagtctgttcaataagacattttgactcctattaagaagaaacactcttcttatttcaacttggaaattaacaaagaaaacagcattcattgtagggaaaaatggcacattattttttataacctcctcttacttgagtagaaaaataatccacttaatgtgtctagaagggcagtaaccctacattaggggagaacagactcccagggaaaaagccatttacaaaacattgaggaactgccaaacgttgtagggttcatacagccacagctaattactatgtatattgtatttctggacctactggcaatatattggctgatctttctggattgtgtcttctcagctgaacgttgtttatttcccacatcatgcaaatgacagggaggatgttggtctattttgtgattggcagggtaaaaacttaaaattgtgttttagattaggtcacaaaaaagtgtgccagatggttgttaacaaaaaagaaaatgctttcaacaaacctcacatgttgtataatcttggacaaaatacaaaagatgtaaatgtcctgccacaaatatattggagctggatccacctgacaatgctgaaatatctagtagaaacaattcccaaagaggtatgaatctgacttttctctctagaaaaactgctggatgacttcttagaaaagttaagtcagaacccatgtttttttaaaaaatcatttttcagtggtacctttgtatttattgtctactctagtattttctcttgcctggggtggggggaaacattttttcacctgtattatcttcagagaagataatacacctgcagtgttttagcttggaaagttttaaaaagtaaacaggacatggtggcacatacctgtagtctcaactacttaggaagctgaagcatgaggatggcttgagcctaggagtttcagtctagcgtgggcaacatagtgagactcccatctctaaaggtaagtagatacataggtaaataaaacaaaggcagtatattttcatttccttaataaaaatcttgaggaaggtgggggaaaaggcatgtactagcttgcgttcctcatagtccattagcagataattttctcaatagtgtatgaggacaaaaataaataaataagaccagtttcacatttaggtccctagagattcacaatcatcatctcccttctgtctgccaggatttaaattttatttttaatgtggcctctcttacgcatttccctctctctgcagatttcctagtctctcccaagataactggaattgtactcagtattagtcaagtgagagtgccatttattgaccaccgaagaaaagccaggtactctgcagatctcacttcattcctcatagccataccaggaggtagcccatttgcagatgggcaaactgtaactcaaggtttctcacctaggaagggactgagcagagtctcaaactgatatggtttggctctgtgtccccacctaaatctcattttgaattgtaatttccccatgtggagggagagacctgtaatccccatgtgtcaaaggagggaagtaattggattatgggggtgggtttcccccatgctgctcttgtgatcataagtaagttatcaggagatctggtggttttataagtggtagtttttcctgtttgcacatgctttctctcacctgccaccatgtaagatgtgcctgcttccccttccaccatgattgtaagttccctgaggcctccccagccatgcagaactgtgagtcaattaagccctttttctttacagattacacagtctcgggcagttcttcatagcagtgtgaaaatggactaacacacaaacctagatctaactctcagacatgttgttgatgttgacagaaggtaaaagagtccataccaaatgaacattcttttagctacatacagcaattaattttcaccagcccttgagaaaagatttgaagcactagtcagaaggaaaatttattaaatagaagggaaagacatcaaagagttaataaattcagaaactgtacaactgagccaggtgttgaacagaggactagacatggagttagggtgagtaagagggagagagagagggagagaaacactaagaaaagaaaggcagagaaccatgcaacgacttccctgattttaacaatgaaagtagctcagaacataggagttacttggccaatagagttaaaggtcttacttaagaagtaccatgcaaattccatttctggttgccagaccctgatataccacatgttcatttctcaataagtgcatgttaggtaaattgaccactgtctcttctgaaatggaaatgtctatagtggtaaaggcattgccattggatttgaaagctgcaaagcaagttgactgcagggaactctgtgtgtgtgtgtgtgtgtgtgtatgtgtatgtggcttgtaaattattcttttaaactgcttacaaattagctgtgaaactggtagtatgtagttgtccatgtcaataacaaaaaagcaaacacacaaaaaatgcagatcagaagaaacataacctcagtcacttcatattaacagaccattcactcatccatttgtttaaatatttatttaataactaccacatgctacgcactgtgctacatgttaggggatatattggtgaataaaatagttatggttttagcaattacaaagcttacaatctagtcagaaaaacagacaaaattcaagtacaacagaaataactatgtaactacaaattgtgatagaatatgaaggaaataaatgaggcacaatgataaagactggaatgataggcgggtggatgacagagaaatgcatttacatacagtggttaggaaacgcctttatgaatccaaattctaggatctagatggagctctaacttaaacatatattggaatcacatggagggcttgttaaactagattgctgagccccacccaccaaagtgtctgattcagtagttctggagtcaggcagataacttgcatttctagtaagttcccaggtgatgctgatgtcaccgaactaggaagcacactttgcagaattaccggactagagcatagtgcaggagacagaaaggggcctgagctgaggttggaagagtaggcagggaagctctagataccctgacacatgctcagtgacaatatcagtgccaaattcagaacctgtctaggacttggagtgagtctaatgatcaagacaactatgaccactactgttatctttgccaaaggaaggacctctattactccctcttctaagctaagaacctgaaagcaaatttatcaaggaatacaaagaaccaactctaaaatcaaacaatattttttacaaagcattgctatattaacacagtatctaccatccaaagaacctgatgttatcagagcatatttaatagagaagataaaagagatcaaaaggtggcatctgccttcaaacatagagcgttctgaggattacggcaaggaaggcatttctgttaatagtagaagatgtgagcatgcaattattgtaagaatgatctaaattataagtaaagaagatacccttgacctcatctggtttgaaacatttaactggcttccaaaggaagataatctttattagtatttgaaaagttagatagaaagctaccagaattttgatagtttcgtagctctcaactttagtcttcccccaaatcatttgggagcttgttaatggtgtagattaccagagccatcctcagagtttctgatggaatcagatgaagtgaggcccgggaatgtgcactttaataggcatcctcaggcattctgatgctggtagattaaggaccacagtttgagaaatacctagttaaggcatggtaccctgtaaatggcaaaacccagatggataatctcttatggattttgatagagataattgaagttttactatgtgccaggtactgctgggcacttcttaaaagtactccctttagtttttaacaatttaaaaaaataatactcaagtgatgagaaaatgggattcagcaaagcaacttgtctgtagttgatcatgtaccaaataatttatagagccagaatgtaaactgagggtttctgactccaataatacatttatttcaatgatactgagctcatgattgctaacctttgtgaagctacgacaatcattaaacgatttcctggcaaccacagcttctcctaaaagcattatgtgatttggccttttaaaataaagagaaacagagtgtaatcatatcttgagactctgaaaaatccttagatgtctaaaaatattcacaggtgctggacaaccaagtatatgaatcaataagagaatccctaacttaaagtcttgtccactgatattacactggacatatctatccaacatcaagctcagagacagaatgtttagcagtgaagggtagaaactgaagacaaacgcctgagttaaaaaaaaaaaaaaaagtctctatcatggattagctatgtgaaagtgggtaaatgatttgatttctctgagcctcactttcctcatctataaaataataataattactttgggatttttatataagatattattatataatactattatatattattattacatacaatataattatatataacatattaattccattaattataattatagtgtaaaatatattatatataatagcttacatatttttgaatcatttggcatagtacctaccacacagttgttcaatacatgttatcttaattcttattaaattattacttttaagaggcatgtgatgcagttaataaaatagtggaaaaaacataaaggcccaataaacataacaagatggccaatctaatcagaattttgaaaaggcaaataattaaataaataaatcagcaaaatatcacaaaattccccataagatcataaaaaagtcaatattcataggataaaaatattggtgaagaagaggagaaataggtattctctctcataaaccataaattgatacaaccaataaaagggcatttgacagtttgttaaaaaaattgttttaaatgctgtgatacagaaatcctattttttcctattgattctacactcagtagaacagatttcggtaaccttttcctgtaaagggacaaagagtaaatattttagagtttgtgaaactttttacagtctgtcatgataactcaagtctaccacaattgtgtgaaagcagtcccagacaatgcatacatgaattagcttggctgtgttttaataaaattttatttatggacactgaaagttgaattttatctaattttctggtgtcaaatattcatatcgtgattttttttcaaccacttaaaaatgtaaaaacatttcttagcttgcaggctgtaacaaaacagcagcaggcatgatttggcttagcagctagctgtagttattaactgctaccttagagtgatacctactcatgtgcacaaggaggcatggacaaagacatttactgtagcgttaaaaatctgagaacaggccgggtgcggcagctgatgcctgtaatcccagcactttgggaggccgaggcgggaggatcacgaggtcaggagagcgagaccatcctggctaacatggtaaaaccccgtctctactaaaaaaatacaaaaaaattagccgggcgtggtggcaggcgcctgtagtcccagctactcgggaggctgaggcaggagaatggcatgaacctgggaggcggagcttgcagtgagccgagatcgcaccactgcactccagcctggtcgacagagggagactccatctcagaaagaaaaaaaaaaaaaaaaatttgagaacaactattagatcatcaatagagaaatggctaaaaaagtgtggctacatccataatctggaatattatgttattctatgctaatactatgttagcaaaaagaataatttatcacatacaattgtaagagatactcaagaaacttcatggtgaaaaagcaagttgcaactgttcagtaaaaatgcaagctatgctcggacttagaggttttagtacttgcaccattatggcagtgaaaaaattcgttagagaatgaggtcggtcacttttggttcatcattctgtgatcacagaacacagtgggtccatttgctgagacggagccatttgctgttcataaatgtttggatttgtctttcaacaactagctgacaaaggcataggcttaaatgagaaaagaggcaaagaaaatataatagaaaaactcaaagaacacataattaaaagcacttgggggactcctgaacagattcctactgtgtttttatactgaatgtcatcattctcaatgatcaggaggcagatgacagcatcaagacaatatggtgtcaagtcacatttcagaatgttcccggggctctgatcagcattagcctgactaaccagatcagagaagaaagtggtcacagcaaataccctgtctcagttcattactcaacacctgttaactgtgattaacggccctggctaattatgtgttaagagcatctcaggctgtaatggatcccagaggtctgcaaacttgacttcatttacatgtttgtctcctttcagaaggtctcagccaaacatggccgaaatctcccgagcattttatgaactcccatgtcatcaactcagagtttcaaatacaccagggtcttcctagaaaggacaacgaatgtctgagatgtacatttgtttcacagataaagcaggcaaggtttagattttatggcacataaatgggcctcttgttgcaattaatattataaaaggctgctaatctgtgtgcattaaactaattgttacattttgtgatctcggctaaaagactaaactgtatttagatggcagaatgcactaaaacctcgctttatgtctcaaactaaaactgcaaaagtcagaaatcaaaaaggcttcagagaagctttttgtctactcatttttagttttaaaaatatgtattaacattaattttacataattatgtcatgctatattcatacattaaatattaatacatatacaaacctatatatatgtatctgaatgtgtgtatatatatatatatatatatatatatatatatatatatatatatatatacgtgtatacacacacaccacagacgattagacagcccttaccaaggtatttttcttgcttttcttaaatggtattgaacctaactcttcctacagttaactgaaagtcaactaattaacatccctcccaacttttttttttttttttttttttagtagaggagcagagctggcagcagacattaaatccttcttcattcttatttgcttagtctagcaaagtaatgagaaaaaagtaaatccactaacaattgtgtgtgatggaatattatgcaacatctagtattcatgctactgcactccagcatggggaacaaagtgagactgtcaaaaaaaaatatattgaatgtctacatgtactgatatggaaagacatctatgacatatgaagtggaaaaaatcaagctgctgaacattagatagcatattatgatgcaaataaatgtgctataatagcccaactccacatatgtgcatctttagattcctgtatacacaagaaaggatctgaaaacatatagaattacaaggtcttacaagcaatctggttctgccttttttagcccgaatgggaagtacctatcccaaatgaccttcatcatcttcacaactagaaagagattttcatggtcccttctacccagtaacagcagagcacagtggtttggaacatgtgccgtgcagtcaggcaagtgtgcctcaaatcatatctaccacttactggccaagtcatcttagacaagttactacattttccagtacttctgctgttttctcatttgcacaacagtgcccgtctcataaagtttcgtgagggttgtgatttaatagccgtatagcacatgccttagcaagtgtcgtcaacactcacctctctatcattcttagctagtactttcttcatcttgcctcagttattatttgaaatgtgcttgtttccttagtcattacattttctaatttgccaaatgttaaacaagggcaagagttggcactttctgtgtctctctgcttcctcccaccaccactgtaagccccaaataaaataattgttttttacatttctgaaagcttttcactctgttacaaatcaaggggctccaacatgcccttgtttctaacaattctcaatgcagtttaatgctaggggtgaggtgggctcattgacttttgctcttggctgacatttccattagcacatgtgtggtgtgtattttcctccagtattctttttgctaagagttccgtctttctctaatttcttacttttaattgtcttttcttattgatctataagttgctgtcactttgatgaaacctaagggcttcaagcacatctctgctatttactagctggaatctttaaaaaggtatcaattaggttcagtttcttaatgggtaaaatgggcataatatcatctatactttttcttcgttttgaaataaatttggcttttaccacttagagaattcatgtcaattttagaaaaacaaagaccaaaaaatgaaataaacaaagataaaaccattcataatcccactacagatgtcaaaagtctattctacatccttctagtccttataaatgtacataactaaaggttctgggtcaaggggtctagacaattctgaatcttgctttatttcttattctctcttcccagaccactcaaaatgttaagtctgatgtgttttaattgaatacctttcattgtgcgtaaatatacacctaaaatcacaaatataaaggcttttttactgaaggccatcatgctttgcatatttcctgtaacttgctttgctaactttacaatatatcatgtgcaatcatccatagcagatatacattctaattcttaatgacctaataatcatccatagcatgtataacacagttcattcaactagtctcaagtgatcaaaattctttgttttcatttttttgccactgtgaacaatgctgcaataaataattttgtatatatatttttatctatacagaataattcacaaagagattactgtgttaaaggctatgtgtattttttttatttaaaatgatacagccaaactgctaagcaatatatatagctcctagcatttctccacattctaacagcattggatgtcatatattattaagttgtgcctacatcccaggggaaaaaaatctatcttattttacttagcaattctctgagattaacttttcctttttactggctatttctctctggcaaactgctcattcataatcattgcccagttttcatgtggttcactttcaaaaaacttgcatggagtgtcttggtatttaaatggtttaagtattggtttgtcatgtgtgttataaatgctgcttcacctagctcagtgtttgcatttgcttactgtccaacacacataatgaaagtctgtttaggaaaatacatgctttcatacatctttgtttctggcttgccttccatctctccaccccacatcgtattaccatcatttctcttcctggcctctcttgctttcaaattctaactttctcgtctttatctcctcctcaccagttatcacaattacctctgtaaagaactaagatttctcccactactttttttttttttttttctaaagagagaataaagctttggccgaagacagttttgatgagatggctagaaaaactgcttttcttcattggcattttggaaatattgctcagtggtttgggacccatttatttctactgcctctatccatctttgctttatggcttgacttctgctgctttaactccacattctgttttgctccacttcaactgtttagctgccaggtttggtctggtttcactgatttactgtatctaatctcattccctccctggattctgaaccccatcctagaaaaggcacttccagctcacagactcgcatgtttatcgattgaaatttagttcaatcgataaacattttagcatacttgggttcaattccaatagcacagatgttttcagatcatttcagatggtgagacccagaaattttaattatttttccaaacactgctaaaaactgacattaaatttcatccatgaactgaaaacatttttactaggagaaaatcatgatgctgatatatgcaattatgctataaagtattattttattttgttaggtattccatttaatactatagaagtattatgatatttattacataaagcattattataataaaatctcagtaccacccagaaaaattaaaggtttgaccttaactttctccaatttttccctattaatatcaatttgcttttcttgttaagaaaatattaaggtggaaaacttgaaacaggacattctgttctattatttttatgttgagaattgggaaaatacagcttttgttgtatagaatgtggtatgtatgtgatgagtatggaaaatgcatacttccaacggaagcagagagacttgttcaggggccattgcaaaactccactggcaaggcgctatcagcctgcagcaaggttgtagaggcaaaggtaaaagattagagattgatttttagagggtgagctaaaaggacatattggagagctcttaggcagtgtgagggcatattctgacatcttaaatgcctctgcattttaaaatttctgaccagctgtcaattttgtccatcaaaatctcagcctggttatccttgcttataagcagcagattttttgagtgcccccatatgactccaggtttcaaatgtttgctttatcgtatgtcccaaagtccaaatactggagagtcatatggaaatattccaaagatttgcacacagaagtgtgacacataaggtgagaacagccaataaagctgttaggtataagcagttgtgcaaaagaatcagttgtatagccagccctgcaatgcttggaatcaagcagcatggacacaaagtgtctatgtgtacccaaacagggcatagacttcaatgctttttcctttcatgactagtctaaggtttttgaagctcttctcataccttatcacattttacatacctaaaaagaatcaatattttcttgttctttacaacattcttttttgttgttgttattgctattgttgaaggacaatcaattctgatttacataaactcaagggtaacttaaaaagacagttgcagtaactaagattgaagctggcatgcctttcccgagtgaggtgttagacataaaaatggctttcatttcgtaatggagaaaaaagacttaagtctctgggacacaccactcttctcccctaatctcttccacaaatagcagcctgggtgatctttttgtaatgaaaattctatcacaaactccaaatattaaaactttctcatggctttccatcatcttaagaatgagatccaaattcttcaacctagtttaaatggttctatgccagggctctccaactctggtagacccaaccctccttaatacaaatattttgtattaccctcttcactctcctgagatgaaatctactcttaagatactctacctacacttgtatttttaaaaatgttataatatcttaactttaatactaaaaagaaatattagaatgggacagaatatggttatagaagttctcattcccctagacatacccaacggaacaggcagcctcaattgccaccagcagcctctcatggcaaagcgagggaccagcctcaagtgaattaagcactatagatggtagagtagagagacagaattcaggtccttgagtagagtagagtatagatggtagagtagagagacaaagagaattcagatttcactgcactggtgaatcaaccaaccctgaagcccacattacattcagactttttaatgatccaaaacaaattcctttcacagttgaactttctacaatgggttttctgagtatgacataaaacattataaccaacatacccagtcaaaaacagagcgtgagaaacagtgctttctcaacagcttgtctaaagcatgcttatataattatcaggagaatatgtgaaaattagtgaggtttttttctgattgatatgaatgagatatcttagacttcatagagatgatgtgtttaaagaacagcctaaactaaatgtttagtaatgtttcccctaataattcttaaagtttaagaatgacattttctaatttcttatgtattaaggtctaacatacttctcaggcatttaaggcaatggcgcaataatattcaaaaattgttaaagctactcaccccaactccttctaccagtcctggtgcagctaagtaatgcagctgaccattagcacacctgaaactaccacactaatgtggcttttcagggcaggatgaggaaatacagtgcccctagctaacttcttgcagcaaatatttgtttcaattttttaagtgtagttttcctaataccataacaaaatcatttcccccaccttttctcttcattctttcccaaaagtaatacagctactaaaacactgatagtataacaatttatgttgtacttctttctgcttttatcctagattataattgtactacagtaactatagtgataaaggtaaacacttacatggaaccatttgtgtagcaggtctttattccaagcactttgaaaacattaactcctttaaccctataatatccctacaatggtgattactacttttattttactgatgagaacactgattttactgatgagaacgctgaagttcagagaggttaaatcacttggcccaaagttacacagctgtaagccaaggtttgaacagaaggtcagtgctcttagccactagactaccctgcgtctcaatacagagagcagtctggggaaaatactggctaatatcggagaacatgttttgagattattagaaaatgaactcacatacatctcaaagctcttagatacagggagataaagactgcttttcaaagagaaacaaaagtaaacaaaatgtatttcttgaagagcttacaaagctaaagtcagaaatgcatctccactctgtcctgtctggtcatctttaaacttctacatcctaaagctttggtttccaatcagtcacaatctcttgtgctctgatgcactccacacactcactcacacatgcattgtgcatttcacacccacacacacacaaacatgcccaaaatacatggaagaaagataaaattagctgtcttctctttgttgttgatcaaatgtagctgaagagtcagcaggggataaatatcttgatgcttacctcaggtacaagtgctttgaagaagaacatagaagagcaacttttaatgtagcattgtgaaaagaaaaaaaaatgctataaaatccaacccccattgtggggtgtcatttctaacaatgaggtttgttttctttatctgtagtgcatatagatgatcaaacaaaaataactgatccacaggctctgaagtttttatcagtagtcaccttctgcatggattaataaatcaaaaagggattttaatcctatcttccctttaacattatggcacatacttttgcaataagcgtggggcaaattgggagcctttctgagacacaggtaggcaagtaaaaaccacattagctgaacgtgccttcctaggtggtagaaacacatggatcaagggaggatggttgcaacacatccctatcaggaacccactgcaactatctgaagcaccctcctacaggaggggatgggaaatgtcatcctgcagtggaagtgaatacagggctgactattcagatggaaatggccacttggctcaattatgaactgtggttggcactaatagagaagcaatgattttgtttaattctttacaaagacaaaaattaaaaaccagaaggagataaagccaagaccactgccaaagatgatctttctctccaatgttcagtaaattctactcaactccatgattctctcccaccctgggcctccatcattcaaatgtgaaatcattacctggatggtgaagtaatctgtacactaaacccttatgatacacaatttaactatatagccaacctgcacatgtacccctgaacctagcagttaaaaaaagaaaatgaagattttaacacaacccaaagggccaacagggaagcatcccttttttccttatagaaaatagttctcagaactatgatgtattcatccactttttaaaagtgaaaaattttataaagcaagaaactcctcaaaaaggtcacagatttatcatgatgttaaaagtcataaaaattatagttacaggctaagtagttaaatcagaattacacaccacccaattaattttataatcaatagagattaaaggaaatgaggaagtaaagtaaatgataggatcccagcttaaatcaaatcaatatatatttattgatagccatcccatataagatgccatgaagaaggaaaagtgttatggaaatatgtccttgtctctgagcagctcaccacctggctggggaattgatatgtaatatgcagagaatttatgtgcacagcaataacaatacaaggggtgtcacaaggcctcacacaagtcatgaccaacagaaccatgtagaaaagagcatttgtattaatgcaatggtcaagagcctgggctccagagccagacttcctggatttgaatctcaactctaccacttataagctcattgaccttggactagttatgagtctttcagcaggaataaaatagaacctgactcacatgatgattgtaaaaattaagtgagtgaatacttgccaagtgcttgcaaataaggcctggcatacaataattgccatggaagtattaaatgggcaaaatacaattgaaagaagagaaagatctccattgctctaaagtctcccaaagtcctaggacggtttaagcagtgacggatgatatcatgttcattttccccttcccacgaattccctccctactgctacaaacattcttaggtctagaccatactaaagattaaaaatgataaatagtctctactttgtaaactccctgtaaaaaatgttagactcttctacatatgcatctatttatcactgctcacattcattcattcccttatagctcaaaacctgactccaacccctaccattctacagaaagcactacaaaaaccctaaaatctaaatccaactcccatttctccttagtcaacaccctctctagaacattacaaattattcaccgtttgatcatcacaattttctacttcctaggctctgtcattgccatcagaattttggcttcgagaagtaaggactgctcttcctcatacctacatctcttggcatgcagtagcatgttcaattaaattgctttactagacagtgctctctacgacttttggtcagcagacttctgagatgtccctcaagattcttgcctctggtatatgtaacccatataattcctccctcttaagtatgggcaacacttgggtaagacggagtacacttctgtgactaggttatgttatacaacaaaggtaaggggatttctcggatgtaattaggatgccaaaatcaattgactttgagttaatcaaaagggaaattatcttgggtgggcctgacctattcaggtgagccattttaaggggctgaggcttttttttcttcctaaaggaagaaataattcaaagcctaaaagaaattctactgctggccatgaaggagaaagctctcaagttgtgagagggcttcaagagatagccatgtggcggagacctgagagcagcttctaggagctgagaatgaacgctgcgcagtagccgaaagataatgggtgccccagtcctacaatcacaaggaaacagattctgccaacaggagacagctcggaactgggtatttccctagtcaagcaagcctccagataagagcacagtcaactgacaccttgatttcagccttccaggacctttagctgaggaccccagctaaaatatgccatgttccagcctaaatattccagcccatgaaaatggtgagacaataaatttctgtggctttaagccactacatttgtggtaatgtattacacagcaatagcaatctcccgtaccctctgccttccctctgtcttttcctctggctgttttttcttgatccaacacctaaatgtgggttaatttttcctggaatttcttctttctcaacactctccaaagtgattatgcctaattgagttactttaataaccatctatatgtgattattgctagatttttagactgctcttctctcttaagtcatgtcctatttttcctactgcctgctggtcaattccatgtgggcactaccaaactcctcatttgatatctcccaaatctaccttattattgccccatctacctcttgctcaatatctctccctcctagctgggccagtcctgttaatgtcttctccatcctcccaatcatttagtttgtaaacatcactaggacattcttcctctcctgtttccattagaaccaataattggccaactcctgttttaacaagtttatattcaaggcttcttttctattcccaataggtactaggttggcctttttcttcctaatttattaaaaccttagttcaaaatctctaagtatttacaagtaggtcttccaaagttaatgaaattggcacaaccccaagagggctctcaaagtccaatacatgtaagtttccaatctcagctctgccacttaattgcaatgacctaatcatatttttaatatctttgggtctcagtttcctcattcaattattggagaaggtaacatctatctcacagggctattgtattacatgtaaaggaatccaatcaatgataactgttcgaattattacctggaatcgtggcaataggacccatttccctgtcaatcggacttgaaagcttaacaaggccttcaattcttcttcctatatccctttactgaaccatcagggtaaactgaatcaatgtcctacttggtagcttcatcagagcacgttttgagtctgcatccagattgttaactcttggaaaacattagcaatattgcttgtttatccttctttctgtgaacactgactaccacattcagcaataaacattgataaagaaactgaagagttgttaaaatggaaacttgacagcataaaggaaaaaggacaaagaagcaagtgacaggggtaaatgcaattggtaggctgcatcttagctaaactcaaagtgaagcaatgatgccccagcaggctaaggttactcttaatgagaaagtcccttgggacataaatgtcatcactgagatctgatcttcttctaggacagttagaattttcttacgggagagaggcagatactagtgttgttcacctcatcacatgcaacccaaagaaaatacccaatatgaatgggattcttttgaacaaagggaaagaataaaaataattggatatgcttgacaactttcagttactctgcttggccttaaggtgttaagagttgaaaatctagcttttacctagtgcagctgaaaatctctctatataatgcaaaacttcaaaccaccttaccaaagagaggacagcactgagacctagttatctcttaggaaacttcgcaggctattactttgagtacaaaacaatgacacaactttatttcctgccaaacactgagggtacgacattcataaaaattttggtctagtttatgaaaaataaaccaggaggcatcagttaaaactcttataaataccttctttaagtgattttaaaagatttcactgatttcttccacttatcaatagtaatgaaataaaaaaaagtcctagaaatggttacgctttggacaagatttgagtaagacattaaaaaattctattggaagactgtcccagaaaggagcaagagctaaatatggagacaaaattcaaagaaacccaagcaaaaagaaggaaggaagtcaggaggaatttcctgaacaggcacaacaacttcagacccatgagggatgggaaaacaaaagaagttctagatggccttaccagctagagaacaagcaaaccctggcaagagcctccccaggcagcaggtttaacatggcccggccctgtttaagggtatctatcacacagtgatagatgatgctctaataaggctctgcagggtgatggagggaacccataaacccaatgtggttgggatgaggatggaacaataaagaagagagaataaaaggttactagttgttgagaaccctacatgtaattttatgtataatagttgactttatccccacaacaactttctaaaatatcaatatactcactgtataggtgtggaagcataggtactaagaggctaagtgaggaggtggaagaagtcattggtgagcaagcatttccattctttcctaaacacctatggaagaagcatacctccctgccttcactgttggacttggtcatgtgactcgcatgaaaaggcaacagaagaccatgtaccagcttaagcccgtgccttaagaagtttctgcttgtacctctgggagatactgactgactggagaagaacatacactttccaggcaaacacaaagccatgatcatggcaccaaaatgagacatatggggcagagccgtcttctgacctgcagatttgcagtattaaaaagatgccctcagctgctctgtggagctgtgaggatacaatgagactgttgcattccactggagaatagagcgagtaaccagtttactcaagtgtctaaaagtgattttttcactaagtacctcttactagcacttaacactgtgtctaaaacacagtagccattttctgaacaaacattaccttttttcttccacagagaggaagaaccacagaagtataatacagaaacccacttctgacttccacctcaaaattctaaatatagtacctttatgaggtgtcttacttctgagccaacttgattcttacacagcctatcccattttgttctggttcattgtgggtctaagggcaatatttttttttctgccataaactgctttcttgcactgttacttttacaaatcacattagctaaaaatactgcattttattctcttatatcattctctctctaaggcaggatacttcactcttcactgtatttttataactctcatctggtatttttttatgtctgttttctgcacttatctccatcaagtttagataacagtcaccaacttcttgatgactctaagcttttactgaactttgggagattacatctatgtaaggttcgatgtactctactaattaaagatctctttctattgcttccagcagttttcattccttgagattaagccaatagttgcaagggtggtgagattcagggcagtgataattctcaactactctaaagcaagattgctcctttttctcagtcctggttttgggccaggtgcggtggctcacacctgcaaccccagcactttgggaggccaaagtgggcagattacttgaggtcaacagttcaagaccagcctggacaacatggtgaaaccctgtctctactaaaaatacaaaaattagccagccattgtggtgcgcacctatggtctaaactacttgggagctgagacagaagaatagcttgaactctggaggcagaggctgcagtgagctgagatcgcaccactgcactctagcctggatgacaaagcaagattccatctcaaaagaaaaaaaaaaaaaagaatgaccattaacttcattctatcccttacatgcaacattcttgctccatcatttctttttatgatgttggcctaatgatttagtatttaagttttctttacaaactggataacaattaacaattttatagcaaagcaggggctctcccaactcagaaccactgctcgctcactcttatccgtagaatcaattcaggatgcttagtgtagctgtcgctggctgtttcactgacctatctcttgccgacagctccctcaaaactatctccccacctcccacacatacttgaaagggaactaatgtttatgctttcaatattatttaagtatatattttaattatttcaaatcatttagtattttactggtgaaggacgaaggctcaagttctatcttgtcctcggctacacatgcagtaaatgacaaagccatcttaccaaagtcgggagtctgcatttcctaagcacctcactgacatcctgcaacttggcttacaaacttccctcagctcaaaacgcctctcaaacacccccttctggtgagcacttacagactctctcatgtccagctcagagtcttctcttagtagctttttatggccaccctgagacaaaattaactgttgccccatgtgtgtatccgtggtctcctgcatagttttattagaggaaacatgcaaatacactattcctctgctcaccccactgacctacagctccttggcagtagggcttttatttttgtttgcttgggtttttgttctgagacagggtcttactctgtcacccaggctagagtgcagtagcgcaatcttggctcactgcaacctccgcctcccagactcaagtaatcctcccacctcagcctcctgagtagctgggactacaggtacatgccaccatgcccagctaatttttgtattttttgtagagataaggtttcatcatgttgcccaggctggtcttgaactcctgagctcaagcgatgcacctgccttggcctcccaaagtactgggattagaggcatgagccaccatgcctagtctgggcctttatttttaattctcaggactgactatagtttttgacacattgtaggcactcaacattcaacatccaataaatgagtgttggacctaatctagatagctactacaattattaatgaaaaggaaagagctctgagggaacatgcttccatccatatgcgtcatctataatatactgatagtgataaaaactgagtgtatagtgaaaccgtggtaaatatatcactatatagcatttttatcttaacacagaggttcttttaaaagcttctgaggatggcttatcagtacttcataagcaagagactactagcatgcaggcaatttacaaataaacataattctaattttcacagctaaacaattgagaagggtcataggatccttaaaaactgtttatgaaaaatagctcctgcctcaaatagctcacatggatctactgggggaagcattggtgacaggagtaaaattaacatgttgccaacctaccaatgtgcttttcttggatgttgtcacctattaacatcaaatcacctatacttgtttatatttgattatggtttttgaaaacacatttttgtgtttgttttttacttataagattaaaacacatcaaaacatttgctagaagaattgtcttttttttttttactgtgataacacttaagatacatactcttaagaaaattttaagtgcactagataatattgttaactgtacacacattacacagatcatctctagaactaatagttcatcttccataacaaactttatatctgtcagacagaaactctctattcatccctgcccccatcactatcccctggtaatgaccattctacttttttgaatttgactgttttagatttctcatataagtggaatcatgcacttctgtgactggttaatatcatctgacatgatgaccttcaggttcatctacattatctcctatgacaaggtgaataatgttcatatatatatatgtggggggtgtactatacatgtatatcacattttctttatatatccatctgtggaaggacatttaggttgtttatgtattttaactattatgaataatgctgcaatgaacatgagagtgctaatatcctttgagatactgattttaattctttaaaatactcagaagtggtattgctagatcatggggtaaatctattttcaaaattttagaaatctccatacagttttctataatcattgcatcgttttattttcccaccaactgtttagaaggattccaatttcttcatacacttaccagcacttgggttttgggtttgcttttgtgacaacagcccatcctaacaggtgtgaggtgtcctctcactgcggttctgattcacagttccctgatgattagtaatggtgaacatcatttcatatacctgttggctattagcatgtttctttggagaaatttctatttaagtccttttgctcattttgtaaccaagttgagtggatttttttggctattgagttataggaattccttacatattttgcatattagatgcatcagatgtatggttcattttttctcctattccataggtggcttttccactctgttgactgtttcctttgctgtgcagaagcatttcagtgtgaggtagtttcaattgtctatttttggtgcctgtgatttcggtgtcctatccaagaaattattgcctagacaaatgttaaggagatttccccatttccttctacagacgttatagattcaggttttacttctaaatctttgtttcactttgagcttatttttatgtaccacagaatacattaaaattggacccttttattataccatattcaaccaattactttaatgacagtgggtggttactgtataccttgtctgtaccgtttctctcaaaatttgcatttccctttgggaatcttttgcagttacatcccactatctacctctcagcatttagaaaataaatattttctcttccaaatcactattgacagcaaaatctcaaagtaaatccatatgtgaatagtcacttttaaagaataggcaagttaaatactcagcaggaataaaaagtacaactctgtctttctctttctgacacattttcttccctgctttcctccttcatcctgtgagatgagggatggcagggttgcataggggatacatttgaggtttacatcaatctcacacagcagggtgagaatgatcacactatcctagtcccccaccaggacctctggagtaatgtcacatttccttgccactgaaaatgctacctgatgtacattaccttgtctctatttcaggttttaataacaaattcaaactgtcttttcaaaccattttcttaaatgtcttgacagactggtactagtgttaccgtagataaatgcctgctttataccaaagagatatcagaataatttctcttcaatttcctcctgcattttgcctaattattttgaaacattttacagtatattccttggtcccattaaattaaaatatctctttcattctttacccattgctgcccacccaccaaatcatagtttctactctttgggttgtcattttggaaataacatcttactaactacaacattcatagttaaaccaaagaaaacaggtatcatttgtaacagtgttttttctccactgtggcatgtatcaaagatcttcttttttggtttattttacattgtctccaaacaaataaatctaaagttaaaatacaaagtatccttatcagaccaccccttatcagccacttcacagcaaagatgactgtgtgctgggccagcagcaggccattagcatgcacagccttttctctttgatttgtgctgaaatgtaggctatccagttcatactagccttcagccaaagccctgtgggaagtaactgcaaaccataaacttccagtcctttacagacatttgtaatagaaaaagtatgcaaatagagccaccaacattactagggagtctaacttttaaatgacttagtgttattggacttgatttgtaaatgaaaaattcagatatgatggcaaggctgtttttaacaactctcctgatgtgattgaggagttgatgtactattggggaattatatactttataacgtaataaaaatgatttttttttttaccagcaacttgatttatgaagaatggtgcacacgtctgctgaaatatcaaagtaaactttggttacattggcgaggaagctaaaaggctaatacctccagggcacataaaagcttaggccttcttttggtttcttttcagggtgaagataaatgccagattgagttactttgttttttaatacttaaatctaagactttaataacttttatattgtaagttaaggggtacatgtgcaggtttcttacacaggtaaacatgtgtcatgggggtttgttgtacagattatttcatcacccaggtattaagcctagtactcattagttacttttcctgatcgtctccctcctctcacactccgtgttctgacaacaggccccagtgtgtgttgttcccctctatgtgtccatgtgttctcatcatttagctcccacttacaggtgaaaacgtatagtatttggttttctgttcctgcattcgtttgctaaggataatggcctccagctccatccttatccctgcaaaggacatgatcttgttctcttttatggctgcatagtattccatgtgtatatgtaccacattttttcttttttcttttctttttgagatggagtttcgctctgtcatccagactggaatgcagtagcacgatcttggctcagctcactgcaacctctgcctcctgggctcaagcaattcttctgcctcagcttcccaagtagctggaattacaggtatgcgccaccacatccagctaatttttgtaattttagtagagatgggagatttcaccatgttggccaggatggtctcagactcctgacctcaagtgatccacccacctcggcctcccaaagcactagaattacaggtgtgagccaccacacccagccagtaccacattttctttatccagtttatcaatgataggcattcagattgagtaacttttattcaacaatttttcacaagtatatgcagtgtgcccatcatgccagccactgtcctaggtgctgaggacacagcagtgaataaaacagaccaacagaagctctaggcttttatatgtcctagacatattagccttttagtttcttcaccaatgtaaaggaaatgtttactttgatatttcagcagatgtgtacaccattcttcataaatcaagttgttggtttaaaaaatcattttttattaaatcatgaatgtaatgtctgtggccatacagacaaaaaacgctgccttcatggagtctatattctaagcaacatacgctgctcatcttcacagatctgagccaaaagaggtttctttttatttctaaggcattaatattaactcaggtcaaattttattcattttttacaaagtatggatttttaaaatgaatcatcattagaaaatgtttacctaatgtctaggaaaaacattattggtctgaggttcttttaactacccatctacttcacaaaatgttttgctgtgaattaaactacacagcctacaggaaaagataaaatccaagtataaataaagtaaagaacagcacctaacaagcacctcgtattttgtactttcctatttgatttgattatgttttcaatctcttccccctgttcacaggagaggccaactaaaacctaaagtttagtacaactttctggaaattctgcaaagtggcaaacaaactgagaaaatcgtatgccttaaaaacccatcactgatgttcttgatcaatagttggcataaataaatcgtagacatgtgggcaagactgctggagccaggcaaggatttttcttaatgtggacagtgatgtcactgaggcagagagaaggaaggcatatttacaataaaagggagtgattatacaatacattaaaaccataaataaatactccattaagttataaaattctctctatatgttcttaggaggccttcctgtcaggcacttaacttagagaaaagcaagtaaagctccatttatcattcatttagccaaaacttgctgaatcctgctctatgcccgccatgacacatcatcatcactactgtgtattaagagtttactacatcctatgcactgtgctcagagattacatgcatcatctcattccagcaatgatcaaccctataagctgggtgttctttttaataatcattatatagattaggtaaacgatactcaggttgtgttatttatctgtggtcacatggcaattaaataatcagatgtcatatgagggtatgtagttctaagatataaattcatatttatgttactaaataaaggccttctcatgcaaaacaatcaacatctaaattcaggggaaatccagacctatattctaaaaatatggagttaataggtgtttggctgacatactttaagatattctctaccccatgcaccaaaatcatgactagtcacttgaattaatagatatctacacacttcaacaacagctacctagaataatgtatcatggtaatttacattttttaaaattaagatacagtatgattgtataaacatatgtaaactttcatatagtcatattatataaaaagattctatataattacatgaggcaggataagtagtcaaggaagtaatcatgtccttgggatatggcaactgtggcaaccgtacagtcaaaacaataagccccagcatttgcaccgtagtccagctcactcaagcaaagctatctccagtagggaacttcccctggagggagcatgcacatgtgatttcacctgtcctcagactgaccctgtgctgatgataatagtgaaaaacacaccgatgggtggagatttaagatgctaatgagacatgtggcacatggacaagcatgtacagctactgcacatgtgcgtccagacgaccacccagaacatgcttactagtaacactgctttccacctccttatgaataatcatgtaaaactccccaaaactccctattgccagtctttgctgtctcatccttacaagcagcccaccctgaattctctgtctctcagggtgtactgtctattccgcacttaactttcaaaatatgcttttcttttgcagtaaatgactctgtgctgcatatcctttgctgtgtcttgtttaatttcttttaaactaagaagaactgaggtctcacaacagccttcaaaaattacacactgttaacttaaataacaacttgacagttcaaatttaaagagaactattcctgtttaataatcaatcccctttttactaagacaatgggaaaataacattcatgctgatcaccaactaaccacattgttgggttaaatcaaacctctgcaattcctttgagaacataatgatgtccgtggtacccagaacaccaaaattgcctagactaccttctagaacactgtacaatctagttccatcacctcagttgtatgtttaccaggaaaatatcaattcccaaacccatcatacttttagtgtatttacatgatttaagaatataagagactgatgaaatatgcggaagaaaatagagccattgcttccattacttttttcgaaagatgagataaatcgaattggtgagagtgattggctttatattagatggagaaatctttacaaggtgagaaagatgattacaaaagcccagaagaactgtgccttagactgctttgcaggcatccaagtttttactccactttgaaggaatcatcactggtgcacagtgggtaacatttatttgagaaagtagaggtgagactccaaccagtcaattcatatttaaggaggtctagaaccaagaattaccaaacagatgcacattataatgtcctaaaaacatttaaatagcatttttatttcttggtaaagcaacatttgttgctctagccaagagtttcaatcaactgacaaactagaagtcctaactgatttgaataaagggcttctactgtgctctgtgcaaagccttgggtagctagaggcaagattctctagcaacacaagctctacccaccccggttacccacttcagaaccctgcttttagttttgggtacggcctcgaaggattacaggtgatcagatggatgacatcctgagtcatcagtcagtgattcctggtctcagtcagtgattcctccaggcacatctcccttctgatactcctaaataccagaacagcagcctgggaaaagagcaagtaacactcacttctctctgggcatcatgtgtctcccaacccttgagtgtcaagaatcactcttttctaaactcccaggctcctcaaagagcagaagtgcaggcatatatcattttagaacggaaggaatattccagacttgctgctcaagaaacaaaagatgcaagtgtctttgggcttgttcaaaagtacaccccttctttctttgtgctgtgggcaagagatgcacatgccagtctaaatgaaccactgctgtgtttatgttcatgctgcgttccatcatgtttccaatcctttactctttctcaccatttactgaggtactctcacccctacttcacatcgacagccccacagctggtcatcctcagtcacagtcttgccagttctaagccaacctagcccccagagtctcattttatatgcacaacagaggtaggcgcattgtccattagcaagtcaaagacttcttaaatcactgaatggttcctaggcttcttggaatgatttcaggaacaacttgctgcccttggtccacttctcttccctatccaaatttcaaacaagtaactggtatcttcccagtcatcagttcccaagactagacttttctcccaatcagggaaattgggcttgttacatttccatgacatgtcattctgagtgccctgttacccgtctctatctggaagatggtatataaatgaaatcatttacacagtgccattctaattttgaaaggaattgtaggcatgtcaaatagggctcataccaaataataacattctaaataataagagaggccaccaattgaggtataatatgtaccaggtcctacgcctgtaactttacctgcactatcatttaattcgctcagcaatcctataaagtactattgatatcttaccatgaggaacctcagcgttaaaaacttgcccaaagtcacaggtcatgtaaactcatttatgtcaaatttccaatccaaactatataacccaaagactccccaaaggtaaccaaacagataaaatttatataaatccaaagtttttttcttgcctgtctttctgcaatattcagtggggcaataaatctctggaatctgtcatttcagtatatttttaataaagtagactctttcacacactctcctggaacctctctccagttgctcagcttggaggaactcaaccaaagtacaaataacatagggcaataagtgatacttagaatttaagatgctttgggttttatgttggcatacgattctgatactctaccaaattacaacccagcaagagaaatgtattatgaacttgtgtgatataataacaagttaaaaagagtcatcctttcttggaaatcagcatgttcaccccttttgtttttgcttttgttcttagaacttgctgctgtacctcttgcaaagtcccataaggtagaaccaggtgatatcactatctttacctgatacaggagacagaaaagaatttaaaaaaaaggccattttacacagaagggacctaattctgaatgattcaccaatattcgatgaatcactgatgagctatacctttgccctcttcagattccttcttggctgtactaccagtaagtttgaccatgtcaatgcagggagtttactcacataactgtacaagtttctaaaaatgtctagcaataaatatattattcttggaagttatgttctcgggaaaaagaggtgtctccacttacttaacaatgaagtagctcactgaatcatttaaatagtgggctgaagaaaacaacaaaatctttaaaaaacaatttatcatctcaaacttctccttgaacaactgtttcttttttatttaccttagagaataggcaaaggaaaataaaatcacttaacacatagagaactcaagatagagacacacctttagaaagagtcacatacaaactggttagtaaattaggctattgtcttataaaagttgttgtaaatcttaggccaatacattcttgaagaattgatatttgatgcatctgtaggtatttatatatatatatatatatatttgtatttatatatatatatttatatatataaaaatatatatatatttatatgtataaaaatatatatatatatatatatatatatatatatcaggtcatttttcctcccgctcattctttttttagttgtgtttttttttttttaattttaagagacaaggactcgctctgtcacccaggctggagtacagtggcatgatcatggctcactgcagcctcaaactcctgggctcaagtaatcctcctgccttagtctttcatatacctgggactacaggtgcatgctaccatgcctgactaatttttttaacttattgtagaaatgggatctcactgtgttccctgtgatggtcttgaacttctgggctcaagcgatcctcctgcctcagcctcccaaagcactgggattgcaggcataagccaccatgcccagccctggtcactctgaaaggaatgtcattctcttttttgaaaagagatgtgatttcattataatgcctaattgttttgccacatacctaaggttcctgattcatcctcctaagtgacaaagactttttacatagaatcaaaagaacttctggtggtgggaagatggtctatagaaaagaaaaactccccccatgcctatgtcctgaatggtattgcctaggttttcttctagggtttttatggtttaagatctaacatttaagtctttaatccatcttgaattaatttttgtataaggtgtaaggaagggatccagtttcagctttctacatatggctagccagttttcccagcaccatttgttaaatagggaatcctttccccatttcttgtttatgtcaggtttgcctaagatcagatagttgtagatgtgtggtattatttctgagggctctgtcctgtcccattggtctatatctctgttttggtaacagtaccatgctgttttggttactgtagccttgtagtatagtttgaagtcaggtagtgtgatgcctctagctttgttcttttggctcaggattgacttggcaatgcgggctcttttttggtcccataagaactttaaagtaattttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttcattgagcagtggtgtgtagttctccttgaagaggtccttcacatcccttgtaagttggattcctaggtattttattctctttgaagcaattgtgaatgggagttcactcatgatttggctctctgtttatctgttactggtgtataagaatgcttgtgatttttgtacattgattttgtatcctgagactttgctgaagttgcctatcagcttaaggagattttgggctgagacgatggggttttctagatatacaatcatgtcatctgcaaacagtgacaatttgacttcctcttttcctaactgaataccctttacttctttctcctgctgattgccctggccagaacttccaacactatgttgaataggagtggtgagagaggacatctctgtcttgtgccagttttcaaagggaatgcttccagtttttgcccattcagtatgatattggctgtgggtttgtcataaacagcttttattattttgagatacatcccatcaatacctaatttattgagagtttttagcatgaagggctgttgaattttatcaaaggccttttctgcatgtattgagataattatgtggtttttgtctttggttctcttcatatgatggattacatttattgatttgcatatgttgaaccagccttgcatcccagggatgaagcccacttgatcatggtggataagctttttgatgtgctgctggattcagtttgccagtattttattgaggatttttgcatcgatgttcatcagggatactggtctaaaattctctttttttgttgtgtctctgccaggctttggtatcaggatgatgccggcctcatacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaagaatcccatcaaaaactgggtgaaggatatgaacagacacttctcaaaagaagacatttatgcagccaaaagacacatgaaaaaaatgcttatcatcacttgccatcagagaaatgcaaatcaaaaccacagtgagataccatctcacaccagttagaatggtgatcattaaaaagtcaggaaacaacaggtgctggagaggatgtggagaaataggaacacttttacattgttggtgggaatgtaaactacttcaaccactgtggaagtcagtgtggcggttcctcagggatctagaactagaaataccatttgacccagccatcccattactgggtatatatccaaaggattataaatcatgctgctataaagacacgtgcacacgtatgtttattgcggcactactcacaatagcaaagacttggaaccaacccaaatgtccatcaatgatagactggattaagaaaatgtggcatatatataccatggaatactatgcagccataaaaaaatgatgagttcatgtcctttgtagggatgtggatgaaactagaaaccatcattctcagcaaactatcacaaggacaaaaaaccaaacaccgcatgttctcactcatagctgggaattgaacaatgagaacacctggacacaggaaagggaacatcacacaccggggtctgttgttgggtggggggagtgggagagatagcattaggagatatacctaatgctgaatgacgagttaatgggtgcagcacaccaacatggcacatgtatacatatgtaacaaacccgcacattgtgcacatgtaccctagaacttaaagtataataaaaaaaaattttaaaaaaaaagaaagaaaagaaaaactctgactccattgtcttgaaactttgtttttgccatctaattccttaggcacaattttctggctgaggagaaactgcccaaagaccctagttccgttagattgaaaagcgatgaaaggaacagtgcaatgttttcttgatggggcactatggcctcaccacagatgtggcttagttacctgagccctacctggtaactccatgtggattaccataagtactctaaaatatggtaatcaaatactaatgcacgtaagtattgcttggaaaacagagtaagacagtttccccggccctatctccagagattctgattcactaggtctgggtggggctcatgaatttgcatttcaaataaactcacagatgatgccaaatgctagcctgaggaccacattttgagaatcactctagaggactgggattccaaagcactcagggtaacctgtatcacagactgtatctaaaatgttgttcttggattacagtggtctgtagctttaagaagcaattatgatacgtttcttaccaaaggtcatcaaagaaagcacactgctgtgatggcaagctatccacttttataaaaagaagaagaagaagaaaaaaaaaagaaacaaagtaatggctcttctcttggaactgagagaaagctgactctggtttacgaaggcctatctcattcctgatcgtttatcatttgagagaggtgtgaacagtctatgtcaaaaatgctcattcaacattcccaggaagccactcacagggctgaatgtaattttacttaagcctgtctgaacttgcttttcttatttttccccctgtagacacacgattttctttctttgtaagaaagaattcaaagacaaagacacagatgtgatttcaccaaactagcaaactttaaagcaaaaaaaaaaaaatcatccatttctgtttatagcaagactccctgttatccctctactcatcttcctatgcagagagaaaatgtgaaactgtaatagccactcttcaagactgattaaataaaaatcattcaaaagcctgtgttgataacatattcctatcttttgtgtgcaaatccatattgtgtttcttggaagacctaatatcctagaaaaaatagacctgcttcttactgaaaagcagcagttggaaactgaaatgcctacagtacaagtagtaacaaaattaatggaccaagccaggagtgaagcaagggagggtaggagggacaatggagttcttgagagtcctggcattactgggagaactgcaactaattagcttcagaaaaaaatccaattctgataatgccaattggggcatcattgagattctttccattttttgtttgtttctcttggtcctctttcttgatgtgtctgaggattttaagtagaattacagaagctgtgaatgcagaattatagagactctgcatgatggtatctcccaccaaagaaggttcatcctactctctggcagccagtctgaaatggggcgttactttcatccaatttggaattgagttgactcaaagctggttagtgttttgaaagatgtggtccacctctggtttacacacactccataggtgtggtttaaggcctgtggggtacactagtacacctgtcattcgtggatgtgcaactctacttattttaacctcagccctaggagactatcaaaaacacacacagtggctcacacctgtgatcccaacactttgcaccaaggtaggaaaatggcttgaagccaggagttcaagaccagtctggtcaacatagcaagaccctgtctccacaaaatacttaaaatattagccaggtatgctcatgcacacttatagtacaagctattcaggaggctgaggtgggaggactgcttgagcccaggagtttgaggttgcagtgagctatgatcattctactgcaatccagcctgggcagcagagcaagaccctatctcattaaaataataataataataataataataataataataataataataaaaagccttcaggtataaatctacccaaggcacccatcttctctcttaggtcttggttcctctgaatcctggctgctttggcagacccaaacttctatgcttgtctcttcagccttatgagatcaccaaaaattatgttgcccacaaggtatgattttctagctgcctgttttctcaactgctccttgagccaaaacccagcaaattccctgaagggaaaagcagcctgtggactcccggctcagcactctatagttccctgatttctgggtctcttggttgtcttggcagttctttgttatcttcaaattaggtttacatgtggcttttctattgttttcaaagaaacatcagtttgtcacaagccactctaatttagccaaaagcagaagtcctcaggttaatttaatagagtaataatataattacttccccaagaaataatgtttttattctgaatatgaggttaaattcaaatttaaacttaatccatatgttacataggaattattttgttaagaattagcttcaaatatgataatacacatattctattccaaacaacatgacaactcattcttagttcaatgatctcttttaagacagatatatcaagcaatttttgtaatctgtcagcaggcctcaaagaaacttcaaataaccataaatcagtgttatcatttggagtacttgagatgctctagataaatatttgatggtagatggacactaggcagaggaatagtttcatctaatacaataataaaaaaaatcacaagacacccactagtaagtttatcagggagcaagatggagaatgttgctgacagaataccactcctgcagctgccagtaataattcacccttgaagcaaagagatggagatttaaatggggacactatccaacttaagcctttctgtagaatatagtgtcctagatgaagacgtatgtagtaaagatgggggaaatgaccaaattattcgattaccatgtgttacctccaactgggacttccaatattcctgaaaattcacctgcagaagaaagtaaaagagaaacaacaaattctcaccatgaaatgattttgaatgctatttcagaatattaccctgttagatcatctcatcaatgaattcaggggccctctattatgtaggtagctcaagaacgtagcagaagccttggaagggactgtccatggtggatactgacctcaattgctctcggattataacggactatagcagtggatctcttgagagggctttagtctcttccttaacatgcttttatcccagggtgggattactaagatcaaatgcccaggcattcaaatgatggagatgtagaatggtatcaagtttggcacacatcctaaccaattaattggttttcataattatcaagtgttaagatggagtcaaaaaaaatcacacaaaaaaacttaggtctaaaagcaaacaaaaaataattttagctatgtgtgcagtatcaagtggtatcaactgatgtccaaaaaataaaaagaagagcattttctgtatgtggtaggcactgtgccaaggatattacataaaatctgctcatcttcacagtaactctgaattaaataccgtcataatcctcattcttacggataaggaaaatgaagcagagagtgggtaagtaatttagtcaaggtagtaagcagagagagacaacctgaactagctctctggatgcaacattgaaagctcttaaccgcattgctttactggcctcctggacagcattgatcattttccctgcactttaagaatgtaactacggattatggacacgtgcctttcctagctattcttaaattctgagcttaatataaaattaatgacatcctgggagccatgattcttccctactacatctcactaagaacatggtttatgaaatctttatagctagttgaaatgtgtttactaagtcttgccaggaagctcattttatagggatatcacacacaggcaatataaattcctatggggctaagaagccttcattccaaccagtgcttttcctccaagtaattcggtaggtttggaaaatgaagcatctggtctgctcttttccacaagtttctaagcttgaataaagatcactcacttgatacagaaagggttggaaaaattccagatctggcctctgaaggttacttcccagaatgcggctgttaactacctattactgtttagaccaagtatctttgagagggaaaaactcgctttgattgcctaggtacttcaagctgcaaatctgcatttcagtgaacaactactaagtaagcagacaggaaagagaaccagtgccccggtctgtatgcaacatcttgttctagccttttgtgccgaaaagctatgcaactgtgagaaagtcacactgtaagcctcagcttccttctcaataaactgaagatgatgatgatgttcttataaaggtagcgtaagtgaaagcacttagaagttattcaaatatgacatcatatgcgcatacacacacacacacacacacatatgcagtaatgtggcacttaataatggagctatgttctgggaaatgcattgttaggctattttattgtgccaacatcacaaactgtacttacacaaacctagatggtgcagcctactacatacccaggctatatggtatagcctattgctcctcctagatacaaacatgtatagcatgttattgtactgaatactgtaggtaattgtaacacactggcaagtatttgtgtatcaaaacataaaaaagatactataaaaatatggcacaaaaggtagctggcgtggtgactcaggcctgtaatcccagcactttgggaggccgaggtgggtgcatcacaaggtcaagagatcaagaccatcctggccaatatggtgaaaccccatctctactaaaaatacgaaaattagctaggtctggtggcacacgcctgtagtcccagctactcaggaggctgaggcaggagaatcacttgaaactgggaggcagaggttgcaataaaccgagatcggggcactgcactccagcctggcgacagagctagactctgtcaaaaaaaaaaaaaaaaaaaaaaaggcataaaaggtagaaaatgaaaatggtagacctatatagagcacttaacatgaatgaagcttacgggactagaaattgttctgggtgagccagtgagggagtggtgagtgaatgtgaagatctaggatattattgtaaactactgtagactttaataagcactgtacccttaaggttacactaaatttattaaaaaataaagtattaataattgcactatgacattacaatgtctacgtcaacactgggcaataggaatttttcaactccattataatcttatggggccactgtcatatatgtggttcactgttgactgaaatgttttatggtacataaatatatatatatgtgtatatatccccaagatataaatatgtatatatatctctaagagctgagctgtgcatattatccaggtcctgtatagaactgtatagaactatgcaagtgacaaagcagaaaagaataaacagaaaaagtccattaagccactccagaggaagtgagtttgagaggggatgctggattttcataatgagagaaagataatgcagagcaggaagagagattttaaaaaatgaggagctgcaggtcagctacagaagtgggttccagagagttccagtaatgccagcactgggttaagtggggaatttggggatgaaataacagcagacaatgcctcacttattaatggaaaatcatttgatatagaaaagttgtgtgcaaggagccataaaccaaaaacaccaacaaaaaccatgttttcaagaaggaacctgcttgtaacgagccagtgaaggtatataccaatttaagaattaggtactagtgacttcgaattatttaacagccaggtccatatagagaataaatagtagactatttttctcatatgggctatttaagtgagagatataagcagataaaacttcttaattaattgctttcaatagtttagagttagaataggtattttcaatttgtataatgaaaacttgtttttaggagttcttgggccaacgaagaaggcaatcgcaacattaacatagtttgaattaaacatcggtaaaacaacaactaatgaaaagcccaatatgtttttcttactacttgaaaaaatatttttactttattttttttaaccattttatcaaatggttatcaggggcccagtgctcctgaagtcaataaccaaggttcagaaatctttacccttttgctttttgggaaacgtcctaagccacgaaaaccaacttgccgttgcatatcataaggcccacctccagccttcctggttccctgtgttataaatcttcaccttttctccctcttctttcagaccttcttcatttctgaacatccccccacttcaataacccgaataaactcatctccttaatggactggtacatcttgtctttgacatatttaactgttacaagaattccagaaaactgatactagaaaaaaatgaaaccatatagtacatacacttttggtgctattttccagaagttgtatgaatgcaaaatctcaggtaaacaaaatttcataaaggatattaaatatcagttgattatactagtgccacaatcccaagaaagaatataagtatctacggaaaatctcattttgcacaaagataacttagtacaactaaaactagttcaacttttttagaaaaaacattaagcaagtaaacctgactctccaactatgagaagcattccaaactgagcatgaccccataggtagcactgggagattgcataaggaccagaaggtttctagcaatatgggaaaaaaagaaaatcacagctttagcaaaggaacaaagtcctaactatgaagatgacttaaagatacaatccttaggcccacatgggaccctgaggccacccacttccaaatttgagactcccttaatctcaaatccgagccacaattcagtgggcctaactccaattgatgtctcaagacttgtaattttctacaagtttattgctttccctctgagcaaataaacataccacactttatttctatacttctgtgagatttctcatataaataaatgcccaaatcttgggaggagaaatactgtaaccacatatcttcatttcaggccctgcataaatcaatttacagtgcaactctaaggtaaaaaaatgcagcaatagcagccacactcaataataaaatcacactaatttggactaataattagtaacctacttcctgagcactgcaccaagcgattcatatgctttatctcatttcagtatcaggaaaaccctatgaagtggtttaaagtggccccatttgacagatgtgaaaggttaggaccagagaggctttactgtgtacccaagatgactaaattattggaaagtaagtggtaacatagtaattattaagaaaggattcaacatgcatcaccgttatagtcaaaagacattggaatttacatgagaccaatagaatgtgaccaaataaagatatttaaatgaccagtttaatgaattcaaaacaatgattagtaattaacacatcaatctttgaatgtcaatggataattctaaagtgctgcagcttgcttgaaaagtgccttctctcaagctgattaaatattctctccaaaaatcttgtttacattattaatttgctcaataacccctgtcttcagagaagtgtaaacctctagctggtccctgaagagttagcacatatttttaattaaaatggtcttgaatcaattgagttattatttttccaggttatattactaacaatattaactccaaataagatagattaaaaaacaaggtacattgaaagtatgcaaatgtaagtgtcttcaacaatgaaatatctaaagttcatataaagacctgactccaaattatgaaaaatggaaaattagtcatttctgtagtgtacacgaatgatttgcaacagcaaagaatgtaaggatgtgtcaaaagtttacaagttcaaagtacaaaatgaacacttcctttaggaaatgctaaaacaaaattaaataccattagaaagattttgacactttgctcttttatgagccaaattacagtaacagagttgggaatataatgatgcaattatacgctgtcatgaacagtttaattattttatgcctgagcagattttttttttttttaactcaagtgccctatacaacttccacacctgaatgcttctaacttggctttgccattttctgactctatttaattttctggggacacagaaggatggtccttactttaaaaaatggttctatcaaaattcattctcttcacttttaagctcttaaaggcgaggtaacagtttttcagcatacactctccagagggctaaactcattcattcattctttccaatgctccaatgcctccgccaggccaggcaccaggctaggatgcaacatagatagatgtgggaagtcaagggagatgactgacaaacgaggaaaatgaaaatcaacaggaagttgtaaaacataaaggcagctatgggtcatgtctatgccttcaggtttcaccatcagtcctgttttaaatcctagccctgactctatgtaagtatttcagctctaagttaatctcttcaccacctggaaaatgggggccatgaagatctctccctcacaagttgtgaggttcaaatgagatgacgatgcaaatctggcacatagtatatgcccagtgaatatcagcagctaccgaatgataataattgtatttttattactttttgtattatcataagtgtcacaataagctatataaagcatgctaataagaacactgaggaaaagcaataaatcttcctggagtagctcattccgaacagacaaaagtttcaggggagagagggagataatgctgagtaatgggtcttcaatctctatgagaaaaaaaaataacctaagcattgttcaagagaagatgccatgttcatttaaatgactatttcatcttaagaaagcagtctgagctactaatcaaaccagaaccctagccatgctgatgatgatcattaatgtcatcatccataaattcatttgctgtgtcacatcttggtgtaggaatactcatttgttacagttatgtcttcagtttgatgtgaagagaaagcaaccataaagcaacttcaaggaagctcctccaaataattaaaattctgaagcattcctcaagccaaaagcagatcagaccctcactgagggcactttctattaaataagcaggctgctatttgttgttcttgcagcacaagtccttgagctcacaaatcccacagcaccaaaagtcattattttttaaccaaactttttttttttttttcttgagacagagcctcactctgtcacccaggctggagtgcactcgcatgatctcggctcactgcaacctccacctcctgggttcaagcaattctcctgcctcagcctctcgagtagctgggactacaggcacctgccaccacacccggctaatttttggtatttttagtagagatggggtttcaccgtgttagccaggatggtctcaatctcctgacctcgtgatccacttgccttagcctctcaaagtgctgggattataggtgtgagccaccacgctcagccttaacctaacttttaaagtcctaaatatatcttcttaataaaagggccaccatttcttgtgcacatctggagccctttctgggcactagtcactgtgcaaaagttgttacacacataacctcatttcccacaatccttcccaggagacactacttatccagggttgtaaagataaggaaactgaggcacagagatttttaagtcacttacgcaagttttaccataacaaacttgggtattacccaagtttaatattaccataataaacccaagtttactatcaaacagcagagctctgatatgaacccaactttgaactcaatgtctttagtgactatattatagtatgagtaccttgagaatatatatattttaaatttccttatttttaaaaaacaatactcaaattcaaaatacaaattaagatggggtgggtgaggtagggtgaggggagtgaatggatgaaagaagggaaaggaaggcaaattatccagccactacagtcagatgttaaagtagaattcagatatcaaccccaatcgggttgggttttcattatgatcagacaagactcttcttgaccaaagactgaactcaatttctagtcaatgtcttagataacaagggccctcatccattattagactttgaggtcttttccctccatcattgagcttcagctcagcaatcttacggccatttacaaggtgactgatgagccttcatcataaaacaagatgaaagcaacttgcctacatgcacgtcttcaaaaccaaccaaatgaaccaattacagaacaaaaccagtttagtgtgaggatcaaaatgtgataatgttttgttgagcacagagataggcacatagtgggttgcttgtttatttgctttagtatgaataataattattatggatattatcaggattcctaaaaagagtcatttaactattatgggaacaatataatatactagatgccctttcctcaaggttatgcaacctacatgggaaaataactaaaacaaatgagtagcttctgcaattaaggatcctgagaatgacttccctgcttgatttgtggtagtagctgcatgcccaaatggaggaaaattatttgaataaacattggtcagtggggagaagtgagttttaggactaggctgctttcagagaaattcatcaagaggaaaaaaatacataattttaagaagtcaaagcctattattagaaaaatatgttcaccaaatgcagctctaatacctttagcaatgagataaactgagtctagcaagtggttggactcataatgattcgatttctttaactagcccattaatccaaaagatggccaatccacgttcatgaagacactgccagtgagctagaatatctgaaagagttggcataaaaagctccaccacatgcaattaatccacatctgatcacatgcccctgaataatgtcagcccacagatgggtttgtacacacaagatacagtgttgcctttaaatattcacaaatatttttaaagtataactttttaaaaaacatatatgactcagaaagaacagaagggttgcacaactcccagatatctgaaatgatggttaccgacaaatcttcactgatgctaaagaacatttatttcacacctactctgccacattcactcccacacacttccccaaaccagaattgaattgttacttcactttcatgctgacttcagacataattgtcacttctgcaaggtcacactttggggaacactatgtaccttcttaaatacaacattaattatggaactaacctatttagtctcttgccctaaagacttcagcatttaactcgacttccccatagtttactgtatcatagcaattaagttaatggcagcagcagcagcagagaatcttttaacccctaatgggcttgttcctctgattagactagatcaaagaagctgcagctatttggaggcagattagagaggcttcttttttactgatatcagcactgaagagtggaagatcatgtgtgtgttgacatcttacccaaatccatccatgacagtttacactgaagttattcttaatgaagacttttaatacatcaagactatatggatcaggaggcatgaaagcacccttacattcaaagagaataaaatacctaggaatccaatttacaagagaggtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagatactaaggactttcttcacagaattggaaaaaactactttaaagttcatatggaaccaaaacagagcccgtattgccaagtcaatcctaagccaaaagaacaaagctggaggcatcacactacctgacttcaaacaatactacaaggctacagtaaccaaaacagcatggtactggtaccaaaacagagatatagaccaatggaacagaacagagccctcagaaataatgtcacatatctacaaccacctgatctttgacaaacctgacaaaaacaagaaatggggaaaggattccctatttaataaatggtgctgggaaaaccggctagccatgtgtagaaagctgaaactggatcccttccttacaccttatacaaaaatgaattcaagatggattaaagacttaaatgttagacctaaaaccataaaaaccctagaagaaaacctaggcaataccattcaggacataggcatgggcaaggacttcatgtctaaagcaccaaaagcaatggcaacaaaagccaaaattgacaaatgggatccaattaaactaaagagcttctgcacagcaaaagaatctaccatcagagtgaacaggcaacctacagaatgggagaaaatttttgcaatctactcatctgacaaagggctaatatccagaatctacaatgaactcaaacaaatttacaagaaaaaaaacaaagaatcccatcaaaaactgggcgaaggatatgaacagacacttctcaaaagaagacatttatgcagccaaaagacacgtgaaaaaacgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtaggaatgtaaactacttcaaccattgtggaagtcagtgtggcggttcctcagggatccagaactagaaataccatttgacccagccatcccattactgggtatatacccaaaggattataaatcatgctgctataaagacacatgcacacgtatgtttattgcggcactactcacactagcaaagacttggaaccaacccaaatgtccatcaatgatagactggattaagaaaatgtggcacatatacaccatggaatactatgcagccataaaaatgatgagttcatgtcctttgtagggacatggatgaaggtggaaacatcattctcagcaaactatggcaaggacaaaaaaccaaacaccgcatgttctcactcataggtgggaattgaactatgagaacacattgacacaggaaagggaacatcacacaccacacacaggggcttgttgtggggtggggggaggggggagggatagcattaggagatatacctaatgttaaatgatgagttaatgggtgcagcacaccaacatggcacatgtatacatatgtaactaacctgcatgttgtgcacatgtaccctaaaacttaaagtgtaataataataataataataaaagaaatcaccgttatatatttcaggcaaaggtacccagtagctttaggtttttatgcccatctgctttctcaacacaccttgaccgccaactctagatgtcaaaagctgatacaggagtcatacatcattcaattacgttcttcatgatatgggggctatgtgcattctactatatatatttttaaagacatggtctcactctgtcgcccaggctggagtgcagtggcacaaatcacggctcactgcagccttgaactcctaggctcaagggatcctcccaccttagcctcccaagcaagctgggactacaaatgtacaccaccacacctggctaatttgtcttatttttttttttttagaaacaaagtctcactatgctgctagggctggtttcgagctcctgggctcaagcgatcctcctaccttgttctcccaaagtgctgggattacaagcatgagccacagtgcccagcccatttttatcgttggtggaaagaaaagcattttttataatgtgtttagatgtcatactcaattctagcttcatcaaaatcacttggagcttttacattaatgtttaaaatacaagctacatcccagagctagtgaattagtatattttaagggttgagccagaaatttatagtttaccaaagtttccaaggtgattctaataatgacctagttccagaaatcactggtatatgccataatgcaaaggtataaagatagtatacaccaagtaaataaatgtcaaagatcaattaactaaaacaaagagtgggttgggaaaaatgagactgcctgagactaaaatctcattctccatcagctattaaggtagataaattacagcacctctttgagtttcaatgccctcactttcaaaatggggcagtaatagctaccacagatacataggtacaacgcgcttagcagtggtttgaaaccacaataagctgccaaaaagcatggctcattttgctttttaaccagattctagatcttctaaacaataaagctgattataaagacattttccacaaaatagcctttttcctctccttcaatgcttttcacttaatactgtacttcttgcaaagtcagtaggctgagcatgaacaaattaaaattaaaagctgaattacttaattaattttaaggcactctcagttcattaacagcattcctgcaagttaaaaaacaagaaaacacatggaatgattgtaaaccgcatcccaatttcagaaatgttcaaatatattggggttggggaggtgagcagggcaatctactgccatatcaaacccaaaagcttctcttaaaaaggctatgtacatgtatatgcccaccagacaagatgtccttctctcatgttgcaatcagcaacccaaaagtcctgtaaaatagccaaaggtcaaaatagttcagaaaacactacttcttatagtcctcctctccacaaccctcttttcagaagttcgtaactggcatattcacatatcaaaaaatctgaaattaagaaatgtcttcaacaaatatgtctatcaaacttgtcttgaactttcctcacttacctttcggggggcaaatctgatgaggacttattttgggaaacattaaaattagggaaagtcttttggttatacttattaggaaaatcattgtccaagtgtcctgtcttgccagaatgagaggtttataaggaaagaagttccacggctttggactaataaccaaccatgggaatcacagcttccttccaagggaaataacacctttttttaaaatttgcttttatattggttaaaaaaaaaagaaccatgaggaaacatcaagaaccaatattacttctttggaaaaactttttggggatattgctaaggatttatattgcataattcaactaaacgaattttttagttttaaaaaatcccaataatattataaacctagaaactgtttattcagatccaccttggtaaaataaatacattcaataaacacagaatacagacagctttaattttttacatgtgggtcaggaggatccatctctcccaaaacatgtatcaccccacatgtgctgtgatttacaatcctcaaagcattaaagtttaatttgtgaatctactgtttcagattcattggaattctgatccaatagtcactctaaaatagatgcaggctggaagacaattctctacattttaaagccagatggcccataacagctaaatattttttctttccttgttcagaatataattcatgttggaagtagtgaatcaacttaagtacgtacaaatttaagggaaccttagtcatcagtcccaaacttaggaatctatttaaaggaaatatattttaaggttaagtttaaaaaataacaaaagagaataccatatgtaacaaccctggcacagaacactttctttaagaaaactcccttaacgttaacggcaaaaaaatactcttcccatttcactatggtaactaataaaaattttttcttcacactgaaaaataaaatctttatttaatctaattctgtaagtgccaaaaactctgattattttatcaagttattaaatatgttattcagtagtgagccttattgattttccttttgattagaaaaattaccaaaaaaatccagctctacagttcataacctgagaatggtagaaacccaagacgtagagcacattatgcaacactcttaaacaaatctgcctcttgggatctctctccttttatagaaagagactctccagcagcccctagagacattcccatactaagtgagtcagctaaataaaattaagcaactaataaaacaatatgtcatcttgttctcattgtcataattaaaatcctttttctttaagatgaaaggtggcagctatagagtagccttcaaaatcataggctatgccgaagcaggatcttctctccaacgctgtacagacaacgcagctgtccctgacatcaccacttgaaattattccctatttgatatttttgacattaaaaggctgaagtcttttttcttctgcaagttacttccatgcttgcttattaagcattccaagttggtctctcacccaatagccttagaaagcagaccatcattatttagggcaaaggtttccagaggcagtcagaggcaggataaggatgggggatcccaaacaagccatgctctttcctaagcaaagcacctctattttgaatgtgtttgatacactgagcttccaaataagattgaaattgattttaaaaaaagggaacccccgcccccctttaagccaggtaaaaactataaccatccctgtcaagagcgttacatgaatctgtaaatcctatgacagactaccggttgaaaccgaggttgaagtcttcagttcgcctgactcagtgctggtacacagtaaaaactaacactgaatgggtgccccacagtgagtgaggcatttcagcaggaccggggggatgttatgcaacaaaaacagttatagcccttgtctgcctggagttcacaatctaatggaaggatgatcattacatcaaatattaaagagagctaccatgcagtaagcccattctagacatcagctgccgttctaatatcaactcatttactctccaccacacctttaagaatgaggtacagtgatcactccccttttacagaggagccactgaggcacagagttggcaaggttgctaagtggccaagtttggtttgaagccaacggtatggcttgagtgcccatggctcaaccactcaaccctacctcctctcccaaacactgtaagaacccaaatgtcaaatgcacctagggcaagtcctcgacagaaaggcatggggtgtgaaaagaatgtataattagaggatctgaccaaggcagggagaacaccactgaggaattaatgcaggagctgagagcggaaagcagggtagtgaagagaggagggaagagcatcgaggtaggagcaaaagcaagagatccgccaggataaagggcttggagagcaggaggactagaattcagcccatcaggacagagaacataggagggtggcaaacaggaggttatggccccaggcggacaaggaaagacaggaaggtgccaaccatgctggaccgggctaagacagctggggagccactgagggcatgctgcagggagatcactgggctaatacttgtgagtccaaaagacttttctggctgtatctacacagtcatggcacagtcctcccaataggcaggccgacacaaaaccaaccctgctctgtatcactccatgtattcctggtcatattgtcacagcctgatgtgcactgaccacctctgtgctgtgccacactgagggagcagctgctccagctaatttctacccaacattcaccacctggaggcaatgcattggctcctcaggctttagcatggcaagggaacttcacaaataagaaagtttaaaaatgatgttactctcttcaaaatcttttcttcatttgtaggtggcagaaggcaacagatatatcacatcattgagtaccatgggacatgtgttcacactttaaagtacttaggtgttatttcatgtaaatgttgagaaggaaaaaaaaatcctgtttttcttgtctcttgggaatcagctttggttttctgaagaaatagttcacaaatctaaggaaaatgatatatctatacttatttccctaaagagaacataatttttcttcttttggttgataaggatttaattgcatttagaaggatttaatcacataaggctaaccaatgaaacactaactgtgggcagaactctgtttcagttggccctattggccctaaaatgtcattgatagtgactaaatatacacattactcctctcccccgccatcctttctcctccttccatttctccttctcagaacagagaaataaaacgtctaggaaacccatcatttactggggaaaggaaggggacgtgtaacatttcaaactgtaataaggcatgaacttgccaagctgtccatgtgggaggttatagcatgcccagagaagttgcccagaaaatagacatggtttccaatcaaaaaaacttagaccagttgaaactctggctttgggcaatttacttaacttctctgggcatcagtgttaacttatgtaaaatggagacaatcacaatatgtaccttaccctgttgtggtaagattaaataattggcacagggcctgacacaataaaggttaatgatagcagctgttaattattatccacgaatcagtttaactttaagaaaataacaactactttggccattctagcaagtgtgtggcaaagagggataacagaagctccttttgtggaagaacatgtaatttgccctttatttgcacagtttggaatcatcatcataacatcctaatatgccttgaaatcctgtgaaaaaacagaagtaaacaagtaaaaccaccatagcaacactatggcagaactgagttcactaaaagatcttgtctcttgctcaaaaggcttgactcaaggaaaagaactaggtatttctaggttcccctgcattcatttttttaaaaaattgttgtgggtacatataagatatgttgtaggtacatttatggggtacaagggatattttgatgcaggaatacaatacataataatcacgtagggtaaatgggatatacatcatctcaagcatttatcctttgtgttacaaacaatcctatcatatttttaagctattttaaaatgtacaacaaattactgttgactgtagtcaccctgttatgctatcaaatactagatcttatacatcatatgtaacaacatctgtgtatgcattaaccatctccccctccccaactacccttcccagcttctggtaacaatccttctactctctctttccgtgagctcagttgttttaaatttttagttctcacaaagaagtgagaacatgtgatgtttgtctttctgtgcctggcttatttcacttaacacaatgacctccagttccatccaggttgttgcaaatgacaagatatcattcttttttatagctgaatagtactccattgtgtatatgtatcatattttctttatccattcctctgttagggacacttaggttgcttccaaatcttggctagtgtgaacaatgctgcaataaacacgggggtacagatagctcttcaatacactgatttcctttcttttgggtatatacctagcagcgagtttgctggatcatatggtagctctttagtcttttgagtaacctccaaactgtcctccacagtggttgtactaatttacattcccaccaacaatgtatgagagttcacttttctcaacgtcctctccagcacttgttattgcctgtcttttgcatatcttttcattattttgtgtcctcttcaataagccattttaactgggatattactgtagttttgatttgcatttctctgatgatcagttatgttgagaaccttttcatatatttgccatttgtatgtttcttttgagaaatgtctatccagatctctgctcattttttaatcagattattagattttttttcctatggaattgtttgagctccttatatattttggttattaaccccttgtcagatgaatagtttgcaaatattttctcccattctgtgagttgtctcttcaaattgctttcaaatttgctcttcaaatttgtttactttgctatgcagaagctttttaacttaagctatcccatttgtccatttttgctttggttaactgtgtttgtagggtattactcaagaaatctttgccaagaccaatgtcctggagagttcccccagtgtcttcttgtagaagtttcatagtttgaggtcttatatttaagtctttaatccattttgatttgatttttgtatatggcaagagataggggtctagttttattcttctgcatatagatattcagttttcccagcaccacttactgaagagattgtgttttcctcaatgcatattcttggcaactttgttgaaaatgagtttgctgtagatgtatggatttatttctgggtcctctatagtgttccattggtctatgtgtctgtttttatgccagtaccatgctgttttggttactatatctctgtagtataatttgaagtcagataatgtgattcctccagtactttttgctcaggatagctttagctattctgggtcttttgtggtattatgtaaatgctaagattatttttttctattttcatgaagaatgtcattggtatttttatatggattgcattgaatctgcagattgctttggatagaatgggcattttaacagtattgattcttccaaaccatgaacatggaatatctttccatttatcttgtgtcctcttcaattttttacatcaatgttttatagatttcactgtggacatctttcacttctctggttaagtttattcctaggtagttgatttgtagttattgtaaatggaattactttcttgaattatttttcagattgtccactgttggcatataaaaatgctactgatttttgtatgttgatttttatatcttgcaactgtactcaatttgtttatcagttctaatagttttttggtagagtctttagatttttccaaatataagatcgtatcatctgcaaacaaggataatttgacatccaacttggataccctttatatctttctcttgtctgatttctctagctatgacttccagtactatgttgaataacagtggtgaaagtgagcatgtttgtctcatttcagattgtagggagaaaaccttcaggtgtttccccttcactatattagctgtgggtctgtcatatatggcttttattgtgtcaaggtatgttccttctatacacagtttctgtgggtttttaatcatgaaaggatgttgaattttatgaaatgctttttcagcaaaaattgaaataatcatatcgtttttgtccttgtgttcatatgatgtatcattgattgatttgcatatgttgaaccatccttgcgtaactggaataaatcccgcttggtcatgataaatgctttttttaatgtgttgctgaattcagtttgttagtattttgttgaggatttttgcatctatattcatcagggttacttgcctgcagttttttttttttttttttaatgtgcctttgtctggtttttgtatcagggtgatactagcctcctagaatgaatctgcaagtattccttcctcatcagttttatgaaacagtttgagtagcattggtattagtggttctttacgcatttgctaaaattcagcagttaagccatcaaatctagcgcttttctttgctgagcgacttcattatggcattgatctcattacttcgtctgttcaggttttgcatttcttagtggttcaatcttggtaggttgtgtgtgtctagaaacatatccatttcttctaggttttccaatttattggtatatagtagctcacagtatcttctaatgatctttgaatttctatgatatcaattgtaatgtctcctttttcatctctaattttatttgggtcttctctttttttctgaagatttgtcaatttgatttcttttttcaaaaaaacaactttttgtttcatttaccttttgtattttttcatttcaatttcatttatttctgctctgatctttatttttccttctactaattttgggtctggttttcacttgcttttctagttgtttaaaatgtatcattagtttttctactttttgatgtaggcaattactactataaactttcctctgaatactgctttcaccatatctcataggttttgatacattgcgtttccattttcatttgtttcaatatatttttaaaattttcttaattttttcattgacccactggtcattcagaagcatattgtttaatttccatgtgtttgtataatttccaaaatttcagctgttattgatttctaattttattccatggtggtcagagaagatatttgacataatttttaaaaaaatgttttaagatttgttttgtggcctgaaatatggtctttcctcgagaatgatccatgagctgaagaatgtgtactctgcagccattggataaaatgttctgtaaatgtctattaggtccatttggtctgtactgcagattaagtaagatgtttgctgactttctgtctggatgatatttccaatgctgacagtgggtgaagtctccagctattattgtattggggtcttatctaataataactttacataacatatatgagtgctccagtgttgggtgcatatatatttacaattgttatatctcttgctgaattgacccctttgtcatataatgaccttctttgtctcttaccatagtttttgtcttgaaggctattttgtctgatataagcatagctcctcctgctctttttggtttctattttcatgcaacatcttcttccatatctctttatttttagtctatgtgtgtctttatattataggcgaagtgtgttcttgcaggcaacagatcattgcagctagttttatttatccattcagccactctacatctttcgattagagtttagtccatttacattcaatgttattattgatgaataggatttactcctgctattttgttatttgttttctggttgttttgtagtcttctctttcttctttcattccttcctgtcttccttttaatgaaggtgattttctcaagtgatatgtttttattgcttgcttttttattttttctagatctgttttaagtttttgctttgagtgtactgtgaggcttgcaaataacatcttgtaacccattatattaaacagatgacaacactgattgcataaacaattaaactaataaaaacactatacttttcatacccctgctttttaactttttgttgtttctgtttatatcatactatctatgtcttgaaaagttgtggttattatttttgatagattcattgtttagtctttccactcaagatatgagtagtttacatactacaatagtgttatgatattctttatttttctgtgtacttactattaccagtaagttttctactttcagatagttttttattactcattaacatccttttctttcagattgaagaaagaatcctttagcatttcttgcaggatagttctggtgttttgtttgtctgggaaagtctttatttctcctaaatatacatgtttgaaggatattttcactggatatactattgtaggttagaagattttttttccttgagtactttaaatatgtaatatcactctctcctggcttgtaagatttccactgaaacatctgctgccatacattttggagatctttgttatttcttttctcttgctgcttttaggatcctttctttatctttgacctttgggagttcattaaatgccatgagatagtcttatttgggttaaatctgcttagtgttctattaccttcctgtacttaaatattgatatctttctctaggttttggaagttttctgttatccctttgaattaacttttctctctctctctctgcctcctctttaaggccaataactcttagattgcccttttgaggctattttgtagattctgcaggcatgcttcattgttttgtattcttttctcttttgtctcctctgactgtgtattttcaaacagcttgtcttcaagctcactaattctttgttttgcttatttctgctattaacagactctgatgcattcttcagtaggccagctgcatttttcagctccagaatctctgcttgattctttatatctccctctcttcattagatttgtctaatacaactctgaactccttctctgtgttatcttggattccactgagcttcttcaaaacagctattttgaattccctttctgaaagctcacatatctctctctctctccaggattggctacaggtgacttagtttggtgaggtcatgtttttctggaaggtcttgatgctttgggtgtttgtcagtgtctgggttttgaagagttaggtattcactgtagtcttttcagtctgggcttgtttctgcctatccttgggaaggctttccaggtatttgaagggacatgggtgtagtcatctaagtttttggtcactttacccgtttctactttaggggtgccccaagcccaataacactgtggctattgcaggcttgtacagataccaccgtggtggtcttgggtaacttccagaagaattccctggattaccaggcagagactcttgttctcatcccttacttccctccaaacagatgaaatctgtctctgtctctctgtctctctcccctctcctctctctttctttctctctctctctctctctctccagagctgcctgaagctgtgggaggggtgacacaagcactcctgtggccaccgccactgggactatattgggtcagaaatgaagccagcctaacactgggtctcacccaaggcctacaacaattactgcctggctaccacctatgttaactcaagtcccaagggttctgcaataagtatatgggaaatcctgccaggcttgtgtccttcccttcagggcagtaagttctctctggctctggtcaggtccagagatgttttctgggagtcacggcctggagttgggaaatttagaaatctacttggtgctctattctaccgcagctaagctggcacccaaaccataagacaaagtcctttctgcccttccctctcctttcctcaagcagaggaatctctctgaccaccactgctccgggcacatggagagtattgcctggctaccaatgacattcactcgaggtccaagggctcttcagtgagcttgtggtgaatgctgccagtcctgagtctctctcctcagggaagttgtctttcctctggcccaggacaggtccaggaatgtcattcaggagccaaatcctgaaatcagagatcctaggagcccacttgatcctctgccatactgtggccaaactggtacccaagcggcaagataaagtcctctttacttttccctctcttttcctcaagcagaagggatctctccctgtagccaccacagctgggaatgtgctgttcacaactgaagccagcagggctctgagtctcactcaaggcctgcagcaagtactgcttggctatcactgctgattattcagggcccagtgctcttcggttagcaggtgatgcactctgcaagaactgagtccctcccttcattcaaggcagcaggttctcttccagctcagggtatgtttagaaacgctgtctggaagccaaggcctagaacagaggcctcaggactctgcctggtgccctatgctactatggctgaactagtatccaagttgcaaaacaatatcctctttactctctcctctcctcttctgaaacaaagggaagaaggagctgcctggagctgtgagctgtgttgcctagagttagtggggagcagctcaagcactcccttcaccagctgatatcttcttaggtcatgtgtaccccaggtccactggttctgagctcagtacaggaccaggactttccttgcagtccttgtggcctagactgcctttcaagtttatttagaacttcagagcactttagcctgtggtggtggagcttgccggaactcaggttctgaccattggcatggacaatttgcctctggctagggctggtctaaatgctccctccttgggaacctgctgagttcttcctggtgttgctttctactgtgacagggcaacactgagttacaatacaaagtcccacaatcactgcactctccttcccccaagcacaaagattctttctccacgtctcatggactgtgcaggagaatggcggaatggtgacatcaaccattcaagactgtcttttctaccctcttcagtgcctctttccttaatatactgttaaaaccagatactgcaatcacccacctggtcttttgttcttatgaaggtacttttttgtatgtacagttgttcaatttggtgtttctgccggggaacaaccactgcaggcttcaatttggccatcttgctctgtcttccccctgccaccccacccctctcacattcttgaaatgagtaaaaagccttcacgctaagcatggccatggaatcttcccatgttgaactgtaagatgaacagagtcatatttcaaataaagagattaggctgacatgaatgatcatatttttaataacttattaacctaattgcatgccacaattacatagtgagttttcatcttttaaatcaattttggggtgagggatgaaatactacctattgggtacaatgttcactattcaagtgatgggtacacttaaagcccagacatcaccactacacaatatatccacgtaacgtaactgcactagtagctctcagtctacttttttgttaaaaaaaaaaaagagcaaaaacaacagcaagaggaaagatatatatttaagaaaaaagcatttcaatgaggcaaaaacaactggttcatccttaggtccttaggcccatttattacttcgaactgtatgcccacttttttattttataaaggtttgcatgtcttcaaactacatgcccaccttcattttgcaaagtattgtacaatgctgtatttttttttttttttttgagacgaagtcttgctttgttgcccaggctggagtgcagtggcgtgatctcggctcactgcaagctccacttcccaggttcacgccattctcctgcctcagcctaccgagtagctgggactacaggcacctgccacctcgccgggctaatttttttgtgtttgtagtagagacagggtttcatcatgttagccaggatggtctcgatctcctgacctcatgatccgcccgtctcggcctcccaaagggctgggattacaggcatgagccatgtacaatgctgttttaaaagcagcgctcgtctttgctgcctttcaactttacatgctttggtttctcatagagaaaataaaaattgtttttaatccttaaagaacttctgacaggagagaaaaatgacttgtgtgtcccaaagcccccaatcccaaagacatctaagcaaaaccaagttgggggtgggggtggagaatttaaatagcagtaattatcgtatctcaatttgcaagaaaaacaaatgcctcaaataccattattcatttaagttttctgacaacctgacatttatctcctttagtgctatattatagaaatgtttcttattatattcattttccagagactgagaacttttaaaaccaatgaaatgcatgtcccagagttgatcctttgctttaaaaaaaagtttgaaaaaggaaaagctattatgttgattacaaaccgaagtgagttacagtaaatgatgcaaagaaattttgacaaataggtatatgcacttgaaagtggtactactctgctctcaaggtgttgctgttaagatatgaaccaacgctgaaaactccatatccacagatagctggcttcttcgataaaattcaattcaaatcaaagagtaattaaagcacttaatttgcatgagcactgttccaagattaactaaagggctgaggggagctggaggtggggagctcaattaagaacctattcaacatatttcaagagagagggacaatctgaatttaggatatggatgtggaaatagaaaggggaatgtgagagacattatcaagagagaataaatacaatgtgaagagacaacctgggagaagggagaaaaatattgccaggcttaaaatacatgacaatgaaaaggccattaaccaatagggctaactacaaaggtggtgctttggtggcaaaaaattttctttggaaatactgatttgaggtacttgcacatgaaaacttaacctcagctgggcgcagtggctcacgcctgtaatcctagcactttgggaggcaaaggttggtagattgcctcagctcaggagttcgagaccagcctgggcaacacagtgaaaccccgtctctactaaaatacaataaaaattagccaggcgtggcagcatgcacctgtatagtcccagctactcaggaggccgaggcaggagaattacttgaacccgggaggaggaggttgcagtgagctgagatcacgccattgcactctggcctgggtgacagagcgagactccatttccaaaaaaaaaagaaaaaaagaaaacctaacctcacagagaattgtacctggagatgtatgggggaaagacacattattttggaaacatttaaagaacctcatactcagaactagaaaaaaagacatcttcataaattctgatgcatttttcatcctaataccagcagtgacacaatcaggacagggaatgtgtctgcttacccagcaatcaaggaagatgaaggagatgaagcagacagagggcagggagggtcaaccctgactgcaccagcaccaaaggctagagtttcttctggtatagcaaagcctaaataattttcttcattaagcttattttttcatccatgggaaaaggaacatgtgttcatattacattaacttgaaaaattcagaattaatgaaaaaataagcctcagaatcttaaatcaactgaatatagcaacagagaatagatgaagccccaaagggcttctgtcacactcatatataataaaaacaccagtcatgtttacagttcaattttatagagctaaattgatgagtagttttggagtgttctagaaattctacaatattcattttttattgcagtttttgaatttattaataattaggcaagaaatcattaactacattttcaaaacagtagaagtaaagcttaggaggctcattttcacaaatgtattattttcaacacaatacaattttttttttttttgagatggagtttcgctcttatcacccaggctggagtgcagtggcacaatctcggctcaccacaacctctgcctcccgggttcaagagattctcctgcctcagcctcccgagtagctgggattacaggcgcctgccaccacacccagctacttttgtatttttagtagagacgaggtttctccatgttgctcaggctgttctcaaactcctgacctaacctgatctgcccacctcagcctctcagagtgctgggattacaggcgtgagccaccgcacctggccaacacaatacaattccaatttttaaatagtactacttaaatcacaaatacaactgactgttattaatacaatgaaccaggttgagttatctgccattacttactttagaacttagctcatgtcagaaatatacaaaatactcctttgatataaacagatagcttgggggaaaacgaaaaactcttattagaattactactagttgctgtagcaactgtcgaagtgttttactatgtgccaggcactgggccagagactctttgttcatctctttaatcttcactacatttctataaagtaggtatcttgagatgtccattgtactgaaaaggagacaaagcaaaggttaggggagttaagtaactcagtaacttaaatgtttttctcccttagctgaaatgatgcatgccacaggtttgaaaaacattctttccctattcaatcatttatttaagtgataaacattaatctcaacataaacagaaaatagattgaatactgtgattattactttgaaaccaaagctccatctttagagaaactcatactggcaaagcaaacaaggactgatgaattggaggtgcacttgtgcgcttaaaactgcagcagctgatgtaggcactggaggggctacaacccagggacccaggtagtttgcagaaattcacaaggtgcagggtatcagttttgtcatcactttgatacctgtcaacttcatgggcctgggccaatcagccaacttgctcaaacctcacgtttctttcatgtaaatacaggttaagcacccctacaccaaatacccaatatctgaaatgctcccaaatctgacacttcttgagtgctgagctgacgccacaagtggaaaattccacccctgacctcatgtgatgggtcataatcaaaatgcagttgcataacacagtttattaagagtctccaaggggaaaaaggcccttccagtccccttcagcgtatcttttccactcatgcccagatttccctacacaagcatgccacaaagtattgtgtattatgtgggaaataacacacagggaacttggcacaagaactggcatacaattcccgaaatagtagagctgtcatcatcattactggtttttatagtaactgtgaccccaaagagttaatagaagtgagatagtagaaaaactgatggctgtgcagtcacagaaatcttccaagtctacatctctcattgaggagatatgcaccatttgcaaagttatttaacgtacctgagcctcagtgtccctgagtgtaaaatataaataaaaatatttccctggtatgagacagaaaaatagagctaatgtgtcaaaagtaccacatggagagactggaacacaggaagttcctattactgttagtatgaaggcgctttaagaactcaaactaggcaacaggtacaggccacagggggaataaacgcaaacgtccagttaaaaccaaatccagacataagagaaactttatttgaaaaagtaactgctataaggggagtgagactactgcaatagggagagctctggtcatgagatgtgcaagtagctcaacgattgggcagaaaggaattttcttttatagggaggggtaagcaaggctagaaagatcagctgggagcactgactagggaaagcttctcctgaaggtcagctggttctcaggaggggtattcaaggagaggctgctctgcatcccaatgctgaaggcatggtcaaagttcaagggcctagggagcgagacacacctgactgaagtttggttgattatttgggcactgggtataaacaaatcagctgaccatttataaggcgcagaacgggaatgtgaaaactcagcttctggccttgtcggaggtacttaagtgagcatcatttggtctcgtcctggacacccggggaaggattttttttttttttaagaagccttttccagaagacaaagggtgggggatttcttcacctagtgctattttccaaaatacttggctcaggtaaagctcaacattaccataaacagaacaaactatatatatatatatgtatggtttgtatatgtttaagtacgtatatacagtttcgtttacatgcatatgctgaatatagttcagtacttttaagcaaagtattataatatcatattcaaacaatcaccacctttttttcctacaaaaataagcaatgaattaaaagcaagtctgtcattaacccacggtgaggaaggaggaacaattttaactacctgaggtcttcaaaatggatttttttttttcagttcttattctaatgcaatttcctggtcagaatctttttatacataaccttgaatataacaaaaaccaggaaaatggcttgtacacaaaatgaaggctactaagagcatgagaaaatatttcattcttttcctttgatcatctacttttcttttgagagagatgcagagagaggatttgagtgtttatgcctgcctttggatttcttttgctgggttttctattaagtcttctctgacatcattactagcttatgcatactgaatgtgtactctcttgccaggcatcacactaaccacactatgtaataatttctatagatctccacacagctcagtgagaacagtgctactgttaaaaagtttcatattaatgtctgcattttagatctactgcaaataatcacatattatttttctggtagatgaatttcatgccaaaagattaacttaaccttttatatacatatgtaaacaatcggtataggcatgtagatataaacatgtatagaacacaaacttgcatttgtctcaggaatcaggtagagaccatagtaaacatttttatcttggaaggagggcagagagctcatcatcatcaattcagaacctataatgattttacccaaacttctctaatatgatagggagcaacactttttcaccctgttcatagtacgaatgaaaggtgaattatcttggtctagtttgagttctgcttgctcacccctggaaggagaaagtgcataccatagagaagcgtggagattctttgctgggtaataggaaattggtcttcacagcagaaaataataattgcaacaaaagtactaacaaaaataataacaacaattagagcaacaataaaaactacagcattgacatactgattgctcataatatgccaggcactggataagcgccctatttcactaccaaacataattcttccaataatcagcagtaaccttatgcatcccacttacagatgaagaaatgagacaaaggaagttcacacagctaccaaaattgggaaccaggaattaacctcaggcagtgtgactgcacagccagggcccttccaaacaattggttaactaacctgggtcttttgctggccaatgtatcggggaataatcctagccaacaaattcaagggaaacggaatcaagcaaatatgaatgaacttcatttactgaaaacaaagtaggctttgataggactgtgttaccatctctagacctaactatgattatgtcatttcttagtgcctcttgcggcaaagaaagtgcactttacataaaaaaacaatagaatgcatctggcagaagtatgagaagagtaacgatcatggtgatggtggtgatgatgatgatgatgacagcttcaagagcagcagggtaaggatgccactaaaatcaccaccatttatgtgccaggcattatgatacagtcattacatataacctttttctcccactatattgcatgctgcttcacttaccttgtaaaacattttagacataaaaggtgctccatttttttgcacaaatgaacaaatacatgaaataaaagtatgttgaaggcacagaaaaagtattcataaaagacaaactcaaaattcccaatgacacagagagtataatcacaccacatatcaaatccaagccacatagcacagagtgtgctattgaaatgaaacgcaatataactattgctctgggaattacagatgggatccagtaaaagacactgtattaattatattgttttccatggaacttttctaaggttgcccaggacagcaacactgtagaacattcatgatgaaactgtcaaagaggactagacttgaggggccttagggagaaaagagatttgaaaataatgtactgcttgcccatggttcagacgtgcctttctctgcaagtatgatcacattattgattctcaaaggaagaaagaaaatatgactttgtcccttaactgacatcaaagttacagtgttatgcagtgatgcccaaaagcatttgcaaatattcagaaacaaagttttgagtgtcctaggagatgactatcataccaattgatccaaaacacaatggtcaagaggcatggaaaacctatggttggggagggagaggaagggtcataaatatatacagtcatgcaccacgtaatgacattttagtcaatttactggatatatgatggtggtcctataagattataatgtatctggaaaattcctattgcttagtgacatcctagctgtcttaatgacatagcacaagacattacttatgtgtttgcagtgatgctggtataaatgaacctgtgctgccagtcatataaaagtattgcatattaggtacagcaggggtccccaaccccctggctgcagatcagtgcccatctgtggcctgttagtacagtgggaggtgagcagtgggtgagtgagcattactgcctgagctctacctcctgtcagatcagagtcggtattagattctgatagaagcatgaaccctattgtgaattgcacatgcgagggatctaggttgcatgctccttatgagaatctaactaatgcctgaatatctgaggtaaaacagtttcattccaaaactgtccatcccccatgacccctgtctgttgaataattgtcttccatgaaaccagtccctggtgccaaaaaggttgggggctactgacgtaaagtacataatacttgataatgataatacgtggctatactggttgatgttgtattagtccattttcacaatgcaataaagatattaccagagactgggtactttatgaagagaagaggcttaattgactcacagttccacatggttggggaggcctcaggaaacttacaatcacggcagaaggcaaagagaaagcaaggtatgtctcccacagtggcaggagagaaagagagagaaaaccagcaggggagagtccggagacttatcaaataaccacatctcatgagaactccctcactatcatgagaacagcatgggggaaactgatccaatcacctctctccaggtctctccctcaacatctggggattacaattcaagaggagatttgaatggcaagacagccaaaccaaatcattccagtgctggtccctctcaaatctcatgtcctttgcacatttcaaaaggcaatcatgccttcccaacagttccccaaagtcttaactcattctagcattaacacaaaagttcacatccaaaatctcatctaagacaaggcaagtcccttccacttaggaacctgtaaactcaaaaacaagttagttacttacaagatacaatggggatatacaggcattgggtaaatgttcccattacaaatgagagaaattggccaaaactaaggggacacaggtcccatgcaaatccgaaacccagtgaggcagtcattaaatcttaaagctccaaaatgatctcctctgactccatggatcaaatccagggcatgctcatgcaggaagagggatcccagggccttgggcagctctacctctctgactctgcagggtacacccctctcccccaactccccaacggctgctttcacagctgtcgttgagtgtctttggcttttccaggtgcacagtgcaagctgttggtggatctaccattctggggtctagaggatggtggccctcttctcacagctccactaggcagtgccccagtggggactctgtgtggggactctgtttgggggtgccaaccccacatttcccctttgtactgccctagcagaggttttccatgagggctctgcccctgcagtagaattccgcctggacatccaggcatttccatacatccttttatatctaggtggaaattcccaaagagttccacaagactagagaaaaaagaatgaagaggagtgaacaaaacctccaagaaatatgggacttcataaaaagactgaatctacaactgattggagtacctgaaggggatgggaagaacggaaacaagctggaaaacacacttcaggatattatccaggagagcttccccaacctagcaagacagaccaacatgcaaattcagaaaattcagagaacaccactaagatactccagaagaagagcaaccccaagacacataatcatcagattctccaaggttgaaatgaaggaaagaatgttaagggcagccagagagaaaggccaggtcaccaacaaagggaatcccatgagactaacagtggacctctcagcagaaactctacatgccagaagagactgggggccaatattcagcattcttaaagagaagaattttcaacccagaatttcatatccagccaaactaaacttcataagcataagagaaataaaatcctttccagacaagcaaatgctgagggatttcatcaccaccaggcctgccttgcatgagattctgaaagaagcactaaataaggaaaggagaaacaagtaccagctgctgcaaaaacacaccaaaatataaagaacaatggcactatgaagaaattgcatcaaatagtatgcaaaataactagatagcatcatcatgacaggatcaaattcacacataacaatacgaaccttaaatgtaaatgggttaaatgcgccaattaaaagacacagactggcaaattggataaagagtcaagacccatcagtgtgctgtgttcaggagacccatctcacacacaaagacacaaatagactcaaaataaaggaatggaggaaaatttaccaagcaaatagaaagcaaaagaaagcagagcttgcagtcctagtctctgacaaaacaaactttaaaccaacaaagatcaaaaaagacaaagaaggttattacataatggtaaagggaacaattgaacaaggagagctaagtattctaaatatgtatgcaaccaatacagaagcactgagattcataaaacaagttcttacagacctacaaagagacttagactcccacacaataatagtgggagactttaacaccatactgttaatattagatcaacaagacagaaaattaatgaggatattcaggacataaactcagctctggagggctctggatcaagcggacctaatagacagctacagaactccctaccccaacgcaacagaatacacattcttctcagttccacgtggcattattctaaaatcgaccacataatttgaagtaaaacactcctcagcaaatgcaaaagaactgaaatcataacagtctctaggaccacagtgcaatcaaattagaactcatgattaagaaactcactcaaaaccacacaattacatggaaattgaacaacatgatcctgagtgaatcctgggtaaataatggaattaaggcggaaatcaagaagttctttgaaaccaatgagaacaaagagacaacatatcagaatctccgggacacagagtgtcccagtgttaagaggaaaatttgtagcactaaatgctcacatcagaaagctagaaagatctcaaatcaacaccctaacatcacaattaaaagagctagagaggcaagagaaaaaaatccaaaagccagcagaagacaagaaataactaagatcagagcagaactgaaggagatagagacacaaaaaaccctccaaaaataaaataaatgaagacaagagctggttttcttgaaaaaaataaaaaatagacagcaagctagattaataaagaagaaaagagagaagaatcaaatacacacaataaaaaaatgataatagggatatcaccactgacaccacagaaatacaaactaccataagtgaatactataaacacctctatgcaaacaaactagaaaatctagaagaaatggataaattctgggacacataccccctcccaagactaaaccaggaaggagttgaatccttgaacagaccaataataagttctgaaattgaggcagtaattaacagtctactgaccaaaaaaagcccaaggccacatggattcacagccaaattctaccagaggtacaaagaggaactggtgtcattccttctgaaactattccaaacagttgaaaagcagggactcctccctaagtcattttatgaagccagcatcaccctgatgccaaaaccaggaggagacacagtgaaaaaagaaactgtaggccaatatccctgatgagcatcaatgcgaaaatcctctgtaaaatactggcaaaccaaatctagcagcacatcaaaaaacttatccaccacgatcaagtcagcttcattcctgggattcaatggtggttcaacatacgcaactcaataaacgtaatctatcacataaacagaaccaaagacaaaaaccacatgattatctcaatagatgcagaaaaagcctttgataatattcaacatcccttcgtgttaaaaactgtcaataaagtaggttttgatgggacatatctcaaaataataagagctacttatgaaaaacccatagctaatatcatattgaatgggtaaaacctggaagcattctctttaaaaactgatacaaacaaggacaccctctctcaccactcctattcaacatagtattgaaagttctggccagggcaatcaggcaagagaaagaaataaagagtattcgcataggaagagaggaagttaaattgtctctgtttagagattacatgattttatttttagaaaaccccatcatctcagcccccaaactccttaaactgataagcaatttcagtaaagtctcaggatacaaaatcaatgtgcaaaaatcacaagcattcctttacaccaacaatagacaagcagagagccaaatcatgaatgaactcccattcacaattgctacaaagagaataaatacctaggaaaacagctaacaggggatgtgaaggacctcttcaaggagaactacaaaccactgctcaaggaaataagagaaaacaaattggacaaccttccatcctcatggatagaaggaatcagtatcatgaaaatggccatactgcccaaagtaatttacagattcaatgttattctcaaactactattgacatccctcacaaaattagaaaacactactttaaatttcatatggaatctatgaagacctctgtatagccaagacaatcctaagcaaaaagaataaagctggaggtatcaggctacctggcttcaaactatactacaaggctacagtaaccaaaacagcatggtactggtatcaaaacagagatatagaccaatggaacagaacagaggcctcagaaataaaaccactcatctataaccatctgatcttcaacaaacctgacaaaaacaagcaatggggaaaggatttcttattcaataaatggttctgggaaaactggctagccatatgcagaaaactgaaactggaccccttccttacaccttatacaaaaattaactcaagatggattaaagacttaaatgtaaaacccaaaactataaaaaccgtagaacaaaacctaggcaataccattgggcaaagacttcatgacgaaaatgccaaaagcaattgcaacaaaggtcaaaattgacaaatgggatctaactaaactaaagagcttctgtacagctaaagaaactatcatcagagtgaacaggcaatctacagaatgggagaaaatttttgcaatctacgcatctgacaaatgtctaatatccagaacttacaaggaacttaaacaaatttacaagaaaaaaacaaccccatcaaaaagtgggcaaaggatatgaacagacatttcttaaaaggagacatttacataaccaacaaacatatgaaaaaaagctcaacatcactgatcatcagagaaatgcaaatcaaaaccataatgagataccatctgaagtcagtcagaatggtgagtactgaaaaaccaagaaacaacagatgctggtgaggctgtggagaaattagaatgcttttacactgttggtgggaatgtaaattaattcaacctctgtgggaagacagtatagtgattcctcaaggatctagaacagaaataccacttgacccagcaatcccattaccaggtatatgcccaaaagaatataaatcattctactataaagacacatgcacacttatgtttagtgcagcgtcatttacaatagcaaagactcagaaccaactcaaatgcccatcaatgatagactggataaagaaaacgtggtgcatatacaccatggaatactatgcagacatataaaggaatgagatcatgtcctttgcagggacatggaagaagctggaagccatcatcctcagcaaactaacaaagaacagaaaaccaaacaccacatgttctcactcataagtgggagctgaacaatgagaatacatggacacagggaggggaacaacacacaccaaggcctgttgggggtggggggcaaggggagggaacttagacaacaggtcaataggtgcagcaaaccaccatggcacacgtatacctatgtaacaaacctgcatgttctgcacgtgtatcctggaatctaaagtaaaattttttttaaataaagaaatggacaactctctagaatcaaacaccttgaaattccttgaataattaaggacccacggattgttcatcttttcatatacagaccccaacctataattactaattactaattgcagtgagatcagagaaaaaataaatgaaaagtctactttggagtcaaagatatggttatttcaaagaacagtttccctatcaatagtcatttgtctaagactatattgatcagcatgaagtggcacattatagaagacacttctgcacacctgttacagaaaagcctcctcacaatgcctatttctactaactaatctatgctgtccactctaataggaactgaaaaagacaccatttcctcaatttgatagaggatacagtaaatatttacacaacacttaaaatgagagagtatataaacaataatagaaaacaggtaattcagggctagaatttccaataaaaaattttattttgtttttgttttttaattagaggaagagaaagatcaagccatatgtcagatgtacttcattcttttttcacaaaagcattatctagtcataaaatagaggatcacaaaaagagctgaactgatcataaaaagtctgtatttcctgtgcactacaaacaaccataatcccttgaacaattccccaaagctcctaacatcaaacattaatcagtcagtttaggatccatcagcaaatttaggatacctccaaaggggcctgacaggttaggcaaagaaagcattgcataccatcagttctttcactgatagctaaagatctataggtcagagaagggcaggctctgatgtctcctccattaattattgaaggtaatattccagatgctagtaaatcttaataacttcaaatatcagcttcaaagatgtacttttgatgaacaaagccaaaacacttctccttatcaaaaagacatgttataatgcatattttatctttcaacggatatcctctcaccaataaacgtgatctttgatccaaaaattcttagtaatgccactaaaatttctcaaaacaaagtcagtttaaacgtgcttcagttaaaaccactgccctattgctctaaaagaaacattacaaaatgcaactacagactgtcaatttttcaacaactttgggagtgactgtttagacactgtcaaatgatttctaagcaaccctgccacaagcagactggcttgctataaacacaaggtgtaggatacataagaactaatatttgttaaggaatttctgtgtgccagactcttggctgatctctttgggtttgattgaatcgaatagtcatcacaatctgcagaaaggtttggtgacttgatcgcaagaacctggctagtaagggactgagtaagagacttcactaggcaagttaaagtgctgctctacactcccattgctgtctctgtacccagcacgtgggcacaaatgtaagagcctcgtgaaggaaagcataagcaagaacacactgagcagctctaggaagctccttaaggtagaatgagaaacttactcaggcaggctcctgcagttgcacaattatcattcttcttaagtgtgattactgctcaaagtcagaaacatcaaatgtggaaatattatccaagtaggggatccatccatgaaagcaacaattgagagacttctacattctgctctacgacacctggaaggctcatctccgaagtcacattctttcaagatggtttgaacaaaatgcagatctttggtgcagcaattaataggtacagttatgtatacttcaacaggctgaatgtaatctatcttgaacttgcctttcaattactccgtgcttggagcttcctgcagtgcctgactatctcaaagttgctaacgcagggaaataagcctatcagaaattcaaaacacttcatcatcacattttaatcatacaaaatagtaagtcctgagtttagctcattccttgacaagtcagagatgatgaagtctttaatgctcacctatttatacagcaatctttcctcctaattccgtctatcctattctgttatctcaaagatataaccaggtgacagagttcaagttcattaccaagagaatgtatttctccagccaaagcaaatagaatttcgatgaaacttctaagtacctgttataaatgccaagtattaaaggttctttattcagctatttacaagaccatctgtgaagccaacattctgtgatccaaatgcagatgttctatgaaggaaggcaaggctaaaaaagaaaatcctgacaaggcccgtgcagctacttaaagcataaagggaagtgcaatggtcttacgatttaaatataaacctttgttaaatgatgaggaaaccacagcagcagggacctgctaaacaatcactcgactcctgtgattgagctaaaagattatatttgagatgctcggtccatcgacatatttactgagcccctgttatgttcctagtgtgttccaggcaccatagcattattgtaggcctggctcatgtatgctgtgatttggtgtttaccttcgattctgaagtttagaaaacctcttaacagggcttcaagatacttttctcttgtatctgattccaagtaaccctgtatttactcaaccaacagtcactgtaggactattcagaagtcatgttaagtaaaaggtgggttacctagaagctgacagtgtcactggagcggggtcttgaggatctagacattggttctgtggttgcttagaaaggtctgggggccatgagggagggcctatgacagcagggtaggggatattctcagagcaatagctatgtacaatagaaatatttcaatcttttaattaccagtgtgactaaacagaacctcagcagtcctatgttgcctagtatacataaatatttaagtccaagccctatattcaggcagctctccagctaaataatatgctatagaattatctaactttctctatcaagttcaatagattgagagaaagaccagttatctaacagccagaaggaaaatcaagataaaaacttggtgttaagtttttatgtaaaacatgaaactataatattttgctgaataatttcaatgactgcaaatgaacaaaatctattccaccttttggaatcccttttcagttttaattcatatattccacactttctgctacagagatttccatcatgggtcaaggattgaaccagatgatgtccaatgagttgggatttccaagagagaccatgagcagtgctaaaaagtagacattttgtcacaatatttaataaatagcattcattagaaaaatattatccccctttaagcaaatactattattatttctctctataatagaaacagagttctaacataatagtacctattcgttttactcagaggcatcaatcctaattggaaatttttaaaaatccagctcaagttgcaattcacagaggtggcaaatctcctttagagggcacagaaatgtacatatgatctcattttaaaatgtgtgtgtatactttttatttctgagaaagcaacaaaatcctggcttccaataatgtccaacttaatggagcataacttaaactccttttaacaaagtttaaatttttaaaagcccactgaattaaagacatcatgactaagaccaagctggagtgctctagaatctagcttacaactgtttggcctaaggagcctatagcattgaccctgcatacattaaagccacctgtgctcaagtccacttatcactcacacctgcttacaccatgctactgctcactacaataccaataagaacatctgcctgctttagataaagattctctgcacatctaaattagaataacaagtttttgaactattattgcaaaagaaacagcagtcaatgtggtaatttttggggatctctgcctaggtttcattaggctcaccctaatgtctttttcagttttggcaggagggcctgtgcctgttttcatagccaaaagactgccatactcacaaatggccaaaaagtatgaagaaatccttcaagtttcccaggcactgaacaggaggctccaaaccaagtcatctgcttggagtttttattactccaagttctgttataaactgtacctcagtgctcttcatgtacgacatgacaggcaggaaatcatccttacagctttcacatttaacaaggctacttttgaccaaaatgagcaatgaatttcaaaatacagggacatggcaaagtgctgtaactcggaattaaacaaatcaacaccaagaaacaatattctactagcaattcggtaatcacaggcaaagatgataaatatccataatgtttttataagccacaaacatggtttaatctaatcttacactgtttgtgtttataaagccaagacaagggtgatcatctaatattttcataacatctagtagaaggtagttaaaaagatgttacattagacatcgttactgcttcaaaataaactctcaccttagttaacaaaatgtgttatgggttctgtgcacatctgttataggtaccacagagacactatagctactgaactcgtatgtgtgctagacattccattttgctttttaaaaaatatataacaacctattatttatttaccataattatctccattttacaaaagtgagaaggcttaaatttattttccccaatccaaaactgtaactactccagcccaggtgtctcttttaaacctcttgctccgtctccacagacttcaacatggaggaaattcaggggataaactatatccaaagcagcctcaaagattcaggcagtaatttcattatcatgtcttacttgatttgtaccaaaaaaaaaaaaaaaagattagatttcagtttcacgtcttctgtctcttactaattcaggtactaaaaacagttggtatttactgagtgcttattttgctctaagcccttcacatgatttaacaaattcccaaaacaaccctacagggtagatagtagcatcatgctactttgcaggtgaggatacaggtataaagatgttaagtaacttgcacaggtagccaatttgggcccctaactaaggcagtctggtcgatgctttgacctttgtgctacctttcctctacctctgaagacaaaaggtaattgcaaaataaaagtatgatatgctgagaagcaaataaactagatctggtaacccaaaaagtatatgttgcactcaagccctccttgcagtaccaaacccacaaaaccaaatggtgctgagttgtgcattagaaacaggttaaaagacctattaaataagctcagatctgaaaggtaaacaataagctactgaaatatgatttttattaagcaatagcaaacaagtctatttacatttcaagaaagaaatggcaataattcattagcaagacaaaatagagtcaaccaaaccgatgtagtttctctctccacacacccactcccttacacacatactagcagccctatgaaaaacagggttataatagaaatgctgacacaaccaaccttataatgtttcatacgaaaagctacaattatattttctaattgtaaactgggtgaaaaaaaaaaggccaaccagaacaaaaacataataactacctagaaacagtccatcagaattcttggattatgaaaaatgcatataaaacactattatcttcagccacagccagaagatgtcagacaatcaattcatataacatgccagcttaataaaatctgcatacaaaatttatgaatgcagtaatattcctttatatcacaagttattaatggtcaatttaatgaacatctacagctggagtgctttcgttctgtatgatattttaatcatttttagccatggatttaaacgcatttcattttataaccatcagctagtgaagataagaaaacctttacacaaataactgaaatatttggggtaggccaccaattttgtctttatgttgttatttatttccttaaatttttttttacaacagaaacacaatgaaatgttccattataacaatatttgatttaatatttgtatttagaatatgaaaagtttgcttaaagtagcattacatgtttggctagcataaaatcttccatttcatttcaaataaagaactttctaacctcgtttatgtgaaacaatctcgctcagagctattatcctccaaaaactatcctggtggaatgttgacatctcggacataaatattcttgaaaattaatgtgttgtatttcttaagtatcctatttccactcacttgttcacataatctttaaaaatcctattgtgttcaagtctacttttcccacagattctttactaaaactaaattttactatatgatgcttatgtggaaggaacaggcaacataactgcaagacaacagtagctatctgaaaatacaaacattcagcatttaaaatattgatgtctttctgtggtcacaaagtcaaataattgtttctcacatttgagcattagaatttggtatttaaaattacactcatccttcagagttaattgaaagatttggatatataggaaaaaggttaagaaatctaggtcataaatacttcttaaggtgcaagaattggcttcataaactagtaaatgtgcaataatcactattaaagaatgaaagatggcattttttttttttttttgagatggagtctcactctgttgcccaggctggagtgcaatggtgtgatctcggctcactgcaaccgccacctcccaggttcaagcgattcgcctgcctcagtctcccaagtaattgagattacaggcgcccaccatcatgcctggctaatttttgtatttttagtagagacggggtttctccatgttggtcaggctggtcttgaactcctgacctcaggtgatccacccgcctctctcccaatgacagcaattttttagtttgactgtctatagccttataggacattacaggtgaaaatcagtaaaagccatgtgcacaaaagatttagtgcattcatgtgtctttattcattcactctatcttctgttgcttcactggttccttttgggcttcctactatgtgccagttaatctttatttgctctgggcgagtaactcccattcttaaagacctaataaaacaggacacagtacatgtatacccactaattataaaacagcgtagaattgatggataagtgccaaggagaaatacaaatcaagaattcagagaaaatggttcttacttgtcgagaaaagggcaagggaagactttataaaggtcaactggaatttagaggagtaaaagaaataagggtatttttgggtaaagggcacaacatgaaattgacttaaggacaatacacacaaggacaaaaagtgcctatgacgtgagttttaagtttaaaatacagactttcaacaatgcttaaatctgtagatggtaggcattttccaaattcctctaataagtagaatcagcctatatccaaggaagatcataactcattaaatttcattttaaccttcctgaatctgcctaaattttctcatcttatcaggcaagccaatatatgcttacactgtgaggttaaagaaatgaacctgtgaagagaacctgtcaaatcaaattatcaacaagcaatagtcccactattggggaatatataagctgcaatgtcaattttaaagaagtgtgcttacatttgcattttaattaggtcacaccttcaacatcatgatattaatttcagtttaatgctctattttattgccatttccaaaatgacatttttagacatggacataaagaaaaaaatctctacttttgttttgacaacccataaatattgcaaattgaaacaatgttgaacaaagttcaatatttggaatattcaaacgagagatacgactgtgtctaaaattctaaatacttagaattggatttcaaaaatattccaagggaaaattattagattctcatttaagagcataatggagtgttgaatggaacataaaattcaggttcctgtgagtcaccagaagctaaatatgaatagctcagaaaaaatcattttggttaagactttgcattagaattgagacatgctttgtagttttttcagatcaagagggaggtagacaaattacagaatgtatctttgtccattaataaatgacatatactcaaatacataaagttgtaataacattcacataacaaaattcatcaatcattttaaagtgtaaaattcagtggcattttgtacattcacaatgtcatgcaactttcaccatatctgtttccagaatgttttcatcatcccaaaagaaaactctgtggccattacagccattctacattccccactacccactcctaacccctggtaccactaatctgctacctctatgactttgccaattctggatatttcacataaattgtatcacataatatgcgacttttagtgtatagttttaatttttatttttgtaggtacatagttgtatatatttatggggtacatgacatgttttgatacagacatgcaatgtgtaataatcacatcatgtaaaatggggtatccatcccctcaagcatttatcctttgtgttacaaacaatcaaattatactcttagttatttcaaaatgtacaattaaatcattattgactacagtcactccgttgcgctatcaaatactaggtcttattcatgttttctatttttttgtactcattaaccatacccacacctccctgcccaccacctgtcaactatccttcccagcttctggtaatactccttctacttactacctctattagttgaattgtttcgatttttagatcctacaaataagtgagaacatacagtatttgtctttctaggcctgacttatttcacttcgcagaatgacctccagttccattcatgttgttgcaaatgacatgatctcattcttttttgtggataaatagtactccattgtgattaagtaccacattttttaaatccattcctctgccgatggacacttaggttgcttccaaatcttgactattgtgaacagtgctgcaacaaacacgggagcgcagatcgctctgtgatatactgacttcctttgggtatatatccaacagtgggatgtctggactgtgtgttagctctacttttagttttctgagtaacctccaaactgttctccttagtggctgtactaatttacattcccaccaacagggtacaagggttcccttttctctacatccccgccagcatttgttactgtctgtcttttggatataagccattttaactggagtgagatgatatctcgttgtagttctgatttgcatttctttgatgatgaaggatgttgagcaccttttcatatgcctgttagctatttttagtgtatggtttctttcataagcaaatgcttcaagtacattctaacaaatacattctctaattcttctttaagggaatactcttaaagaagaaatggtcaagtacttcatttcccaactgttttctatttttcttttcccaaaactattccaaaaagtttatggggctttgtgtttattgtttatgaggtaaacaaatatgagtttttactcccagatttttccaaattaaaaaggcagtgacaaatatccatttaaattaaaaatccaagccattattgacattggaacttgattctacatatgcattaaaaaaaagacctaacagggggaaacctacattgtgttcataactggggatatccaacagcatcagtatgtcaaatttccataaatgaatccatgtattcaatgccattcctttaaaaaatttcacggccttttcccacagaatttgacaagacggaaaaaaatcatttgaaagagtcaaggtaaagaacagccaaaatgtgattaaaagaaaggaatgcttgtctttctagacataaagatactctttaatcatagtaatcaaaggactgtatcattaaagctcaaagagaccaactgaactcagtggacaggcaagaaacagattcacacatttatgtcaagaccatggggaaagaatagaatggaacactgtttttccataggaagaaaagtagattcataatttatatcacatataaaagatatccagatgatatcaaggcacatatggaaaagaaaacattaatacattagaaaaatatgaaagtactgttatgatattaacactgggaatatattcttaaggtacagccaaaatgcatagaccaaaaggaaattattaaatttcattatactaaacattttagtatcaaaggcactatcccctgtcccgaccccatcacacatatggaaacccactaagattccaagcgagaaataaaaaaaagtcctgtgatggatatgatcacaaaggatttaaatctagaatatataaaaatactaattattgcaaaagaaaacaatgacccaatggaaaaaattggcaaagaatacacacaagcaattgacaaaaagggacacctgtttgcatccaggagcaaacgttttactccactggataattggagaaatgagaattaatccaataatgtggtaccatcttttacccaccagagtggcaaacacttaaaaagtgtgccaatgcaaacatcatgggaaacagatgttttcacccaatgctatggagtatcaactgacacaagcacttaattaggactatagaactgctctccaatgttggagaaatgtgtaccttacaacatggtgattccactgctaggtaaatattctacagagagactcaccagtacactaggaaacacatacaaagatattggttttacatcgtcttaactgagaaaaattagaaacaacctttaaaaaggaataggaaattaatttgtcttccactcagggactagaatacaatacaggaggtaaaaatgaaagaatgagggcttcatttattcatgtagctgtatctcaaaaacaatgccgagtaaaagaaactgattatgtacagcaggacacagtcaagaaaatattaaatacatcaaacaacatgatttcctttttagggatacagatgcacattaaaaacaaataaaaacaaaaaacaaaaaaaaacatgcaaacctaagcaggtagaaaacctaccaacttcaggtcagtaaacgcctctaaagcagttctcaaaagggggtaactttgcctcccacatgtggcaatatgtggagatattctttgttattcacaactaggagggggcatggtattgtatctggtcggtacaggtagagttgctgctaaacacttacagtgcacaggacagcccccacaagaaagtagttatctggtccaaaatggcaatggttacaaggttgagaaaggcagccctaaaaacagaggaaggagaataagatgacaggtggggaagatgaagtgtatctataacttttcattctaagaaaagatctgaagcatgtatgaaaatatgttaaattttttaagaaggactgccacattattctttgtacattcttatatttgaaatatctctttaatcagttcaaaaatataaaaatcattctgcaaacaaacacagttaatttctaaatttgatgaaaattacataattcttttattagcctatttctataaatatatctttggaaaaacaatattctcacactcacgatcaaacgtatttgcactttttttcagtgtttgttctacacagagctataaaaggaagactgtggaagaacccaggattcatccaggatcacaggatcatttcattattacagtttcaggcaagaacattctaaaaccagctcagagaaagctaattccgtcctttcctggttatatagcagatcataataattccaggcaattctctgaagaagctgatgatctagaacagtgggcttgcatcacacaccccatcatgcttccttaagtacatggcttaggatgctgatttctcccaacctcatgggtttcagtagttcctacaaacaactttgagatcaaccagtgcataattttattttttcctttagttccttagtgcagaggatggcaaactttttctgtaaagggcaagatagtaaatattttgggctttgcaggccatatggtctctgtcacagctactcatctgtgtcactgtaacacaaaaacagccatagaggatacataaaggaacaaatgtggctgtgttccaataaacctttagttacagaaacaggcagggagctagacttggctccaagccatagtttcgccaacaccaagatggacagcaaaaatgcaaccagtttaaatactattttaaatttaaggcatttcctccaatctttgaaagtaaagttttatgtatgttttaatcagtgtaaaaattttgtactaccaaaaatgaatttatataaatgaaacaattcaataaatgatgaaaatgttcatttgttacatttatagcatactaacttctttctggaagtatgttataccccctgatttactaaattattaattataattttactagtttaaattatgctattaatgattccttataagaaaataaacacacatattgtatcttcaactaagggttgggaacgacaaggacagtgaaattatactcccaacacaaataatagctttctattaggtttgctatttcacctgaataattccttataatcatgaataatgatgttattcgacaacctaatgatatcatggtgtgtagcttcaatccatctgtctttgtcaagaaggtcaaatatttgtactccactgcactaggcaaagttgaacaaacagttaaacaacatcacacaccttaattactccttcaaatgaaaccagcaactaccattttacctgattctaggacctgtgaaataaaaacctacttcaaagatatttaatctgtatacacttttacaccaaatttaagctcaacttaaaaaaaaaataaaagtggttaaactcaagaaaaagccccaagattttctaagggtattgttaattggttgttgctgtaaaatgttttgtgaataacaaaatattccaggaacttttaacaaagatctggaatacttcatgtgttatcttgacattggcttaaaggtaagaataaagcaatagcgtgatagatgtgaactatagttcctataaatgcttcatagtgtttgctttgcttcgagattccatgagtgaccaaggagttgaaggggataaaaactccccattcactgtttctacagagcctctacaagacctggacccttggggctgggggatggtgaatatagcaaggtatgatgtgggcatacttaaatgatttgcagcaaaataatgtttatattaaaaatcctgttttccttccttccacccttctgctttttcttaaatctcaccaaagctttattgctgcacaaaaatgaagtccttagaaggccttattaatctggttccagactcctagcatcttcccacttcctcaccatgcttcacccccacaggtcttcgtgtttttgaaacggagtctcgctctgtcgcccaggctggagggcagtggcgagatctcggctcactttaagctcctcctcccgggttcacgcgactctcctgcctcagcctcccgagtagctgggactataagtgcccgccaccgcacccggctaatattttgtatctttagtagagacggggtttcaccgtggccttgatctcctgacctcgtgatccgcccgcctcggcctcccaaagtcctgggattacaggcatgagccaccgcgcccggcctctctgtgtttttttaaacattattgagcatgcaaacttgtttctgcccctgagcctttgttcttgtttccttctacctggacttggctgcccattgtcccacaatgggctggtccctcctcgttagttcttacagcacgtgtcaccggcaaagagaagacttccctaccactctgtctcaagcagtccctcactctcaatcatactcttctttttattttattcagaatagaaaatcatgttgtttgtgatttatgggtttacatttatgggtttcatcttttatggtaaacctctgcacacaagaataaaagtaggatcgttatctgactattcattattgtatacctggggtctggcacatagcagaaactaattaaatgataaatttacatattcattcatttacaatagacaactctgtgtctaatttgaggtcagcaaatgacggccctagagccaaacctgcctgatacctatttttgtaaataaagttttattggaacacagccctgtttgcccgtttaccaattgatgatgttgctttcacactagaatggcctagtggtgtagttacaacagagaccacatggcccagaaaagatttacagaaaaagtttgctagctcctggtctactacacagtatatgttctcaaataaataaaataaagtacagtcattgcttttaaaggagttctggtccattgtgtgtttttattcaaacacttttagattaaaattctatggcccaaaagaaagctcctttaaaactgtaagcatcacctagcaagagttgtattggtgctgtggctgggcacggtggctcacgcctgtaatcccagcactttaggaggccaaggtgggtggatcatttgaggtcaggagtttgagaccagcctggtcaacatggtaaaaccccatctctactaaaaatacaaaaaaaattagtagggtgtggtggtgcacccctgtaatcctagctactagggaggctgaggcaggagaattgcttgaacccgggaggcagaggttgcagtgagccaagatcaccccactgcactccagcctgggtgacagagtgagcatccatctaaaaaaaaaaaaaaaaaaaaaaaaaattgtattggtgctctattcattaggtcagctggctgaaatcataaagaactaacacagtgcctggcccctggtaagtactatacaagccttgattggcttctttttggaagaaaacattatatccggtggctaacacagggcttggcacatattcggttggtgcaaaagtaactgcagttttcacaataaaagtaatggcaaaaacctcaattgcttttccatcccaacctaatagcaagtaacagtcaagatctgttgaactgaattgaagtgaacttgactctttcagccagagggactaacaggctaatctgtgaaattagtgggcaaaaaactgattcactcacctgagaacaagccattctgtaaaataggctgagaaaccatttctcaccaacatttttcagggatgacttgaagtaatatgatccaaggagccagatttcaatatacgtttaatgttttttgataactcgttgtaggtagccactatttatcttatttgagttacaaagatacataaacacaaaatttaaacagtaatttgagtcacagactcccagagttgcaatactatcccctgtaatactcagttctatagatattttttcttttaaaagatccaaactaacccacatttacgccagctcttccaattatgactaaccgatgcatattatttctccaaatcttgacggtctaagctaatgcctctcacagttgactcacagatggaagtcacaattatttgggagtggctggctttttgttttgagttccacttcctggctcctacgctcaacttttgaattcagaatccttagagtgagaaatcatggcagagtccggaatctccattttaacaaacaccctaggtgatgctcggtcctttagaaatctgttattttagatcaagagatcatatatccacattaagaaataccaagtagctatcaacttttggaaccactactttcctctattggaaatgtaacgaagtgatactgtgtgttttacttggagttattcatattactgtatattacgtgcatacacatgcatattacgcactcagtacttgtaggagtgaagtactcaaagaaaagctaaaatgtggcatctttgccatccaggcggttctttgataagcagcatacgcataaatgatgtaaacaaatgatacaatgacccatgactgagagaccgacgagtagacatgcaacaagatttcagagaaagaagcaatcaagggggtctaggttgtcagtgatgtgaaaaattgccttctttggatccagtagaggaggcaggaagtacaaaaagtgatagtagttatcacactctagaggtgtcccaggaccttgttcttctctcagttaagacctaagatcttagaacacaggaagagtaaagcaagaactatggccttctaagttattaatcccagcagcctgggaaagattactaaggctttgaaagctggccaaaagtcattgcatctcagtggtcatagaggaagacctgggccaccatgaactgaaccagtaagaagcccctgtctccaaggagctgtcctgaatgaccttgcacggcacagcattctctttatcttcctgtggcatcagtaataaaaatcattggctggtctcctcatttgacatctaatcaaacacttcactcggaagttacttttcttgcgggtttaggtcttaaccctccaaggatcctgcaaagttctagaggacagagtgtcagcaactcccccagtgcttagcacaataatgtcaggcatcataaaaagatcttgtttaatcatttgataattttttatttattgcctaccatgtaccagacattgtgttaagcactcaatagaacagacagctagatcctaaacccaatggcagtgacaaaaccgtctgtagtcatgagggctgacgacaacactatgactatagtaaaagccattaaaatcactttaaattggtgaattgcacggtgtgtgaagtatatatcaaaaatgctattataaaaaaatcaaaatggcagaaaggaagatggtcaagccttagaaattcacttggtgaaaggttagaaaaaacacatccagaacttagttactcctatttagatggtgactgtgacacattagtaatacttgatggtactgtagctgaatactgaatattaagaaaattggaatgcttctcagaagcaacaaaacaacgaaactacatttatgctgtattggttaagaacataggtgtcagaatcagaaaaacatgtgatcagttctaggttctcttccttagttgtgtgactttggtcaaactgcttacctatctgagcctcaatttcttcatcagtaaaataactttaaaatatagtaatgctcaataattcttagctagtaatcaaataatgcaaattagcataatacattctcacttataaaattagcatatattaggaaaattattactattcaatgagtagtagcaaaatgtttttccactttgcttttgggtacatgtgaaattttattgtatgtccactcattgagatctcaaacatttattatcataacatttacataatttatgtgtatgtaccttatccaagaaggcctatgatagcaaagatgctatgtctcagttttctttgaatacttcactcctacaattactgagtgtgtatgcatgtaatatacagtaatataaataactgataaatgtatgggcacatacattttatattggttgtggcatgacttctaatagtgaaagttatgaaacaaactaaatattcaaaaccaggtgaaataattatagttaatcatattgatgaaatattatgaaaccactgaaaatgaagttaatgaataagaaacattaactttaaacaataagaaaaaacttacggtattaggatcaaaagaaagggatatcatactatatgtagagtagtgttgtgttctagttttatctaaaactgttttggagaagatggaagaaaacaaaacattttaaaagattaacagggattatctctgggcagtaggattatgagtctttttacttcatacttttgtgcatgaaaaaaattaacagtattaaattcttgctcattttatttataataaatacatgcagtattgattttaagaaagagcaaataagccttattttacgtatcaccagattatatcacaaagtgacgttaattttactacacagataaatgaccacatagctcaaatgaccagaaaaaaagaattgtgaagtatattctctaaatataagcatccaaccatattgatagccaccaatgtcagtcacacttaaaaagattttttggccgggcagcgtgcctcacgcctgtaatcccagcactttgggcggccgaggcgggcagatcatgaggtcaggagatcgagaccatcctggccaacatggtgaaaccccgtctctactaaaaatacaaaaattagctgggcatggtggcacgcgcctgtaatcccagctactcgggaggctgaggcaggagaatcacttgaacctgggagttggaggttgcagtgagccaagatctccactgcactccagcctggcgacagaacgagaccccgtctcaaaaaaaaaaaaattttttttttggttcaacaaagctgcttagtaagtagtttaaagttatttattattctaacccaaatgtttcacatcacagtaatttgttaaatataattgtataacatagtaaaacgtgaactgccaaatacaatatattgattgaaggagtctcatgaagctttgagagcttcagcgatagtggacaggctgtattcaaccgcagctccaaaggagaaagtgattaacaaaataagaaaataattaattcaaaagaaaatatgctttagaaatatgtgattttttaattgtgagaaggataaaatgtttccttaaggtcatgtaactgttagctacacaggtagcctttctgcccggtagtaagcccaatgtggaaatgaaatttagtagtgatttaatttataattatttttcaaagtttgaggaataggaacaactacattatgttcaatagtctgaaagcacaaattctgacctttaagttcaaagtggaagtcaaactgctatacgtcagcatgacaacatcaagaaaaaccaacaggtcccaggggacaaggggaatacctgcttccctgcccactatcaccccaaaagttttgtcagaactattttggacatttgtcaaagatgtattttttttcctatttagatcatgagctgtaaaaacagaaaaaaacaaaataatgggcagaaatctatctgaaacccactactttttttccttcctttattttaatagataaaaggctaaaccaggtcatctacctaaacaagactggttccaggcctctgctatggctaagtagttaaggaaatgatttttgcaattaggatggtctcatttatattgggacttcactacttactaggtgggtgagtgtggacagcttacttccatacccctaggcttctttcagcatctgtgtaaagggccattaagtcagaattaaataagtggtagctgttattactaaatataaaagcctcatagaaaagatatgttagttattagaaagaaaattttccctaaaacttcttttaaaacatcttatgacaaagttacagaaatatttttaagccgtttgtaactaatacagacgcacattctctctcatatttacacttttcacctttgcttcccatctggaggagatcatcctccaaggtttcttccagcatattttatgataatcagactatgaattgggaatacatattatttgggctctgtttttgattgctatttttcatgtggtaaatcccagaaagctgcccaaatcccctgctgattatcttggccaagatgttgacaaactcttagatttctgctatcccattggcatccattggtattgcaatggcattctttcatccaacggacaaaacctctttccaaattctgacaacttctatattatcatcattcttctaatgttaataagcttgaatttggtaacattaaccccacagttaccaaatatggcctcctcatgccaacccacctctgctttttgtagaagaaactattaggccatttgtaaaagtctggtttgatgactcctcattttgtggcaatttcataaatatgaccaactttatcattagtcttattttctttcaattaatcaacaaagccatgagtaaaatgtgaaaatttaatagtcttttcccatgatttctcacagacaatataattgagctttccatgttattttacagttctttttatatggtaggcactaatgaaggagtccacaaacactggttacatagcacacatggttgatgtctatttttcacatggtactttgagggtggagggtaggtgggaagggatggatgtattccataggatctgtagcaacaagtataaagctaattttgtaaactgcaactcctgaacactggtgcctttggagaaattatttatcatatattatctatattacagagattgtgtttggcaaatccacggttttagagtcagtacacaaggcagataatcatttgtctgaaaatctcggacaagtgtgtttactatctatagtagatggcaccattttcttcacaaatatttattctcctcttctcctacatcgtgggaggagtatactactttgctttactgatttcaagatggtcatgtgatgtgctttggccaatggatcacaagtggatataacacacggccctcccaaaggaagctttaaacgtatgtgtgtggtctgggttggccttctaacctcctgccctctaccataggagcaaaatgttccagataggggctgcttcttcagcctgcgtaaatggaatgagaagacaatggagcagacccaaagccagctgagcccagccaagaccagcagagccacagctgacctgcagatttgtgaacaagaatgaatgatgttgttgtaaactaccaagattccaggttgttgccccataaaaactgacggatatactatccctaagtcttaattacttcatttaataaattgtgatttagtgtgtgtaaaacatagtgctgaagttactatagtgaaaaaaaagcatatactgcccctgctctcatagtctagaggaagaaaatggaaattgcaccatcattctagcacatgtgaattacaaacaagtaaatgctatcaaggaaagaaatgtggttccattagaacatataataaaggaaagtggccaagactgaggtttcaaaagagcccttctagaagaagggatacgtgagttggcattggtagaatgaacaggagttagcaaggtaaaaagacaatgcaaaaacattccagtcaagagagaaacaacatgcaaaggcctatggctaaaggaaacacgatttggtggaggaatgaaagaggctagtatggctgggcatgaaagaaagagggaggcctggcatgtggtgagattagagagaaagactgaagcaagaccagaggcctttaaaggccatgttttaaaagctagggtctttatcctatgtacgaaaggaagctagcaaaggttttttgttttgttttgtttcattttgtttttttacaacaacaacagcagcaacaacaaaacttgtattttaagctcaggggtacgagggtaggttagttacataggtaaactcgtgtcatggcggtttgttgtacagattatttcatcacccaggtattaagtctagtacccgttagttatttttcctgatcctctccctccttccatcttccaccctctgataagccccagtatacattgtttcctcggcccatatgtccttgtgttctcatcatttaactcccacttataagtgagaacatgtggtatttgctttcctgttcctgcattagtttgctaaagacaatggcctccagctccatccatgtccttgtaaaggacatgatttcattctttttatggctgcatagtattccatggtgtatatgtacaacattttctttatccagtctaccactgatgagcatttaggttgattctatatctttgctattgtgaatagtgcttcggtgaacatatgcatgcatgtgtctttatagcagaatgacaaaggtttttcaatggggataaagtaaggagttcttcatcagtttgtgtttgataaagctctgactgctagctacatggagaatgtattgcagggaatgtagagtgaagacaataaataagctgagtgaggaatgctggtggcttggattagggcactggcattagaaattagagaaatagatagatttgtgaaatttaggaagtaaaaccagcaagatcagcactgtgaatacagtattgcatgttagaaaaagaaggatgttctatagtactactatccatgaagcgatagatcttacaataaagaaggaatctaagaaataatgtctctggattatgaatttgacttaatttatcaattaggtttgactacttgaaaataacccataatggtaggtaatttcaactccctgccaccacagttacaggtggaaactgttattactgaataatggtgtgagcataaatgatgtttgtcaaacttgtgaatcttaggaaaactctttggacaagtgagtgaatattaatttagacttcattggagagttcaagttttttctctttccatataatctatgtcatctttttggaaaaggtgaaaacaaaaaaatagataatacaaagtacttcaaaatgccaaagactaccctctgagctagcttgaattctattccttctatttatttggatcaattcttatccaaatctgtgagatttgtatattatgagggtgttttctttgacatcttaaagttcaaagatgtgtttcaacaatctttagagtaggtacttatggcatcacagcttagcttctcaaaaagccaattataagacacagctgttaccatgccaaattcctatatatttggttttaaaaaaaactaattctacacctggctgatgaagtaaagacgaacgtgatagtataaatgtacagacacaaatcactgctttaagattccctctctagacccacatagtacatatctgtggtgtctaccagctaagcttctcttcctatattcccacccaaattcttttggggtacctgcaactcccccattgcaagcagtcctggtaggctatcaaataaaacaccttatctaccaagcaagagatccaggacaggccaaacagatggcgtgctccaggaatgtgactcttggcgattccaaatgataccaggacatgtatggttggagctacatcacttcaatggcagcatcctgaggagactgtcattaccgcaaccaggatacccagagctgccccaacttctattatttctgaggcctgtttgtgcttagctttcaaatttcagtctatgacctgcttcccatagctttccaatcttgtgtactattacataagtagaagctgattctcagataagacaagttgtccaaaatcacacagataataaatagatgaattaggattcacatctctgttagactgaatccacattcataatcttaataaattcattatactgttcctatgatcacatctcaaatggaatttgtaaaaagcccagtaacatttgtttattgccttagcctaccacttagaaattacaatgaaatgttaactatatctgctattttgctattcgcaagtgacagatgacttggaaagcatgtccactttagtcctctaagcacatttacattttcatattgccttcacatgacatttctgtggctacacttgcaatccagactagtctttcatcctctgttgacaatgatctgtttcattttcagagaaaactacccaataagtctctttaacgttatggatatagtctttctaaggaataggaagaaaatattttttcattgtcttacagtttttttgtttcaatgaatacatcacgtacctggtaaagaaaccttgctaccgtctcaacctttgccaacattatcattcacagagattccaatgagtgatacaaaccctagcagcttcagcctacagcttggtgaggttgactacaaagagcgcccatcccagagttactagtactcttattttgccatctttatttttgtctctggaaaatgaataaaatgtcagcttcagtagcaacatactgtggaattcataaaacaaaggtcaggtatgaagaacacaggaaaccaatggtagcaaaaggaaacccaatgcctgagctggccatcttggcgagtggggaaaactagaacagcactgaaaaccaagcatagttaagccaggattgatgggtaacagctgcactttgcaattcacctgcaattcagatccaatttcacatattctgcaagcccaaaaaaggccaattattgttaagtttctataagagtttaaacggccatgattcatttttgttttcctttaggaattttaggaccccctaagaagtattctctcttctacatatcatttctaggccttgaatttgaatggagcatctgctgagtataatggacctatttggccttttatctcattttttgtgaagctagtcaaatatgtatccttccactagggtcagcatcgactagatggactaggaagaatttcattagaaaatgagatctcatgggagacgataaagaccaggcttccaagacagagatgtgagttcaagtctctggtatttactagctgaagggctgtgggcaatcatgttaccttcttgaacctgctcccccacctccccccacacacacaatatagaaatacctaatttgtacaattacgaatccaaaatattaaatttaaatttaaggttttagcacaatggcacataggaatgactatagtgccattattaaaaatccagtaagtgcatttatgcaccatataatgtagtatatgttgtaaattcaatagtacataatagaatcatagtctctaacctcggaggtcttacatctaatgttaatgacaaaccaagaataaattccagtaagggggtgaaaagtgttctgatgatgggggaaatgcaggtaataatgagtagctattttattattaaaaacgtaaaacacatgtacagcagagtggtcaagaatctaaactctatcatcagaatgcctaggtgtgagtctcatgtctgcccattactttcagtgagactttgcataaggttatccatcagtgaaattaaaatgataatattaactatcttaaagggttttcacaaggattaacagagaaaatatgtatcgtactgagaatggtgctggagatatactaatccttcaataaatattacctataattaccaccattatgccaattccatcagtactgagctatacagaaatggtcgacacccttcagaatgtctccttctacacagacaaacatcgctttatgtgttttaagacaatcaagctataactagagaaaaatctaaggtatctctaaagacactttcaactcagaccatttatctttaatcaaaaatttggaaattttgatgttaaaattctgaaattattttgagggtactatagggtcttagaataaatagaagagaaaaataaacataaaatgagaggaagcacccccatagtgctggattttaatggaggtatcagcatcaatccatgatttaaaatatatgtatacatattttccagtcctttctaacagaagggcctagaaacaatgtcacctgagtagccatgagcacacttaatgcccagatcttggtttctaattatcttctatttaaatgaaccatatagctaattccagatctgaagcagggaaagtatgttatgccaggaaatgaggacagcttatagataaatagggttatctcaaaagggcagagacatctgaataaagggacttctgctgtcaaattgggcaaatttaatcaaaatgatataataaatggattctaacaccttgaattaaaagtgatctcagtttactagatgagagagaaacagcaacagacaaaaaggggctaaaaaaattgaggagaggtaaagttcttccttacagaataatgtctgtaaatatatgttgaaagaacgacaaaaatagaaagctaacatcttatatatcccatattataaatgactcaagccagaatcaccaacaaatgctaaaacaaacaattaggggaaatcttattgtggaacaagacatgtctattaattcaagtcacagcaaacctaggaaaagattgactgatatgtagccatggtaataagtagcatcctgaatcagattaaagtctatttaattggcactttctagtcaaccaatcagtaacagccctttattgctaaaagacagccagtcagcaacagactcatacatctctaagtgccaattaagcaacctgccccactcctcacctgaatcaacatgtttccacatatgtcagcttacttacttctgaaaatctacttaactccatactttccactttggtctactcagactgaactcgaccagcatagttctcctttacaataaattcagctttgtctttgaatttcagatgaatggtgaactgcattatcaccccactatataataattaaaaagaaaaaaactgtgtcttttacagtggggtaatctggcagtcatcaactaaccaaatggtgaaacttggcattgtcattagtgatgccaatagcctgacaggatgtactgatgcagaggcaaggggacaacataacctatttggtgtccttgccaaaaatggtttaaatgaaccgaatcaggagaaaacaatgagatggatcaagatagtaggctgttgcatgggccatatggcttggaatcttcaaataatttaatgtcatgaatatccaagggagttagacaattgatatatattttaaaatatttaataaccaaatgcaatttattaatttatgaataaccaaaagcaatttaggaaccttgactggatctgtgtcatggaggaaaaaaagccaactgagaaagcaaattgagaaaatctgaatatggaaaatatgatattactgaactaatgtgaattttcttgggtgcagtaaatggggttagttgtgtaggaatgtttccttattcttggaaaatgcaagctgaattatttaggagtaaagcatcctaacatctgcagcagactactgtttgttagagggtttggcacaaaggaagtgtctacagagacacggcacagatatatcaagatgtcaaagttaatgaatctcaatgagagataaacaggtgatcactgaactgttctttcaactttactgaggttgaaatttttacattctatttacttttattctgaatcttatatacacagaccacccatggaatttcccaggtatttttcttcagcctcaatttctcacttacagtaaaaataaatgtgttgtactctgtttttgtaagtcagctcaaaactttattggcagaaacagtggtccaaataagcaaagttcaaaacatttaataataattttcccctacataaaaaaggcaaatatttttcagttaaggataacaaagataagattccctttggagtttaaaatcctccaatctttcagctttgtccatgtcattatcctcagcaaacacacacaggaacagaaaaccaaacaccacatgttctcacttacaagagggagctgaacaatgagaacacatggacacagggaacaatacacactggtgatatggacaggaagcaggagggaagggtccctggtgagggttctactctcaagcctggacccatggccttaaatgagaataggcatgcttgtttttgtgcccagatgttgccttttccaaaaccactctgacctgccctgcaccctatcctgtgcccataagaaccccaaaccccacgctccatgagcagaagagcagcagagcggcagagcagagaacaggagagaagaggagagaagtgtctgaacgtggagaggacaagaggcagctggacatcggagactaggttggggagaagtttggccagggacagccttactccaagggaagattatcttcccactccattccctttccagctccccatcctgctgagatccactttcatcacccaataaaatcctctgcacacactacccttcaatccatttgtgtgacctgattcttcctggatgccagacaagaattcaggaggcactgggtgtggaaacccaaaaaggctgtcacactgactcttcactgagctggctaacacttaagctgtctgtggatggcaaggctaaaagagcattgtaacacacttggacgctgccatggggcatgcacagggcctgcttctgctggagagaagcagccagcagttccagtgttccttcactccggttcccacacccgtttccttgcacgctccctcccgtggggagtggccagcagtgggctgagtaaaactagcagcttcagttcctgccagcgaagtggtcaagggagctcccgtttcactggggcctgtcgaggaggtggggagaaggagagcatcaggttaaatagctaatgcatgcagggcttaacaccaggtgacgggttggtagatgcagcaaccaccatggcacatgttgacctatgtaacaaacccacacatgctgcacatgtatcccagaacttaaagttttaaaagataataaaaacaagagttataagtggtggaacaacaacaacgacaaaaatcctccagtgtttatcataagccattttgcctccaatgtcagtaagacaacctagaagtctctgagaggagagaaatctttccagatccatcaggagacacagaagtcacatgaaagcgttcctacagacacatgaaaatgctaagggtatctttggacactgaggactctcccaccaacagccacactgacaacagcctttggtgtctcactcagaggagtccctggtgggaagccaggctgtaatctgtcacaagagcatgtgagcagaggccaccttactagataaaatgcagctggttaccgcattccctggagggacagtgacctccgacagacaaggtgaggcaggcagacaaaacagtgggcaccgcaaatgaacaggcaggcgcggagtggtgcctggaggaaagcctctgacctggagccgagggagagctgctagataaacaagccattataagagggtaatattccatcctagtgtgagcggaagctgggaagaaaaccaactgtaggcctgatgtggactgcagctggcaggaaggctgcagagctcggttcaaggcaggagatcctgcccctgtccctggcacagaacacaaacagcaccactggatgtggtgggaggaggaggaaggaaaatctatacatttacgggacgtgaaatgcaagaaattgagggaattcgtccaggaaggaggaatgacaccattaatatcagtatttatgggcttacaagaagataaatgcatttcaagagtagcctcaccccaaagagaactaaccacacaattaagatcaaggctactgtcatagacctggctctgctttgaaaaacaagctacaaagggaagtttgggctttaatttaaaaaaaaaaaaaaaatgttcacggaaataagagaaactttaagaaaacttgtagaacacaaaaatcacattagactcttctataattctcataacaatagaaacttaacaataatggagcttatatttgaatgcttcatatggacgagagagagtttaagcattttgcatatattaactcacatgatcctcacaacaattccgctgggtagatactattaccgcccatttgaagcataaggtaactgaaggaaatctaggttaagtaattcccagggcttgctcttgtaagacaactgagcttggattcacatccaggccctcagctgcaaagcttatattcctcagcccatgaatactgcctctgggtatgcaaaaatcacctttgccttcaggaaataaggctcacatttttaagtgaacactcaagttgatatagtggggaaggcggggaaggcagggaaatctggagctgagacaaaggagtggggaaacatactatgggttcagaggacctatccacaaacctgttggtctctgtacctcttcacgctgttgaaaaattgactacaccgaagagcttgaatttatgtgactatatttgctgatatttaattccaagttagaactaagaaaattctaaaatatttattcatttacttaaaataataaacccatatgttaatgtaatattttaataatattttctaaaacaaaaaaactagtgtgaagagtgacaaatctctaatgaatggcttgatagaagataattgcatccttatttctgcttctgtatgcaatctatcatgagatgtcttcgctaaagcataggaagaagttggcctcatatagacatatagttggaaaaggaactacttcacaaattctgcaaaggtcttggggaccttccggggccccaggaccactggtctagagaaaggactctagagttagaccacctggatttgaaacctggctctgccacttaatagctgtttggtctagatcgatttagctcatattatctcattctctcatctataaaatggagataccaacagtacccacctgataggtttgctcatgagtgctaaattaatatttatcaaatgcctagaacaatctcagagcataaatattatatgttagatgaataaataaaatgacctggctttgcaagaagcatctccgccagagtaacgtctctgtactgaattgtacattctgacagctgagacaatgacagggatcacttgagcgaaagtgatcaattacacccatgttataatagggataattataataggagcttcagtaaattgagaaatcaattgagatacaaacttcgacttcatgggagctaagaaaacataatcatttgaatctctactcctctgaggatggatagcaacatcctttcaaaaccctttcatgttcaaagtcacatcagacaggggaaattctttaatgtaatttctgttgcattttggctataaaaacatgtcgagaagttgttaagctgacaaattccaaggtatctcttaatgacaaaaagtgggtgaatagttataaaggctcaagagttaatgttattttagggttaagttaaatatatttttacctgtgcaaatttttatctatttcatttttaaaaattgataaaggtcattcaggaggtgatttgagaacacacaacttgttgtagatatctttcttatttatattattgccatatatgatgcaatacatgtaaaattcttccatcccatcctactatacctttcacatattctttgacattttattccctccatcaaatatgagttgtcttttagatagcatcggaatcataggatactaagtagctacttcctctgtctctctacacccacctccctaaaactacaggcggctgacccactgatattactatgaattttttgctcttcatcaacggtcaaagggtggtcttcagtccaatggcctggttaactgggaattgccatatatggcttatcatttttaagaaattacaatattgcagaaagcattttatatgaaaattatattaaacataatctagaatgtaaaacagcaccataacgtcatattgaatatagtacatttcatgactcagaagacacattatagttgtgccacaatccccaagatctgtcttttcaatattacccctatgcaggaaacatgtgaaactagcaattaatagtataaagaccaacttaggagttctgtaaagaagttagttagaatgtgaaaacaccgctgtgcttctagaaccatactgcccggttcatcatgacactcctggtctctccatttataaacttggaaataccattctttaccttcttcaagggtggccaggaagatacagtgaatttttaaagcatgcctatgaagttccatgaacttgttggtgatagtggactagcaaaataaaaattagaagaaagaaaactcattcaaaaaaaatcacaagaaaatacgcacaaatatttaatctcaggatagattttgcataaaagaacaggaaaaactcataaatgaccaagttgacaaaactatgacaaaatttctacatgttaataacatcttaaagaaactgaagaggctagggccaaaaaaggaacaatatttgcaacaaatgtgacaggtagagggttaattcgtaaaagatctctaacatattgggtttttaaaaatatcccaatagaaaaagaagcaaagcaccttcataggtaacttattgataaaggtaatgtatatatatgtttaaaagttaactccactagcaattagataataaaatgtaaacagtgagatatgtaaaatctatcaacttggaaaaggttaggccaaaacaaaaaacctaattcttgaagtttatgagatgtgtacccccatgcagtgctagtatacaataacttccgaatgttcatccatttaaacaccacataatattatagcaagtagtgattccagtttaagaaatttagcagaaacattaccaaagatcctgtaccaaaatatttgttacacatatgtcgaaaagtcagtaataactaataaattatagtagatccatatggcacaatattataccatcgttaaaaatttcatttatatgcaggctgggtgcgctggctcatgcctgtaatccaagcactatgggaggcagaggcaggcagattgcttgaggccaggagtttgagaccagcctggccaacatggggaaacttcgtctctactaaaaatacaaaaattagctgggcatggtggcctgtaatcccagctactcaagaggctgaggcaggagaattgcttgaacccaggaggtggaggttgcagtgagcaccgaggtggcaccaatgcactctagcctggacaacagagtgagactgtctaaaaaacaattattttttacatacatattaaaacgtcagaaaaatgtcaacaatgaagtaggttaaaatcatgttataaagtgtttctctttttcaagagaaacatgtaagaacaaagaaaaaagtagaaaggaataaactgcagttttggcaaaggttatttctggaaaataagattatagatggtttttattttgtacagtgggcagatattcttatgattagaaaaaataaatgaaaggtttaaaaatgggttacacttgatataaactagactgcagcttcatagatataatttaaacaaaacgtttatttagtcaagcaattcattagctggttactggtagactgcattaaaaacaccaaatagtttgaatatatttacagttggcccttgaacaattaaggggcaagtgatcctgtaccactccccatctgcatagttgaaaattcacatgtaacttaacttcccaaaacttaactactagtagactattgttgactggaagccttaccaataaacacttgattaacaaatattttgtttatgtattatgtattgtattcttaaagtaaactagagaaaatattaatattaagaaaaccataaggaagagaaaagacatttacagtattatactatatgtattgataccatagcttgacatcatctatttacaagatgaatcatctgtctaaaactgtaggtacatatcaaggaatttaaccttttcttgtaacatcatggcttttctctgcttcttgggagcacgtccagcatcactagtgacccttcatgttagtcccatggtactattccaggtttatggtatgcatcacacacaaagaaaaatgagaaccatgagagatcactttttactgtgaaacaatttactggagtgaccatcagctcagagatgattagtgtcctgaggagttttaaacagatactcccaacacttgagctcaccccaatagcaatacaaggtggctacaaatttcttatagtacagtatgtactatagttaattttatgcatttatgatttcatacaccatctttatatttctttatattcctctcaactgcaagtggcaccatgtccagactgtgtttgtgtgcctacgtttcgataaattttaggcttgtttgtgtttatggtactaaatgatagaacagactagtatctacatatattaatgacatacatttattctttttttagatatttctagctagttttttttcaaattgtcacaaatgtccaaaaaatttttctaatatacttattgaaaaaaatccacagaagtggacccacacatttcaaacctgtgctctccaaggatcaactgtaattccttttctccataacatttcagtagtatcagaactacattaatgctccgtacctcctgtgtacggattatatcaggaggctgagctgtggatgaaagagattttaaaaagaaacagtagtgtgatttgaaactaaataaaagagaaacatctcgtctagagagcatgtcagtcctagtccaaacctttccagcatgtacaggctgaacactccaaaatgaaggtctactgcttattgctgaattgttggtagtctcaatgaccccaggattgcagagatgcttcactttcaaaaaaaaaatccattaaaattagttcaaagaggacactaacatggtgttagagggtcatttttcaatgttgtgggtggaggagcgagacacttagagtaactcccattatggttaatgagagttgagcatctagactcatctaaaccccctgagggtttaatttaaaaccactatggcaaagcaactctaagccatgaatgaacagcagcatttttcacacacctacctcttcccaagtaccaaaaacagtagaaataataaaggtgagtttgtttggttgggtttgatttttactaccatgcctcatagaagagaaaaaaaaaggaaaaaggctcatatcaaatgcctataaattttttggtttattttaaatccagggtgttattttaatgccatttttaaatgactaatttaaacttgagtctgggtttttccagttgctatgtgatgttcacatagaaatgcagtatttttttaaattccatttaagcttcagttttacaaatttagggctaccattatataatgtccattccaagacccatgctcttgatcaaccttaaggcatcaggataatggacaataaaaaaaaaataagtattattattattttttgaggcggaggcttgctctgtctcccaggctggagtgcaatggcatgatctcggctcactgcaagctccgcctcccagattcacgccattctcctgcctcaacctcccgagtagctgggactacaggcgcccgccaccacacccagctaattttttgtatttttagtagagacggggtttcaccgtgttagccaggatggtctcgatctgctgacttcgtgatccgcccacctcggcctcccaaagtgctgggattacaggcatgagccactgtgcccggccaaaagttataattattataccatgcttccaatatgccaaatttattcattcttctgacttccatatcaccttgttttaattctctcacaagagcccaggaggcaggcaaatacctgttttcatagcagaaaatacctttatcttcacatgagcaaatcaaacaaaaaagaataaatgacctaagtttccccatatgggactaaaatacatttctccaattccctgtccaaagctcatttgcagttttgacaagtacaaatgttttgtacccaaagacagtaaatgaggcagtagagccattggcaggcagagctctttcttctcccatgtacattcaacaataccagaaacaggactgagagagccttgtaaccatcatttccatggtttgagttttgtggtagggtcagggaaggcctctgtgtgtaagtgatgacaagggaacaggaattgaaaggaggaaaaccagggaccctgtgtaggtcagagggtggcaggtgaaggtcagaggaatgtcagattttactttaagtgaaagaaacagcaacagcaaccagaagttttttttttttttttttctgacacagagtcttgctctgttgcctaggctggttgtgcagtggcacgatctgagctcactgcaacttctgcccccctgagttcaagcaattatcgtgtctcagcctcctgagaagctgggattaaaagtgcccaccagcacacctggctaagttttgcatttttagtagatacagggtttcaccatgttggccaggctggtttcgaactcctgacctcaagtgatcacctgcctcagcctcccaaagtgttgggattacaggcatgagtcactatgcccagccagaaacaaccataatttcttaatgcaaaggaacaacctgttcttgtttctgtatttttaaaaatctatgtcagctacatagtggtagactggaggatggatagtggtagactggagttgcgggagtgataaacaaggaaacctgagagctcactgcacccagttcagacaagatttggcaggagtagtagagatgttgagtaccagactcagaacatatttttgagaaacagcctccatgtgcattggaaggatgttttgagaatgctgtcaattacatattctggcatcatctccttgaggaagaattcacagaaaatcgcctgatctctggtgttgtgcacatttctgcatttttctgaacaatcagcctatttttacctcaagaattgatgctctttccttatttaggttggtgatagaaagttcagggccaactttgtgacccatctgtttttgttggttttcaggctgctaaagacacacccaagactgggtaatttataaagaaaaagaggtttaatagactcatagttccacgtggctggggaggcctcacaatcatggcagaagtcaaaaggcacatcttacacggcagcaggcaaaaggaaaaatgagagccaagtgaaaggggaaactccttataaaaacagcaaatctcgtgagacttattcattaccacaagaacagtatgggggaaaccatccctgtgattcaattatctcccacgggctccctcccataacacgtgggaattatgggagctataattcaatatgagatttgggtgggcacacagccaaaccatatcactatctctagcaagtatataaatattttatatctatttgatgcactaatctcacttttggtccatcttactttccttttactacttcttgaattttgtagtttgcttttttttaaagcacttaaatcttactctactttttcatagtcaccttaaatcatgttttaaaaattctaggaaataaatgaataaacaaactaaaattgtctaatggaaatttccttgattattatagaaataataaatcagaagaaggtttcatcaaagggatcatcagaaagaaatagagatctacaaaagggcatgttatgtaaggcaacctgtatgcatgggaagccaagatgataaagccataaaaacttgactaaactgaagaaattgcttacagagctgctccagacttcctgaggaaggcaagacagtggcatatacaatcttgggaaatcaaatctcatgagccgacgagttatcaaacccttctgttagatttctctcagctgaggaaataactgatttcatcagcctggctggaatccacatggaaatctatgaaacctgtgctgggcatgggaggggttgagtatttttcatgctcaaaccacctgttacttctctctctttcaaagcaggccactttggaatgatgaatattagttatgtctccaagcatgtgttcatgtgtgttaggtacatagaaatcctggttgacactatgttaaccattgcagtatactgcctggtgtgagaacttaccacattattctacttgttaaatgaggaccgttgtcctcttttatctttagagctaaaaagccaacatggtcaaccagggtcactcatctagcaaatattcatttaacaaatatttactgaacacctcctatgagcctggccctgcccaggcagaggagatgcattcatgaataaacctgagaatcatccctgccctcagagagctcacattctagtcagcctgagacacacacacacacacacacacacacacacacacacacacacacacacacaaataaattatataataatttagtgtataaacactacaaaggaacgtcatgtggtaggggtgcaattttaagataatgggaaagactattctgtgacatttgagcacaatctaaatagaggtctgaaggagttgagtgaacatagcatatgtacatctggggaattggcattccacgaagaataaacagctgctggttcaagggctatgaggcagcagtgtgcttagaatgttaaacaaacaacaaggaatctagtgtggttggatctgagcgaatgtggggagctttgaaagttgtatgtagctgctgtaacaaattaccataaattggtggctgaaaacaatagccattgatgctgtcatggttttggaggccagcgtggcatccaggtgtcagcagggccacgctccctctttgctgctccagcttctgatggctgtcagcattccttgacttgtgaccacatcactccagtctgccttcacgatcatgttgtgtcctccttttctccatgtaatctccctgtctcactcttataaggacactgccattggatgtaggatttgcctggctgatccaggataatctccccacctcaaggtgagatacttaactcacacatccacaaagacccctttcctaataaggtaccattcacaggtttcaaggattgagatatggacatctcttttgagggatccccattcaactcactacaggaaaaatggtaatagatgaaatcagaggggcaatggttgatggcagggggtggatggaggagtacaagtaggaaccttgtcaatcactgtgataactttggctttagttagaagaaggtaggaagccactgtggggataatgagagaagtgacatagattcaacaagtcttaacaggatcactccggctgctgccatgcaaaaaagttccaatagcatttaatccttacattgatactttgttggcttaagagcatgccaaatttagattagaaatgaaaatgagaagaacctgatatacagatcttcagaaaatatttaataattaaaagaatattcctctacctaaccatcctgttttgaaccaaaattaaatttatcccataaatatttatcaaccatctaatatacacaagattctgactctaagaattgaagggatcacaccctacctaatgtggtattgactgacaaccccttttttttaagatttatgtcatctctttgtgtaaacaataattgaagaatctcaacttagtgggagaaagacgtgctaccattatattctttgccattacttttccagccaccctatgttgaatccctttctggctctttaataatatcttgggcagaacgtataactatgtagtcactttccataattgtaaatctctccattttaaaattctagtcttggttcttttaaaattttatatcctatcaagcacagacttgagatgcaacttttattacttagagctctctacaagtgttcccccatagtgaggctaagctatgctagcgttaaaggcagagtggtcttaggtatcaggttgcctgtcaacaggtgacaggtggccaggtgtggtggcacatgcctgtaattccagcactttgggaggctgaggtagattgcttgagctcaggagtttgagatcagcctgagcaacatggtgaaaccttgtctctacaaaaaatgcaaaaattagctgggcgtggtggcccacacctgtagtcccagctgttcaggaggctgaggtgagaagatcacttgagtcctggagctcaaggctgcagtgagtcaaggttgtaccactgcactatagcttggatgacagagtgagaccctgtctcaaaaacaaaaacacaaaatgaaacacacaacacatacacacacacacacacacacacacacaaacaggtgacaggtaagtgtccctggtctagctccagttccatctgctgggagcctctgcaaatacggtagtctgcactggtgaattaacagacatgttttttccaggaaggtagtaaagtctcgcccccgtttgtttctgaggatccatttacaaaaggacagccatgtctcccttttaggtctgccggtgttccatgacccaatcccctctctggagaggccagcacctcagttggcccagcatctacctgagcaacctagtggtgcctgcctcctactcggacattcatggtcatttacaggaaccgggggacctgctgaggttggtgcttctgggcttcttcaaagggctaccgaaaaggtgaaatagtgtagaaaagttgttctcatcttttttcccaggaacactactcctcttcagtgacttcttgctctgctactacaggcctctccaacaagcctcccctgccccaccctacattcaagaatgcaaagatgagaagcaagcactcttgtgtgctcatgtacaattccaaactccacagagcacatgggaagctctccaaaagcaattgtacctccctgcactcccagatcatgacagtacctgtgtcagcctgcaggtcctacagcttcgtagcatcaagccaaagaacaagatgccagtgtcattttgtggaaagcatcccccaagagatgtgacttttgaggcagtgggagtaattattccagaagagggaagaagaaagcatccctacactcctcatttcaactgtcgatctttgtcctcacgtatcctctccctttgcggtttgggggcgtggaggtatgtttcagtgaggtaggaatggttctgctgctgcctctcagtaatgtggatgtggggagcatctgtccccacatgtcagcattcctgcttaggccttagctgtttattccgcggaaatatgaaaagtttcactcaacatctgctgcactcctgaacttcaattacattactgcagatatgactccctgagagatggcttctagagtcatttggtccctaaacagaatagaaaatactaactggtattctaggcctctgcatgtgaaacactctagattttcatgtaattcctgttgatttatttttatcttgacacatcttatttaacaactattaaagcaatcatctttggtgaatggaagggtatcatggctaacttttaaagtattagcacgtaaatctcttgaactgaaaattaatcttaaagataaaaagaagttcttgataacttcaggcatttcaaaacctatcagaaaggagaaaaattggagagccagatgaatttagctcctcctggacccattttatctcagagcaaattatgcggctaaccaagctaaactgcctggccccatatagatggcagtggagagtaaggcttaaaccttctagactttcagaagtcactaaggttggtcttattcttaaatgataatgaagcttacaataaaataataaagccactaacagcaaaatgcccataaaaatataaatggcagagtaaagatttaggaaaatacaacactagaaagtggggctaatgggaaaggtttaaactctagggagaagaacttctcaggacacccaccccaccgtacatagaagtttgcagcacatgtgaaatgtaactggagaaggtgaaatgaacaatggaatgagaatcaaaagtcctgggtaaagcccagactcccatgaactagagccaccattggtctgtgcctcagcttttccattcaaaccactcataggccaatgaggatagaacaatttttgtttcagaaaggttcttgctctgcagcccaggctagagtgcagaggtgcaatcacagcttactataaccttgaactcctgggctaaagcaatcctcctacctcagcctccctagtagttaggactacagatgcatgccatcacacctagccaataaacttttcttgtagaaaagggtctagctatgctgcctaggctggtctgaaactcctggtctcaagtgatccccctgcttcagcctcccaaaactctgggattacaggtgtgcaccactgtgcctgtgtgaaacaaaatattgactccaataatgcattgttagtcataaaatataattttaattatttaaaattatcttaatgtaagatattagttatatgtatataaatatactctccactgccacagttaccccaaacacatatacaaaaggaaaagaaaggaaggaaggaaaaaaggaaggaaggaaggaaggaaattgcctcagtatcccccatgctacaagtaagctttcccttaaaccactattaggaggctaagttcagtgtgaggaagatgaccatttgatacgaagaaagagttctgttggtcttaattaatcagctaacctacaactatgcttgacttaattggtcttgaagaacaaagaacatgcttggtcttaggaatataaaggagcttcttccatctgtttttctccctctaaaatctccctctaaaatctactgagaccatgtgcattggcatgtctattcctgttattacaatattgaaatacacaagtattacttattacccttgcgtgctgctcaccacctcttttcttcctcccctgggactctccagacctccccacaatgcacaaattaataggctgatgtctggcacagtagagagctttcaggaaccacctttgacattggtcagtaccacctgtcatactaattgttacacataaacataactccactgcctaagacatatccacccatatcctgacccccaaatgcaggcagatacaagctaaaccaaggctcctgaaatatatttaaagcctgtagtagaaatctcacaaagatagtttagattgcaaactacttcagatatctggtattgtagaggtttttaaggataagtccaatgtaggatttgtgcccagaagctatttgcaaatttatggttattttttcagttaattagtttgagaaaggaaatggcagctaagtaaataaattagatcattaatttgcaataaatataaattaattatgctaattctaagagttgaacacatatacgtattttgtatatataataaaaataaggaacatacataagactattaggagaggaaagctaccttgactgttgtaaaaaaatccacgtatatgtactcagtagattttaacagttttgatatgtgcatgaaatataaaagaataagtaactacctactgatgttcaaacaaacctattttcattccaaatggaaattagaatatattctgcattatttgagttaattacatgacacttcttataaataatgatgtattattattccattcattacttctaattatattccttagcaagtgcgatgcctgcaacaccatgaccagtcttttcctgttccttaaaatctgatgacttgcatggaaagcaggtcaaaaatatgcccagaatataacgaacagagttcagtgattgttaaccatgacagtttaaaactacttgaaaaagttactgtggaaataaatagaaatggtgaacagctttccaaattacaggatacccatgatagcaacataagaaatatttgaagtgttgtctagatacatataattatcattctaccattcactagaattggagaaagaacacccctaatatccctctcccccagcatacatacacattaacagaattacattctgtgtagatccgcagatcgtaaagatacacatttctggttgcaaaagtgactctacagcctttatgcaattctgagaaatgtacctgctaaaagtcctaatcaaaatgacagttgaatttttctcctgtaatgcataatcaggtcaggccagcccaccccatcccatgcacagcacggtctggggctagaaggtaaaacatagtatggaagacaggtcaagatcaaggaaagacagttaaaactatcattaagcaacagggacctagtaacccacaaggctactttgtacatacatatcctcaccagagagcaggcagcaaggagccagaagagtcaaggaagagaaggcagatagcaggaagtagtctagatgaggtctagagaccaacatgtacatgcctcaggaacagtgtttcgtgggtatgtcaccttcattttgaaggggccagggcaaagtgcacaaagtccacacatttttcttcatccaatttcaaaccttccttgcacacatacaaagtacctacttaattccttcagcatcagcttccaacaatccattgttctgtctatgataaaaaataaagatgtcagtctcggctccagaaacaaaaaataaacttgggagaggaagagactagcaaggagggcttccccttcccctctagtgcccatcacagttactgccttctgaccccacgtgcagcctgagtcctcaaccttggcagctcactaccaactgatcagctggtatgtgagataaaatgaatttgttttctgcattgtaattctttagatggcaagtcaagatggatgatggtcacagcaagtttgtcttacaatgggagttggcaggattctctgtggtggattttagacactgaaaaaagatgttggtcaactttgaatgatgacagcatccaataacttcctttgttcccattgtccagtgctatcagaagctgcttgtagctggtggccatgtactctaataacccaagggtaggtgcacattcatatggaaacctttcccacagaagtaggaaaaagaaaggtccaacttaacagtcactgctaaatgcatgtctttgaacacaataatctgccaaatgaagtcaagaaagaaatgtgaccacaagaaaaccaacttgccccactacaatggacagcaatattgtctttgaacatttctcctccaaaagctcttaagctggctaatatacaacaagcatgcacagagcaaagacaagacatgtgcttagggaaattttaagagcaaaaacctatctttagctataaagatattaaaatagtgcttgtgctcattttacttgtacaggaaggtttgaaaagaactcttttttttttttttttttttttgagacggagtctcgctctgtcgcccaggctggagtgcagtggtgcgatctaggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgaaaagaaactctttagagaaatgaaagatcactaataactgcagtttcctgaacaattaaaggaattcacaagattacaacctactgaggaaatgacaaatatttctgatttttatggaaggactaaaagggcgcttttatgtatagcatctattctgtaagaatcactgttaagtaatgaagctatttttattatttttccacttatttcaggaacactcaacatggtaacggtctgaaaacgggggaaacttaacattgctctttggaaagttaatattccgtattaaaagatatttgtcagagttttcttttttaccttttgaatttggatcttggagcactgtttgcatggtagccaactttttatttctaatgtgtcagcagaaatgttcttaaagttacctagtctaattctctcacaaatatactttgtaaggctgtccctacatgcatcatcctaatgttgtatggccctggtaacattctgcgtgagatggtcttgattggaaaaatctgctctttttaataactgattcaataaactgttgacgtatgatttgtagaatacagtatgatcagtgagcaaggtttctgtcattacacaccctattcaattcatccacaaatgttgctgtgtctccctcatgttgcagctccttatgccattcagaatagcaatgcagagatcaatacactctctgctgaagacgacagaacaaatgaataattttatttacaatgaaagccccagtcttcaaatggataccactaatgtttaaattcattttcatgctcaactcaagaagagagatagacacagcacaaagcaaagggagtgggggtaaggagaagtattagccataatggttcaaatttatttaagccatgaacaatagctgggctgcactgagacacaggaataaaatgtttgctgcagaattctgaatgtgtactcttcaaaatgattctgtcaccaagaaactctgaaaagcattttccagtaacaagaaattaatggattaaagacattctgacatattcttctaagcgttgcaccacagaagccaaagcctgttcaataggctttaaacagtgttggcaaggaacagaagcgtttgcttcaggtgggaacaaggagggactgaagtggctgttttgagaatgaagcaaacgatcctgcttcaaaagcgtatctttggcctctgatttgacagttctttttctttctctgaaagctatgaaaaagtcagtgagcaaagtcataagaaataagtgttggtgaggggcagcaaaatgttataagagagacaagttcaaagatgacatttacaagcctctcatgaatggcacactccccaaagggcacctgaatgccatttttaagaagaagtcatcaaacatacaaaataaaatgttccattttacataaagatgccaatatactgcccttaaaacacagattggtccattcacaaattaacatgtaaagaaatggcaaagaaccttctcccatctgccatcaattcattcactgcttttagatttaactccctacactcacacgcttgtaaacagaattgtaatggacaaaggatgaaggggaagctgggaaaacctagcttggacatgatactgaaacatctggaaaaaagtggtgacaagacttggccttggggatgggaaacgggaaaaggtgggatttcggcacatcctgtctctctattctgttaactggaacaatgcatatactcctgatgtttccagcttcactttagattcagtgaacacagtacatttggatgctaagaaaaaagagatgtgcaagagcaggtctcgtccataggaagcaaagactcagtgcagacagaaatagggatgcacgtactttggatatgaggcagactgggctgtgtgtttggtcttggtacctggaacagagtatgagctcagtaataaagtactgaatgaatcaacatgagaataaggaagtgagtgtcacaaacagaggacagagttttgttttgttttcttccctaggagcaggggacagttatcaaagcacttcagatgaaatgaaaagcatggggaggaatctccagttgaggtgaggggcaggagaaagtatagtaaagggatagtacaacacatattcagggaacagccggaaagaagggagactgagccagtacaatgaaggtccttaaaaactattctaaggaatttggactttatcctcaaaaaacagacattccttattggtttattaacaagggaagagaagaatgatatggtcagggctgtggttcagataaagttataggctacattggaaaagcccagaggcagggagacagcataaatctagatgaaccacacctaagggctagactagggcaggcaggagagaacactggaggaagataaaagcccactccagacatctcaccatttatttatgaaatgttagtggacagagctatccacatcttccattctcaagtctcaggacaaaagactagagctttctgcaagcaaaggagtaccttattaagatgcgtctcccaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaagatgcgtctcccagttgtaacatggcagagtttataaaggtaaagtaaaataaaaagttacaaaatcatcacataaaaagcattgtctgaatacactgtctactggccctgagactgttttaaatactgcagctgttaattagacttatagagtataatgattttaaaaaagctctggttctcattgttcttataatcagagagggttggatccttcttgctaccttccaaacaaactgaagtgtgttaattttaataaaatattctccgagcccttggtatttactcaaatataaagtaactgagcagggttcatttcccaaatggtgacaccagtgccatctacaaagaaacgagttgtcattcactacttgctcactattcactacagatattttcctagacatagacatttctacttttcttgagttcaaactcaggtatgccctggttttagacatcactttttctgagtttgttaaaaagtctgaaatatcaaattactctcaagatatgagtaaaaaaactacaaagcagagttcattccattattaaccattttaaaaagtggccaacatggcaaaaccccgtctctactaaaaatacaaaaattagctcagtgtggtagtgcctgcctgtggtcccagctacttgggaggctgtggcacaagaatcggttgaacccgggaggcagagattgtactgagccaagattgtgccactgcaacttagcctgggctacagagtgagactctgcctcaaaaggaacaacaacaaaaaaaagtggtacatctctgtgacctctaattttcataggaatgagagtgaatttagacaaatggatcttgtctaaattcatattttcatcccaggtccctttatttcttttctaaaagtcagttaaagctggcacctagagagagatggcatttaaaccatattcttttaacacctgaatttacagacattttgctttaaaaaaccccaaaggaaaaagcccactacaaacttatagcaaaataaaatgttacttcaagaaattcaggtcttttaaaagatttcaatacacaattggtattaaaattaaaagtgctgttttctagggcttttctaaatcattctagtgtttttttttaataaacagaagaaaatagttttctaatattatttagactcatttaaaagaagagttttaaatattaagaaaagcttacatatttactagagtattgcttattagttttctaaattaatacaatttatttgactagaatttggattccagaaatttgggagtctataatacaatcacaattatcttttggtacatgtttttcttatttgtattttttttttttttagcatacaatagttacgtggctagaaaagaagcttgttcataaagttctcaggcactttccacattttcactggaaaaaaaatgtagcttactctgaaaaacctcttggcatatttgtacattcagaattactaagaaattcatttcaaagcaaaatcatgtctcagcgtggaaaatacttattatctgaaaatatcaaattttattctgttgccttctgcatggcaaactaagtgaaggaggaaagagaaaaacatcctgaagagtccgtacaaaattcatatgcacacaatcaggagtgaaacttttaacaacataaagataacttcccaagcatttcaccaatacttgttattcccactgcaaaagaataaagctcctattgaagtctataggaggaaagactacaactcagtggtcagagggaaataaaacaactccaccaatgacactggtcaatgatctgcaagctggtatttttcccaagagaaaatgctatttcaggtcctaatattttttaaaaaaaatttgtaagtatatctataatataaatttaattaaaacgcacaacttgaatgatctccaagaggtaaagcaacaaagtcagtctcaaatcctcacatatcttacttccacatcacaaaggcaccactcaatctactattaaaattcacaacagataagctgaaaaccaagtgcccgtgatattcactgggctcattttagaagcacctatttatttactcagctatggtagtgaaaaggtcaagcaaaaattcacctccaaagccacggttgctaagcaactctcctcagaagttctgcaacattgatcaagcatattactggtgccaccaactggattcagaataaatatgagtaacatcttacctggtgtctccgaagtgggagggagatggattctttatttacctttttggacagactggaggccaatcttgtatttatattcatttggctggttaggctcagaagacttttattttccctctccaaaaaaaaaaagaaaggatacgtcctggtaccacaggtttcctattcacaagagcgaaggacagttctgttttgagaaacactacagagggcttgatgagatgttggccaaatctgaacgacatgtcctcacagttgaagtctaaaagaaaagacaatggatagttataaaattcaattaagaaactcagttcatataccaccttaaagaaagcaaattccattactacagattcttagttgcagagaggatgccattgaaattgttcctcattgaatgttcaccaagatgcattctgggaaagtctttctaaaatactccactctccctaccagtgtttccttgattagagttagcaattttcaagcagaagcttccacgtggacaataaaacagcttttccccttcactccctctgcacttcacggtgccaccttaactcaaatccacaaggccctatttgtcagctacttatttttacccatctattttgtcatgtctgctaagctgaaaattttcattaagtattaactataaaccttctaattcttaaatgcttctctcaaatggttttgtgttcatataatagcaatttagaacaagtacgaacactgtctgaccttgcctacaattacaaaaacatgagcacttccagagaactattctagtaaaatctccaaaataaaggagaaaaaaaacatttaaaaagaaggaaggagcaaaacggagttcaaaactagaacaattcctggttgtaacagggccacaaagcagcaaggtacctgaaatgttctgcgtcttccttttgagggaaagccatggggggccgggggcaggaaagggaggctgaagggaatttggcaaatggcacagctgagacaagccaaatccatctagcaccaaggaatgacttttcaatcaggtggatgccaatacatgacaaagttactttgtgaatgactaagacacactttgtgaatgactaagaaacaccatccctagaaaactacttcatttttctaattcgggaacagcctagtatgaaactgaggaacatggatcaatctacagaaaaacagagaaaggattacaaaaaggatgaaattagaaaatagttggctatttgtgatatgcatttggttttcaaccccatttcctggcacgcaactcctaaaatccttagaaactccaaagtgatgtctttttgtatgctaatgattgactggtgtctagcagcctctaagagtctaggtagcttcaggatggggttgatcacaagaaggaccaagcacacttatacaccaataacagacaacagagagcaaactcatgagtgaactcccattcacaattgcttcaaagagaataaaatacctaggaatctaacttataagggatgtgaaggacctcttcaaggagaactacaaaccactgctcaacgaaataaaagaggacacaaacaaatggaagaacattctatgctcatggataggaagaaccagtattgagaaaatggccatactgtccaaggtaatttatagattcaatgccatccccatcaagataccaattactttcttcacagaattggaaaaaaactactctaaagttcatatggaaccaaaaaagaacctgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccacacatctacaactatctgatctttgacaaacctgacaaaaacaagaaatggggaaaggattccttatttaacaaatggtactgggaaaactggctagccctatgtagaaagcagaaattggatcccttccttacaccttatacaaaaagtaattcaagatggattaaagacttaaatgttagaccaaaaaccataaaaaccctagaagaaaacctaggcaataccattcaggacataggcatgggcaaggacttcatgtctaaaacaccaaaagcaatggcaacaaaagccaaaattgacaaatgggttctaattaaactaaagagcttctgcacagcaaaagaatctaccatcagagtgaacaggcaacctacagaatgggagaaaatttttgcaatctactcatctgacaaagggctaatatccagaatctacaaagaactcaaacaaatttacaagaaaaaaacaaacaaccccatcaacaagtgggcgaaagatatgaacagacagttctcaaaagaagacatttatgcagccaacagacacatgaaaaaatgctcatcatcaatggccatcagagaaaatgcaaatcaaaaccacaatgagatacaatctcacaccagctagaatggcgatcagtaaaaagtcaggaaacaacaggtgctggagaggatgtggagaaacaggaacacttttacactgttgctgggactgtaaactagttcaaccattgtggaagacagtgtggtgattcctcagggatctagaactagaaataccatttgacccagccatcccattactgggtatatacccaaaggattataaatcatgctgctataaagacacatgcacacatatgtttattgcggcactattcacaatagcaaagacttggaaccaacccaaatgtccaacagtgatagactagattaaggaaaatgtagcacatatacgtggaatactatgcagccataaaaaaggatgagttcatgtcctttgtagggacatggatgaagctggaaaccatcattctcagcaaactatcacaaggacaaaaaaccaaacactgcatgttctcacttataggtgggaattgaacaatgagaacacttggacacaggaaggggaacatcacacactggggcctgttgtggggtggggcgagggtggagggatagcattaggagatatacctaacgtgaatgacaagttaatgggtgcagcacaccaacatggtacatgtatacatatgtaacaaacctgcatgttgtgcacatgtaccctagaacttaaagtataataaaaatatatatatataaataaaataaaataaattaaattaaaataaaaaagaagaaccaaagcaggattatagggccagaacattcagccccactcctcaatctcccaggaagagagaggggctgaaggtgaagttgatcaccaatggtcaacagtttaatcggtcatgtttacataatgaagcctctgtaaaaacccagaagaacaggtttagggagcttctggatagctgaacacgcagaagttcctgaaggatggctcgccctgggagagcatggaagttccatgctctttcccccatacctcaccttatgcatcttttcatcagtatcctttgtaatatttgctgtgataaactggtaaacttaagtatttccctgaattctttgagttgttcaagcaaattgattgaactcaaagaagggaccatggggtccctgatttatagtcagttggaagttccagaggcccagacttgcaactggtgtctgaaagtcaggtgacagtctcatggcattgagccctcaacctgtggaatctgaggctatctccaggtacgtaacatccaaattcttctgaaatgaatcaaaggacatccagctggtgtccgctgctttgtgtgttggggggaaagaaaccccacacatttggtcacagtagtagtctttgctgattgttgttgctggtgtgaaagcagaagaaaaacatgttgagtgtatttttttccttattttatatagcacatgaataatgcatgattgtttaatgattctaatattctcaatgacacagaagacagagagctgtgcaaatgtcacttactatggacacacccacatagccagaactgtacacatttcaggtactaaagaaataagataggaaggtttgccccagtggtacaagataatggtttttagaacatttacaaccagctcattaaaaacccaacagttctcaaggtgacgtccctccacaatagcatcagcatcacttgggaacttattagaaatgcaaattttgaggccccaccccagacctactgaaccagaaactctgggacaagggcccagcaatcaaggcttccatagctgtccaggtgtttcagaaccactgaccaaacccaactatcctcccaatccctgggccttttcctacagaattcctgccaaatggctgcctagcatatgcttgaatatgtccagtgatgggaagttcatcacacattcctcctaagacagtcaactctacaaataacatagttgctctttataccaagtccatctgtttttcatgactttattccttgggatcatataaaacaagtatcatgcaagtggcagtgcttcagatatttggagttagctatttttcattttttcttgtttttcaagaataaagatggcaaatcacatccaccattctacaaacagcattgattcaagtgacctgtgattatttccctccccagaatctacttccttagagtcttagctgtaccactttgattttttgcttttagtaacaccccaccatattctacatgtggggctattcgtactacctggttctagggatgggcaagtgacccaggcacccatagtcctttgacatatgattggttcgggagtggacacaggacacaaaatgagccaatcaaaggcaaggacatccttcagagtaatactgctattagtaacaatgccactttctttcaactgagttgccaaactggtagactatgaacctgaaacagctacgagttttcctaaaaaagagctggcttgatgtgagagccaatactgaggcaaagacagtgaagacacagagacccatacctgatgacactgtctgagcacatggatctaacattgccagaagaagtcatgtaccagaagtttctttcaggataatggaatagaattgacttagcacaggctctacttgatgagctactattatcatgagcccatgaaaggctcttctttttcttttcacttttccaatcattttcctttttgtcctctgtgttcagtcccattccctcccttcccaccacagaaattcactttttcataattaatgtattattcagaatcctctttacatgtttgtgtacatacattttttgtcaaaaatacacagggcccttatacataatttttaaatttgtatataaattgtaggttttaaatcccattcttctgtattctctcaacattgttttagaaatttatccatgttgccataaacaattccttcactgcattccactgtagtattccttgcccattcctctagtgctgtagagctagcttgattacaaccttttaccacaagttacactgtgactaccattcttacacgtttccctggattcctatcttagcatcccattgttgggattcaggtcagatacttacttagattttctaaaatatatgcaccagcttgcacgcccagcagcaatacattaggatttctattttcctacatccttaccagcacttgatagtacttcctgctttccaagtttttaattattgaatggtaaaatggcgtctcttccttttacttcatttgtctctaatagtgtgatgtgtgtgtatatgcatgtttctcttcttatgaattgccaattcatatactttgtcctctttcatattgctttcctcccttcaattttctaattttgtagagtcccttgtatattctaaatattgatcatggtctattaaacacaataattatattttcaccatctattaatttctctatcgttccctccattgaacagaaatcattcattttgatgtattccaagtccatcaattttctttttatagtttgtgctctgcaaatctctccgaacaaatccctctctaccataagtttgcaaatatatatattcctatattttcttctatcgactttatattttcatccttaacatttaggtatttattccacttggaactttgtttatagtatgaaatacagaaacggcttcatttttctttttgtgagccaattttcctagtaccaattcctgggaatgattacagtaagttcccatatatacacaggaataagtctagactcctttctattctgcttcagagccagacgctgtagaacaaaggtcgcacatttttgcacattttttttttctgtaaaggaccagacacagcaggccacacaatgtctgttgcaattactcaactttgtcatggcagcatgaaagcagtatgagtaggcgtggctgtgccccagtaaaactttatttgaataaacaggcagcagcccagatttggtttatagggggagtttgccagctcctgctgtatcttgttaatgtctaaagaaaaacagagatcctctttctgtatttattatcccatataaattttagcctccactctgcccctttcaaaaaaaaattcttagatgttgattagactgaatttaaattgtaagatgggtgaggggaatgtgacatcttcaaaatattcaacgaagccatttatgaatgctgcatttatgctctttaataccataataaaactcttgtaatagagttttaaatttcccttatatgttttatgcattctatcttagatttattcctagatagcttttagtttatgtcactattataaatggtatcttattattgtcatagtttataattagttactcccaatacagcagaaagctattgatttttctacgttcttatagctggcaatctagctgaactcttgcattgcttctaatggtttctgctgattctcttttttgttgttgttttgttttgttttcagacagagtttcgctctgtcacccaggctggagtgcagcggcgcaatctcggctcactgtaagctccgcttcccaggttcaagggattctcctgcctcagcctccagagtagctgggactacaagcgcccgcaccacgcccggcttttttttttttttttttttttttgtatttttagtagagacagggtttcactgtgttagccaggatagtcttgatctcctgacctcatgatccacccatcttggcttctcaaagtgctgggattacaggcatgagccaccgcgcccggacttctctttgtttttatatatatgatttcacttagaaataatgataatcatatctttcatggcaattttcctactttcatgtttctttgtcatactgcattggtcagctatgtggtaatgtattgagaagcagaagtaacacagggatccttttcttgttcctgaccttaagagggctgagtttaaacttctttttttttgtattatgaatgatgtctactctaggtttttaatatgaagcctttaatcaagctaaaaatatcccttctatttcaagttttctaagggttgatacctttttttaaaaaaaattggttttatgaaatgcttttcctatatcactgatgacacaattgcttgttccgtgccattaatgtggcaaactacattagcaaatttaaaaataataattcactattctttccctattatgattaattcaactccgtcacaaggtattattttttaatatactgctagatttgaattcttagccttttgaatgtcataagtgaagttggccaataatttctcaacctatttttttttttttttttttgagacagagtctcactctgttttccaggctggacacagtggcacgatctgggctcactgcaaactccgcctccccggttcaagcgattctcctgcctcagcctcccaagtagctgggattgcaggcacccaccaccacactcagctaagttttgtatttttagtagagacagtgttttaccacattggccaggctggtctcgaactcctaacctcaagtaatccacctgcctcagcctcccaaagtgctgggattacaagcatgagccactgtgctcagccaacttatctagtttttgttatcaagattaaacataatagtttggtttttcttttttgttccaaagagagtttattaaacgagcattttctgtttcatgagcgttaaacaaaactcttttgtcaaactgtgtctttttctcctgtgccagaaaggactaagttttgacaatcattacaatttattgttttctgatttactaaagattttttttttcttgtatcaatttcttagccatatatccttttcacataatactggtaaaaacttatattctttttactggatttaaaaatataatctgtaattatctcttttacctatttcgtattgtgtttatcatggtacatggagatgttttttcttcatctgttattcaaaagtaagatctatcctatgaagttttttaaataatgaacttctggttctttggcttttatgaattatttttactttattaccacatttgtatttatttcctctgatttgttttcctttattgtttctttggatttactatgttgcagtttttctagttacttgagtcaaaccttgggcttataggattccagacttagtgtttttctcttgggtaacaaaagctatatattgccgtgaaagtattccattagctctatctctcacctactgtgcttttattatcactccgctctaaaactttgctattcttgttattatttcctatttaacctgagggttatttcatagtatgtcttttcatatccagatatataggatgtttttgctatctttttgttaacagtgtctgattttatagcactgttgttaagagaacctctaagctgttgattttttagaatttgaggcttcctgactcattgaaagttgaagcttgtgtctaatccacatgccctctgaaataaagtatgctctgcttttgttgaataagttctatatacatgagacatcaaattgttatccaaatctctctttgtctcattgcttcattggtttctgagaggactgttttaaatttctaactatatttgctaaatcaatgtctaacgccataaattattgttttctgtacctcaaagctacattactacatgtggatatgttcctattcatttcactcccttggtcttcttattcctttttcttctttgtatttgacaagtataaatttttccatcaccttacattagcgtgtgttctcttgaatttttttttaataaaatactatagcatcttgttttctatccattaaagaatctgctggataagtttaatcactacacatttacactaattattctttgagcttatttcagatattttatcttttcgtttgtttcacttcactttttctcctgtctaccttccacgggttaagtctggtttttctctccccatgagtatgaaaattacacattctatttttatttcagtagtggttattcgtgttcttatcctatccatactaatgcttagtgtttaaaagcagatcaggatctttatccttagtatattcctacctcctttcatctcttccagatatcatatcccatcttcgtcatgtcctaacttttatgctgaattgatattgttataatttcaaataatgctttatatgcttttttacccaccatccctctctccccacttactctactgattgtattttcatttgtcttgtttacaaagatgtaaggacattcccttctcacaggcagctgtgggctccagcaccacctgcttcttttgaatcttactttccctttctggcctttagtcctcccttttcctcaaaactaggctacacttttgagtggataaagagtctcagctctgccactctcttcctgatcttccagaattcactgaaccttctaatcctcagacatctcatttgaaaatagtagataatgaagtatacaaagcatgtctcgttgtctgccacatgatgtaggtacccttaaatactaatagttttctctctttccctacccaaatctaagtctacctcttttttaattgtggtaaaaatcctccccatatatgctgctagtacacctatttcttcaagttttaatttcaatgaagaagaaaaatattctaggaactctaaaagggacaaaagcattaaaaagattaagagtcaatagagtttgatgggaaaatttgtgcatctccaggatctgaaactgtctccaagactgagataaatattaaatactttcctttcacataaaaatggcagaaagcaattttattttcagataagtaaaattgctgaatctttctaccaaatataaagactagatgtaccaatattctgtggaattttccagggaaaatcatcttcagggaactgcttcttagcaaatatggagatggtggtttctgtaagccagagaagcaaatactggattaggaacctcagtccaaggtttagacccttagacttgtagtgagcattagccaagaaggaaatacaaggaacttggtttactctagaaatggtaattgaaccctactctctctttataaacaaacagaagtagatacataaatgaaaaaaaaggtctcacatttctagccgattactttcttctttatttttttggtgaaaacttcttttatttgggactaaaaatatatgatttcaacattcttaaatgagtctccatttcccacttttcagccataaaaggtagcctcttgctacctctctcttatgacatatttgtaccctctctacctcctataaactacctttacatctgcatctcctacaattctcgccagctggtagcataacacttttagagctttatctttaaaatttaataaacataaaagaaacaatgaaaagatctctactatccttttgtgtgtgactcagtggatgtgttcagtcatttttttgacagggctagataggcaacctaacttgtagtagagtaaggttcagtgacacaaaagcaaatgcaggccccaaactgggaaatctccaagctgtgaacaggaactgacaatagctcacttcagggtagggcagattctttttccggatttgctttcaaatgttatgttaacatccaactaaagtaacgaaatctcttttggtattgccaaaagagattcacatttgagtcagtgggctggggaaggaagatccacccttaatctggtgggcacaatctaatcagctggcagtggatataaagcaggcagaaaaaaaggagcacgagagagagagagcgagagagagagagagagagagacactcttcatagagaatattattcaaggatttcttaaacttgggaatataagacttcagggccctgatttgggaaatactgaattaataacaactctgtcactttaggcaatccctttgcactaaagccacatagcagtactctgttatcagacaacaagcagctgatttaaaatataagcctatatctgtcattttcatattatttcatcaaatagagaacaataaatacaaactttttgagagcatgagggccttcaaaacccactggccgaagtttaagaaactcaggccttcagcaaatgcacctaagaaaccaagctcatgaagatgtgaaattctaatcaacagattacctgaaaacatttccatcccatttcatgatttctctctcttttctgtagcaaatgatgtttttggaagaaaaagagcgcatatttcccttgcctggctactcaaaatgtggtcctctaagtagcaacaacagcatcacttgagagttgtaagaaatgtagattcccaggccccagcctagatgtaatgcataaacctgtattttaacaagatccccagctaggctgtttgtacattaacgtttgaaaagcacatctcagagcactagttttaaaactaggtctattaagatcaacttgagaactttctcaaaaaacaaattcctatacttcatcatactcttgactccaacaatctctgcaacaatgtagctaacccatcacggggatttgacaaacatggcttccgattgtatcttctttccaattcattttatgaactcaggcaagttccttagcttctttaaatttgagaaatgagtatgacaacagtaccttcttctcaaggacacacataaagcacttaaatatttgataagtgctagtcacaatattggtgtattttgccttgacaaaagtaatgcctaattttattcaataaacaattgttaattgtcaactcatacataagctaatattgttaagttgcttcgtataatgcttatcacaaaaatggtatgtaatggttacataaatacaaataaaatcatgtatttgacaccatactgccattaggtgactactatctctccatattagaggtagagcagtgtcaaaaactaccatctgattaaataatagaaataacagctaagtacttactcggtactttcatctttctaagcaatttatatgatatgttacttaatcctgacaaccctatgaggaaggtccttcatacaccaacatatcaacatttatgcatctctttgattacttctcatgcattaattcctagatttgagaatcactgtgttcaaagtatattgaactattaaggctacgggtatgaactactaaatagctctcaagaaatgtagccaatagttgatatccaacggttgtatagaaaaaagtcccatttccccaaaactttgttaatgccaggcattctctaattctccaaattgctaataaaaatttgtcatgacttaggaatacaacataaagggaaataacttcttctaaatgtcctagataaaacaatctaccatgaaaattaatgtctcctaggcaaccaggaagtcagacacaatgaaaaagaaacactgttctcttcgttaaaagaataaaactgtgtttccttttaactagaaaaataaagttgttatttcattatggccaggaatattaaggttcactgtaaaaaataatctgctatttttataccctggcattactcagtgaatggcaaaaatctagaccaatcctagaaggcacgaatgtctttgggggatgtcagaaaaagccttaactccagacacttctaccaactggagagtaggtttctatttcaattaacttaaacactaggggctcaattgttaaccaagaatgtaaatgagcttattaaaagctgctggctaatggatcccaagatgaaccttgagaggaacaatgccctgtcatctaactgaggaacaacacaatctgatctggccccgctctgaaacatactttattgatgacttggaaaacaaggcacataaatgaatggttggagacatatattgaagtttatatgatttgtaaaacattctaatctacaggcgtatgtcaaaattccacaggagacagtagaagaggatcctagaagaagataacaaagtgaacaaagagaaagagaagacaacttgaagtgtcccagaatttaagcaaacaagaatacctgtaacatttttatacaaagagaattttttagtgaagtatattaagtcatcaacttatgtcactaaaaaaattttcaattgttaacaagtcaaagaaaatccaaaacctcagctatttataaacagaaaacacctaggtatttcaaaatgccaactgccttttcaagatctcacttcatcagttacctcttctctgttctgtcattttttttttttttgtaaacctacttgttttacatatttaacctcattctcaccagtttcttccctgtctcctaaaaagatgttcagggattacatatacttaataacctttcctcatcaaactctaatcacctattcatttaataaatatgtattatatacttgccatattccaaatactattctagtggtaaatatgacagaccagccctctgctctcatgtagtattctaggcacagggtgcatattgcaagcagtagagactacaagccagtcaacaaggaaaaatattctgattgtgacttgaaggaaatgatcaaaatccaagaacaggaagggacttggaggaggcagaagtggctgcctaagtgtcaaaggaaaggggaatctcacgtttgatctgcgagttgaatgataagaagtccactgtatgtgactatatggggataaaatgttccagatggaggaaacagcaattgccaaggcaagaatgatctcaagatcttagaggaatggaaagaagagtgtggggtggagcctaacagcaggcagcaaggcagaggtgaggagatgggtttgaaagatgagcagggatcagatcatacaaggtcttgtgtggcgtttcacttaatgagaaactcgtgataacaaagattcaagctccagagtgttcagggtctaaatttgactttcaaaaaaagattttactattgtacattaaaaatcatctcaggacgcctggtgtggtggctaatacctctcatttgggagaccaaagcagaaggatcccttaagaacaggacttcaagaccagcctgggaaatatagtgagaaagaaagaaagaaagaaagagagaaacagagagagggtaggggagaggggaggggagacgggagggggagggggaagaggtgagacgggagggggggaggggaggggagacgggaggggggaggaggggggaggaggggaggagagaggagaggagaggaagaaattagctgggtgtggtggcatgcacctatagtcccagctactccagagaccatggcacgaaatgcctgagcctgggaagttgatgctgcagtgagctgtgatcatgcccctgcactctagcctgggtgacatagtgagatcctgtctataaaaataaacctcaggagcttaaaaaaaagcatatgccccattcccagattatttttctgttaagacttttgaaaagtgacatacaattcatataccataaaattcacccttctagtgtacagtttgatggttttcagtatgtgtgcaaaattgtacaattatcataactacctaattcagaacatttttacccccaaaagagaaaccatttcctttagcagtcatttcacattttcctctagcccacagcccctggcaactactattctactttctgtctctgtggatttgccttttctggacattctatagaaatggagtcatacgatatatagccttttatgtgtagcttatttcacttagcatgtgttcaagattcatccacattttaccatgtattcatcctttattccttttaaaggctgaataataccccattgtatgtatacaccacatgtttttctccattcatcagttgatggacatttgttactacatttttggacgtttgtgaatagtgctgtgaatattcaggtgcaagttttgtgtggacttatgttttcaattattgaacgtacacctaagagtgaaactgctggatcatgtgggaactctgtatttaacattttaaggaactgccaagctgttttccttagtggctgtaccattttacattaccaccaccaatgaaagagggttccaagtcctccacattcctcaccaacaccccactcccagatattttaaattaattggtctggctgagacctagatatcaggcttttttttggtttttattttgaaagttcctatggtgattctattcctaacgtatagtgaaggccaagaagcccttactccagcctgttcattgccaacttggtaagtatttatacctactccctcttcctgataagtattcatacctactccctcttctgctccagagctctttagacatgttacttggtgcccccagcactctcaatgacatctgctttgtagctgactcatccagtgagagaaggaaagataattaaggaagatacagtcttatacttttaacagtctcatttatttctgagtggggccagtgtctgtgtgaaatcttcatggttatctgcatgtctggatgggttttctccaggcactctggtttcctccctcattccaaaggtgcatgtgagattaagaggcatgtctacatggtcccggtctgagtgagaaggtatgtagagtgagtcctgagagggaatggcgccctgtccagggtgggctcctcccttgggccctgagctgccaagacaggctctggccacctgagaccctgaactgcaatgaatgggtaaataattatcttgcttttattaatctttcttataatatgtagacatcatctttatttctgtatttaatattaacaatattttggtttttatttagaagtttggtgatgtttttgtgaggagaaatatgccacaggaattttttttttaatcagttagcctatggtcaaattggtttcattatacattgttttggttaaagttgtagtttctaagaaacctacctatgactcaagtgaggacttgtgtttttacgtaatgtgaatcagcaacccccttcttccactgattgatccgacggagaccttttatgcaaaaagaggtcactgctttaaaatatatatatatatatattttatatttattttatatataaaaattatatatatttaaaaaaatatatatatatatatatagagagagagagagggagagagagagagagagagagagaggctcctgaagttcttctcatctagtcaagaaagatatagggtgtaaatggatacttctatgttttatgcttcaacctgaccttgagtattaaacatggtatcatatttacaaaaatgtataacatttagaactacttttgtcactttataaaatgattcttccaaaccaaacacaggtgatgaatatctaaaacaccagcatcaaggcctagagctttgtgtttgtacaaaatatcagggaaaagccaagcacagtggctcacacctgtaatcccagcactttaggaggcctaggagggcagatcacttgaggtcaggagtttgagaccagcctggccaacactgcaaaaccctgtctctactaaaaatacagaaaattagctgggcatggtggtgggcacctgtaatcccagctacttgggaggctgaggcaggagaatcgcttgaacccagtgggcagaggttgcagtgagccaagattgtgctgcgccactgcactccagcctgggtaacaaagcaagacttcatctcaaaaaaagaaaaaaaacgtatcagggaaagacagaaacctgaataaaaaggaaacagatttctacactgaaggacaaagtatggcatgacttctcagtctgatggaggccgagattcgtttttttcattctgagattcatcttaacggttaaaaaaaaaaaaagaacaaacaaaacgaaacccaaatcatgtttttcatgtggactgtaatagcagagacgaacttacatgtttaaatacaaaaacaatccttaaagaggagaatcagaagttgaaaatcaccttactgttatgtatctttctggagtaatcaaaatttctactatattatagtctctataccatcaaaaaatccacagatatcacagatattcatctccatggactgtatgaagacattgtggacatattgggacatcaactcagaaataatgtcaaaagcttgtatggtaaatctgaatcaactgtgatctttcagaagcaggagcttccaaaggggttcctgtagcatccctttatcagagcaaggccagtcagaggttaagaaacattgggtcttttactttaacacttctcacatattattttaaaaataaataccaaaagaaataccaaaggaaaaaccacataaattatattttgaacatttacattgaacaaattaaagttcccaacataagtgaatacaacataataattactattctgcatatgagagaaattattccaccattttttgactcctgaattgttggcaatattcatggcaaagcaatgctgctcataggtttttgctaaaacggagtataaggctaattacagtgtcaattatagctatgtatcatttgtactctatagacttactcctattttaagtggtctaccatattcttctaatatctaacggtgttattcacaagataactacatgactgatacattttttacgtaacagtgtactacaggtggtacaaccttgtaagagaacaagtttagaagtatataatgcacatcttccttcaatcctgtttattagcatatggaaaacacatttgaagataaccagatataaattcaaggccttgaatccaaagccgtcccaaactactgattccctgtgttcttccaggccctcagaagatgtcggttaaaggaaatcataaaaagtcaaactatagcctctgtgttatgtccccactaaagccagtatggccagactttactgtagctgagaggttcttgctcatggagtcttgaaatagagcttcccaacttcagcagagatgcctattatacaacattaaataaaagacgaatttaaatgaatcaagtcttgactcttcttccaccatcatgggttttacagaacagcattatccagggctccattcaaggtaattttgctttttcattgcttgacaaatgctttcccatttccctgcaccctagacaaattggtatttctcagcagctcttagaatgacaatggcagttttctcttcatcgttttttcatttcttcatcctctcgccatgagaggcactcatcaggggatctctaatcctacccatctcattacctcttcactctatttgtcaccatttggaatttcagaactcttaattattagcttactgttaccaacagtaatgaggctctggctgcctactggggagcatcatccaacactaacaagctagcagactgagaccggcacctgaattccatcacgtggttccattgttcaggccaggtgggacatttctgtctgcaggcaagctttctgcaggagagctggagtttgcagggtggctattatccattcactttggtcttatgattcacactgactcaaaacagctttcctgtgtggtcatgctcatttacatactggctattgccttccttataataacacttaatgtttatttctgccttgtcctccttttcacttgtataaggacttcctggagctaagagttctcaaagggaacactaattggtcattttcttatagctacttttgatctcctcctgacctggaatgaacagtgagtctctcacagccatctgggtgatccgtctatatacagaccttccttgacactcccgcagtagtcagcatactgcctcaacacaaaagaggctagacaaatgttaagtgacatctataaagttttctgagcaccaaagacagacccagatgcagaggagacagaaaggtaaaggattaagaaggagctggtccctctgaaactatgacaaacatgtctttatatagttaacgagggaagatgcaactgatccaaaatccatctcttccttggcttcatatcctttcacagcaacaagagccttgcaccaatgaggacaaatgagcattggttgaatacttctaaatgcccagcctacattaggcacttgacctgcatttgctcatttaaaccccaatagcctgtacagtagacctggaggaaaacaaaacccacagaagtcaagcaacttgatcaaggtcacccattagtgaaaaccccaaagctcttctcagtacaagtggtcacccaacaccgctcagaaaacggttaggcaaaatgagggcctggggtgggttttggaatagcaacaccctgaaggtaatagaggctggtggtagagaagaggagcagtggcatcacctaggtgtgtaacgctgcctttgtcccctgtagctgctgccttctatccaaggtgaccaccgtgttgaacactgtctaggaaatactgtgctcagggcaaaggatgctctctttttttcacatttttatacagctaagagaagtcatttctgaaaacaggacttggaggtcaacgtttacatatgatgccaccaaggacatctcctgatgatacccatgaaggagagaccattccgttagaaaacttgtgcagtaacatttaaaattggcatttgttaaccatactaataagagctaatattcctgtagcccttgctatataccagacattatgctataaatgctttatgtaaatatctcacttactcctctccaaagcctctgaggtatttttatcaccctaattttacaaaagaaaacactaagagtttaagtcccttgcccaagtacacacggaagcaagtgatggagccgagatttgtacccaggtatgtgacactggtctcctccccacctccaacagtgctaagaaagatcttctgcccacattgcattatgtgctgtacttttttcatgtaaatgatcattccaaatgtctacatcctggtgggtgagcggaggaggtgacaggaagaacaaaaaaaaaaatagacatgatgtcaagaaaggaattaattttcaagtgcacaatcactgctacccacagagtctgtctgtttggttttccataggtataaagagattactcagagtccataaggtggccatgccaggtctctcggggtcaagcagacaggccaagggtgtacccaggctctccttagctctctacatggctctgcctcatctgcttgcttggttcacccatgacatcagagaaacaaagttgggagcaatgctacttcaagcatatgccagttactaagggtaatttatggcaactctcattgccacgtgggctgagaagcacaacataataattaaaagactgataagcaatcactaatgaaatgcataggtattgttgaaaaatgcattttgagtccaagtaaaacaatgatgtgtgttctcccagtgcagaatctctgagctctgtaatcttaaaggcttttgcttttaaaatactatttcaaatgccagctattagtaacccatacatttgcaccctggtttcattgcaaaaatgaggaaggaccattgctttccaaaagaggcaacaaatagaattttttaaaaaacgcttctcttggaaaattttgatccgtttcaagtgatcttgtttagaagacccctacgccaagagtcctgccgggacagagttgtgttggcatcacttgactgctacctgtgtcgtctttgcctttgtgtatcgcaaagcctgttagaaacagctcatggaagcggggctcagaagacagaggtgtgtgctagaccctgccctacctttgttctctaacagggaagcataatgtcaaccaatctctagtcatctccctgacccatgtccctgactggcatacacacagggccacatgaaaccattccatggctcaggccagggtttcaagcatcaattacccttagtaacagcacatgcctgaagtagggttgctcccaacttaaatatttctctgatgtcatgggtgaaccaagccaagcagatgaggcagagtcatatagggagctcaggagagtttgagtatgccattggcctgtccacttgacccctgagtctaatgactcagcatggtctttggagttctaggatggcattatttacttctcctcttgcacagtccagaaagaacatttttccccactaaatgcacattcccaggagctccgacctccagtcaaaaaagtaaaagttgcttggtaagctcactgcctggggtcttctataccaggaagggcccaggcctagcactcatgttgtggcatcttcctcctgcactgtaggcagatgtcgctaattaactatgacatgttctcctgcagggcattaacagaatcttttagataccattaccaatcaatcagagttgctgcataacatggaaaacctattgctcatttcacttttcggctttagactaatgacccagggaaacttttcatggcagccctgagatggttcgatccatttcaagctaaggatgtgataatacgtgtatcttccagaatcttgactctttcaattaggagcatgaataacaaacttctagcattgaaataacatattctacggtaatcctctgactgatcaccttgttaataaatatctaaagaccgcatttttctctgagcttccaacttccatgggaacattctgattgtgatataatttttaaattagcgggtttattcatagatttgtgttagtaaatggcaagcttcttactaattagcaaattgtgtaaatccacagcagtattaattttcaactgtatggggaattaatataagacaaaataaataaggagacaattaaaatttccctagaggcatgcatttctataaaattcagcacaaaacaagaaaacattaacccattttgagggtgcatttagaaaagatcacaaaagatgtgtcagtgtcacagagaacaagtgaagcatgcatttgctgtggcacgcactctcagttacagctaaattccctaaagatattttctcaagttactgctgctgagatgtcccctcttgccttgatgcacttttccagcactttctcatttaataaggtttttattatttctttattgatgtttccactcaaattgctggtgtgctctctctcactttagaggacaatgcacagtataatgttctgatcctcaaaaactgccccacaagaggtctctcactaaccaagcgcttgctaatatccatttcacttttcccactaacccactgagaagatggaaagcatatgtatctctgggctcctgtttaacctcccagctctagaagatgagaaaaagcatgtccctcttacgggcacttacaccatttcttatgaagccatcccacacactgttaaacaaatctgattgtttctcaaactcccctttaactgcttcagcttattgctaagatgttggagtcttcctgtgttggtggccatggaaaccacctgtctatttaatggcatgaggtcttttctttacttttcctggcatgccaggctgttggggaaaggccagagccctaagtttaaacaagtcaagtacagatgtttaagaatgacagctcccaacagcttcagatcatagctaataccaaaattaaactgtaacatggtatgctctgatggggaaactgtgcacagtttctaagtacacaaacaagacagtacacagacaattgtaggttccatttgggggcaattttcttcccttatcatggctatcagtgatacaatctgctgcagaagaatgtggtgttaactaattagtataccatatagaagtgcctgtcttgtattatttacagtgcctgggacacactcctagtacagggcttctcataggcacagtaattatgcatttgcctctctgtcttacatattagataatgatctccttaagggctgggaatacggtcagagattgggattgcctatcagccccctcccaagcagacctaagcagccaggtggtaggcaagaacagcttcatgaatggctactaggcagttcccagtagtgcctggaaattctgtaagtaaattttaaacggcttggttcaggccaaaaccaaaatggatcttcctgttccctcaccccaggtctgcagtgacatactatcctgatctcctctttctgtttgaggttgaaaatggaaatgggaagaaccaggcaggccttatctggcctgcttgccatatggagactgatgggcagactgttcacaaccacaagcaggtaccacagaaagaggacagaatagagccggtcctttacttttaggtgagttttcctccactggcatgttgtcaccaggcaaggcagttgccatttctactgatgtaaggagacacacacacacacacacacacacacacacacacacacacacagagagagagagagtgtgtgtgtgtgtgtcaaggagaggtggggaggaagtgagtaggaagggacacagagccagggactaaagagaaaagtcccttcctgtgaaaagaataagataatattttcatttaccatccccatatacacagcagtgagcaaagtgccaggcaaataattgatacccaacaaacatcagctgaatgaacaaatggattcattcattgcacttttccatgtctctatctctagtatttaagatttttttaatgtatcttagaagagcctactgttgtacaccaaaccaaaccaaaacagcagaatgtcctaaagtactgacatatgtgtagaaattacacatcaaattaccaatcagatagacgctaaggtaggactgaaatgtgggccaaacccattttggaaacaaagaacaaagtcaatactcaaggtcaagctcttagacagctattcttccaaagcacctggaccccaagacacactcaacaaatttcaggtcatttcttctctcattaagccagttacaaccaagttatagaagtggagtccttacaagtcgctattgatagaataagagctagtcaaagaatgtttgagccatttttttcccagcctcagatgatggggagaaaaaaaaaacacctcaatcaaggatgtcaaaatgaaccaatctgcaatagtcatctgggcaggggacaggtgaatagcccaattcttctcacagaaatgaagaaaaagttcaggccattatccaggatgacttgaaaaggcaactcagtgactgagctttgtagttctgacaccattcaaatagaaatgggagccagagatagaaggactgacggctcattctcaggaatgtctgtgactatgcttagatgtgtcagtagacaacagcttcctaccaaatggtacaggctttggcagcctcttttttaaaaggccttttagtaactagtcaggcaccattcttaatatcaaaacattctctcttttttattgcccagactctgggaatctggaaaatgaaagaaaagaaaaaaaaagaaaagagagagaaagagagaaagaaaaagagaaagagagaaacagagagagagagagagaaagataattctgactcttcctaggtaaagttatgctttccagttaacttgatccactagttattacccgaaaacatgctttccctatgtttgagttctcattcatttattcaacatctactatgtgccagaccctgtgttagatgctagggatacaacggttaatgagaaaaagaaaatgtcttatcatggagctcattatttatctgtcttataattaatctatattactttatttaacaactacatacattaaacactgcccttttatggttacggaaagacagcagtgaacaaaacagacagtctctattctctgatccagggggaaaagactaaatgagttagtaacattttcagatagttaggagagctggaaaaacatacattgggataatgccattgagagtgagtgatggagtggcagcaggactgttgtttgagataaattggccaggtggcgtctccaagaagaaaagtctcacttgagactggtaaatgaagccagcaatccaggaagggtgtttgtcagggtggccagcttttccccactcctaggttttaagaggagtctgacactgactattattaggaaaataagttagttggcctacttggagggtataataccagccagcaccttaatattcaatgtgtggtctggggaataccagcatcagcatcacccaagagcttgttaggaatgcaaattctcagctccactccagatgtaattgatcaaaatctgcacttgacctgacccctaggtaattcatatgtgtattaagactttgagaagccctggagctagccaccttgagtaagacctaaagtcatgtccaccaagcctggcctctatcagtcattcctttgtttattttggaattcatttgagaaatttgaggacccaggcatagacaagggctgctatttattggaggtcctcaagatcctctaaataaagggaagaacaagtacaaagccctgatatgggccaggctgaattatgagtgaaatcaacagaaataaacgcaagccatttaaattttatccctataaaatggctagcctttggaagtttttaggcaagggagaagtaatatgttctacgtgaaactttggagcagtgactctgggtgctgcagagagagtggacaatagccaagcaagcatggagaaaccacacagttaagaagctacaaaggcgagcccgatgggaagcggtagggacttgagttggtgaggcagcagtgcacttattctggatatgtcttgggagaagagctaataatacttactgatgaatagaaatgtggggcagcagttaggaaagaggatggtcaaagaaccagtcagtgcaggcatacttcatttcactgcattttgctttactgtgcttctcagatattgcatttttagaccaactaataaccctacaatcgccttttaagtgttcaagtgaaaggaagtgtcacacatctctcactttaaatcaaaaagtagaaacgataaagcttagtaaagaaggcatgccagaagccaaagacaggccaaaagctaggcctcttgggccaaacagccacgctgtgaatgcaaaggacaagttattgaaggaaattaaaagtgctactccagtgaacacacaaacagtaagaaagtaaaacacttattgctgatagggagagtttgagtggtctggatagaagatcaaacaagccacaacattcccttaagccaaagcctaatccagagcaaggtcctaactctctccaattgtatgaagtctgagagaggtgaggaagctacagaaaacaagtctgaagctagcagagattggtcatgaggttcaaggaaagaagccatttccataatataaaatgtcgaggtgaagcagcaagtgctaatacagaagctgcagcaagttttccagaagagctggcaaagataatcaatgaagttgaccatattaaacaatagattttcgatagtgacaaaacagccttctattggaaggcgatgccatcaaggactgtcctagctagagaggagaagttagtgcctggcttcaaagcttcaatgaacaaactgaatctcttgttaggggctactgcagatggtgactttaagttgaagtcagtggtccttgagcattctgaaaatcctggatcccttaagaatgatactacatcaactctgcctgtgctctgtaaatggaacaacaaagccgggatgacagcacatctgtctgttgcatgatttactgaattttttaagccccctcttgagacctactgctcaggaaaaaacattcttttccaaatattactgcttactgatgatgtacctggtcacccaagggctctgatagagatgtacaaggagatgaatgttgttttcacacttgctaatacaatatctattctgcagcccacagatcaaggaggaattctgactttcaagtcttattaattaaatacattttgtaaggctataactgtcatggacagtgactcctctgatggatctgggcaaagtaaattgaaaacctggaaaggattcaccattctagaagccattaagaacattcataatgcatgggaggtcaacatgaacatagtttagaagaagttgattccagccctcatggatgactttgaggggttcaagacatcagtggtgaaaaaagcaggaaaactagaattagaagtaaagcctgaagacgtgactgtattgctgtaatctcatgatcaaacttgaacagatgagaaattgctttttatgggtgagcaaagaaagtgatttcttgagatgaaatcaactcctagtgaagatgatgtgaacattgtcgaaatgacaacaaagaatttggaccattataccaacttggttgataaaacaacagcactgtcaaagacgattaactctaattttaaaataagttctactatgagtaaaatgctattaaatagcattacattctacagagaaacctttcattaaaggaagaatcaatcagtatggcaaacttcatttttattgtaagaaatcgccacaaccacccaactttcagcaaccaccaccatgatcagtcagcagccatcaacattgaggcaagaccttcccatttttattgttcacattttttagcaataaagtatttttaattaaggtatgtacactttttaggaataatgatattgcatacttaatagactacagctaagtgtaaatatagcttgtatatgcattgggaaactaaaattcacatgactgatttattgcgatagtcactttttcacagtggtgtgtatctgaacccataatatctttgaggtatggctgtacccctacgaggcatggaggtgggcatactacccatgctgcccccaagcactatggctgaccccttgctgggctgatcccaaatacaaaatacaagaattcataaacaatacaacactttccgttaatggagaatgctataacacctagttcccacttctattcttcaccgttggattctaatagatgcctgttattcctttaaaaatatgagagcaatggatttcatttacaaaaaagggaaattagttacacaacaaaatgaatactcagaaaaatatttcaagcaaatagataaaagaccacttttaaaaatctgaatatccaagataacttgctctcgtaaaagtttgtgattggcaataagagacagattgaaaactgctagacttttcaaaaaaccagctcctggattcactgattttttgaagggttttttgtgtctctatttccttcagttccgctctgatcttagttatttcttgccttctgctagcttttgaatgtgtttgctcttgcttctctagttcttttaattgtgatgttagggtgtcaattttagatctttcctgctttctcttatgggcatttagtgctataaatttccctctacacactgctttgaatgtgtcccagagattctggtatgttgtgtctttgttctcattggtttcaaagaacatctttatttctgccttcatttttttatgtacccagtagtcattcaggagcacgttgttcagtttccatgtagttgagtggttttgagtgagtttcttaatcctgaattctagtttgattgccctgtggtctgagagtttgttttaatttctgttcttttacatttgctgaggagtgctttacttccaactaagtggtcaattttggaatcagtgcggtgcggtgctgagaagaatgtatattctgttgatttggggttgagagttctgtagatgatcaagtgggtttcatccctgggatgcaaggctggttcaacatacgcaaatcaataaacgtaatccagcatataaacagaaccaacgacaaaaaccacatgattatctcaatagatgcagaaaaggcctttgacaaaattcaacaacgcttcatgctaaaaactctcaataaatgaggtattgatgagacgtatctcaaaataataagagctatctatgaccaaccaacagccaatattatactgaatgggcaaaaactggaagcattccctttgaaaactggcacaagacagggatgccctctctcaccactcctattcaacatagtgttggaagctctggccagggcaatcaggcaggagaaggaaataaagggcattcagttaagaaaagaggaagtcaaattgtccctgtttgcagatgacatgattgtatatctagaaaaccccattgtctcagcccaaaatctccttaagctgataggcaacttcagcaaagtctcaagatacaaaatcaatgtgcaaaaatcacaagcattcttatacaccaacaacagacaaacagagagccaaatcatgagtgaactcccattcacaattgcttcaaagagaagaaaatacctaggaatccaacttacaagggatgtgaaggacctcttcaaggagaactacaaaccactgctcaaagaaataaaagaggatacaaacaaatggaagaacattccatgctcatgggtaggaagaatcaatatcgtgaaaatggccatactgcccaaggtaatttatagattcaatgtcatccccatcaagctaccaatgactttcttcacagaattggaaaaaactactttaaagttcttatggaaccaaaaaagagcccacactgccaagtcaatcctaagccaaaagaacaaagctggaggcatcacgctacctgacttcgaactatactacaaggctacagtaaccaaaacagcatggtactggtaccaaaacagagatatagatcaatggaacagaacagagccctcagaaataatgccacatatctacaaccatctgatctttgacaaacctgacaaaagaaacggggaaaggattctctatttaataaatggtgctgggaaaactggttagccatatatagaaagctgaaactggatcccttccttacaccttatacaaaaattaattcaagatggattaaagacttaaatgttagacctaaaaccataaaaaccctagaagaaaacctaggcaataccattcaggacataagtatgggcaaggacttcatgtccaaaacactaaaagcaatggcaacaaaagccaaaattgacaaatgggatctaattaaactaaagagcttctgcacagcaaaagaaactaccatcagagtgaacaggccacctacagaatgggagaaaatttttgcagtctacccatctgacaaagggctaatatccagaatctacaatgaactcaaacaaatctacaagaaaaaaacaaacagtcccagcaaaaagtgggtgaaggatatgaacagacacttctcaaaagaagacatttatgcagccaaaagacacgtgaaaaaaacgctcatcatcactggccatcagagaaatgcaaaacaaatccgcaatgagataccatctctcaccagttagaatggcaatcattaaaaagtcaggaaacaacaggtgctggagaggatgtggagaaataggaacactttacagtgttggtgggactgtaaactagttcaaccattgtggaagtcagtgtggcaattcctcagggatcttgaactagaaatgccatttggcccagcaatcccattactgagtatatacccaaaggattataaatcatgctgctataaagacacatgcacacacatgtttattgcggcactactcacaatagcaaagacttggaactgacccacatgtccaacaatgatagactggattaacaaaatgtggcacacatacaccatggaatactatgcagccataaaaaatgatgagttcatatcctttatagggacatggatgaagctggaaaccatcattctcagcaaactatcacaaggacaaaaaaccaaataccgcgtgttctcactcataggtgggaattgaacaatgagaacacatggacacaggaaggggaacatcacacaccagggcctgttgtggggtggagggaggggggagggatagcattaggagatatacctaatgttaaatcacgagttgatgggtgcagcacaccaacatggcacatgtatacatatgtaactaacctgtacattctgcacatgtaccctgaaacttaaagtataataaaaattaaaaaaaaagaaaagaaaacttctagacttcccaacactttgagaaacagttgccacctaactactaaagcaaaatgaactaaacctaccactggaactcaacctttaggcattttaaaaggccatttttaatgaattccctttcagctcttagtcaagctcatctttttgaattcgatctttatttttaacaggagcacatacttaaagaggtagaaggtatgaagaggtcagcagtgatcatctttacttataagagacaaagcattcctcttggaaaagtcaccataccattttggggacttaaactttgaatattttttcaagaaaacacatttatgacaattcattatgctagagattctttttttttttttcctttcaaaaatattttccattttatgtcttctaaggctgatgaaaacaggccttccaactctgggcttgccttattgcctgtctgtggctgaaacccaaacattttcctattacagtttaagtgtttttatgtatgttttatacccaaattcagtaaaggtttgacatagaccaaggtaacatttcaggcagtatctttaaaatagaaatctattttcagattccaggatgtagaacagttggttttgaatttataactttgataccagcattttcctctttaattgtacttctaaggatacctcctggccaccaaaggacactggcgtggtttatttcagtactgtgataaagtgattgagaactgagattttattcccaaagaggctaactcctttatcttattctaaagccaattattttgcaaattagatccactgcttacatagtatgacatgtgaatagatgtaaggaaatccatcactactactccaagcatatgcctactgagtaatgagttagcaggatcaccttcatgtttgaagacaccaggacgatatagtagaggagaacgtaagctctagtgtcagaacgcctgggttcttattccatctggctagctaggagactttgggcaagtccctcccctacatctcagtttccccatttatactcaatggcagtacttcccaaattagtcacctcatatttagagatatttatttattaatactatatatatatatatatatatatatatatattttttttttttttagacagagttttgctattgtcacccaggctggagtgcaacggcacaatctcggctcactgcaaccttcgcctcacaggttcaagtgattctcctgcctcatatatagctgctttattgagatgtaattcacatatcatacaattcacccattgatgtaattcacccaaatgatacaattcaatggtttttaatctatttacccagtggtacaatcattactacaatcaattctagaatgttttcatcactgcctagggatctttaaaaattccaaagcccagactatgccacaaatcaattatatcacagtctatggcggtgggacacagacatcagtagtttgcgaagctccccaggtaattccattgcacagatatgtttgggaagccatgctgcactggaatcactgtcagagtttcagggaaaataaacacagaaataaagaaagaggagatgttcagcagagagactgtcctatgataacataagcacagaagtggtggtgagaataatcatactgaggacgaatttaatgggaaagactatttaaagaattacactgcaacttttataatcgggactaaaatagcaatttttttactcgttggtaatacatctccaggcacagcatcctctgagagtatgtataagttgggaataagagtgttgaggtaggaaagggatcaggaggagataagaacctgtaacttatctaacacatttcaagacattaccaagcttcttggccttctaaaaagctcctggttagccttacaggatgccactgaagtgccacccctttgtgaaatcttttcccactgaagtcacagtttgatgcttcttaaagctctgcgtttggcataatacagcaattatcacccagagtcatatacttcagaagttggtcaccttcaccagggcaagagttctttgaaggcagaaacaatacttagtacattaaaaaattaaaaaaaaaaaaaaaaaactatctcaagagcctagcgcatgttatggcacagtgttgacaaatatttgttggactgaaccaaagcaaattcacatccactactgtcaacacaaaaatgaaaaaaaaatagtgcactagttccaaagttcccagaacacttaggggccattgtagctctcagaagactggcaagcaagacctgcaattttactctataagggacattgtaagagcaaagcttggggtacttaataactccactaaataaatggcacaaccacaagctgttattaggaacactgaatagaggctgggcacagtggctctcacctgtaatcccagcactttgggaggccgaggcaggtagatcacatgaggtcaggtgttcgagaccagcctggccaacacggtgacatcccatctccccgtctctactaaaaatacaaaaattagccaggcttggtgatgtgcgcctgtaatcccagctactcgggagactgaggcaggagaatcacttgaacctggtaagcagaggtggcagtgagctgagattgcatcactgcactccagcctgggcaacagggcaagactccatcgcaaaaaaaaaaaaaaaaaaaaaaaaaaaagaacaatgaatgacgtattaccaacactgagatcaagaaaaaaaattgccatccaggggaaaaagattaattaatatcaattaattttcttttacaggagtagattatacagaagtctttaggcttctgaggagaatttgagaaaattttacagtaaacaggaatttgcatacgctctgggagcaaaaagtgtgtccccagacaggtcacctggggtatgttcaagatgaagaacaaaagtcgggcatttctctaagtgtagagtcaggagggtgcaaataaaggcaggctttagagggaatagagaaacttttggattcaaaagaaatacaattatcattacaatagagctacatggttacacaataagcaatactattaagcaccctctctggaaagagtgttctttgaaaaacaaaatgcagaacagatccaaaagcaaggtaacaaaagctattaggtgaagtccatcagaggaagaattctctttccatagcatcttccttcaagtacaagataattatgttttatttatggcacaggaatagaatatgagattcaccattcaataaactcaggaaaatcatttctttggtcattgctttttatttataaaatgacggcttggatcaaggtagtgtttcccaaggttttctttctttcttttttttgggggggaagatttaacaggcattacttgaagaaacttagagtcaatagattctaaattatggtcacttgaaaccagcaccacaagattacccatcaagacctaatcaaccaaattaacaattagtatttgggcagaaagttgatgcaatatctccaatatcaaggcagtacagactgctttgaaactgatattcttctctgtgcatgcatatacacacacagacacacacacactcatacacacatatatttataattccttctaaatatttgaatgttcatatatataattctttctttttaattactccaagctgagcatgtgtaggttagattcactctgttttataatatttattgtgtttatagaatatgtccatcacatcctagcccctaggcatgtttacaaataagataggaaaaaaagagactgttgataacataatggctaaaaatccacagccaatattttcagaaagatcacacaaatgcacatacatgcatacacacacagacacacacacactctatctacagatcatcctggtatccaatgtgaattccatcagtattctcagtgcaaaccacaccctgtggtttcttttcctactccctacacaacttctgccatcttgagtcttaaaatataaaacaaaaaaatatatggtccattgatggaaaggatagaaggctttagatgggagacagggtcagattcatcacatcatttcttttgacagcctagcacaggggttaatgttggctggggagatggaaaaaggaaagaggtaatgggagcagacctgggaccagttggtcagcaactcgcagagttctttaatcaccaacaacctccctgtactgaggcaacatgctgctaaatgctcaacatacagcatttcgtttcatcctcttgatgtccctacaaggtagttcctattatttccatatttcacttgataaaactgaggcccaagttacaaaatatcccaagttacaaagctactaagtggcaggctcaggacctgcacccaggtcttcccaaggccaaagtttagactcttcaccagaactgcttggctttttgctagaaagcctggggtcaggaaggttaaccattcacaaagagctcagaagtggcaaggcctggatggaatgcaatcatgaggacaacatggggcactgtccataactgtgtgatattgcactttccctgatcaaacgtcccctctgagggtgtcctagggacatttgagaccatttccctctgacacatcccttcttctgcagaagcacccatctcctttagaatttgaatttctgctaaaaagtagatgctttcctcacaaatgtcccctcctcctgtattctttctcctcttggatctccaaactaaaaactgtagtgggtatagaaaggagagtctcaagtgctgtgaaaatctttctagaggactttcatcccttcccaacagcctgcaatgtggacttctgtcccctcagtaacaaaccgtacatgtccttcctgaactgagaacgaacctgcagcatccagagcagctctaagaagcaggagaagacaaaaaaggcatgcagctccctgctgctctcaggaaaggggagagaagcgcagctgcctccgttcaaggctgggtgagagtgatgagtcaaatgactgtcatcatttggattctgacatttcttcctctacagagaaaacgaaagagtctgctattggtgatcattcattctgcgttcatttatgtcttgtgtactttttttttttatttttcgagatggagtcttgctctgtcacccaggctggggcgcagtgacgtgatctcagctcactataacctctgcctcccaggttcaagtgattatcctgcctcagcctcctgagtagctggaattacaggcaagcaccaccacacctggataatttttgtacttttagtagagacagcatttcaccatgttggccaggctggtcttgaactcctgacctcaagcgatccacccgcctcagcctcccaaagtgctggcattacagacgggagccaccacgtctggttagtattatgtacttctgactattgtgttctactttccgatttaaacaatgatcccagcagctatgggagctacaaagagccaggagtttggaagcttttcaagacactgtgagccctctccttttatcctgacttctttctcactttctgccttttcttgaagaacaagaaaagcaactccagtggaaaccacttaagcctgcaatttagctcacaaattgtccccagcatccttgtatctccttctccaactccttttttttttttttaaccttagctcttcctgatgattgtgagcatagctcagagtaatgccaactgttgctgtatcagcttaaatcagtgtggtacctggtgatggggcacagttgaggcaggcactacgagcttagacgagccttcagccccaactgaaagggatatattgtggagcactcacgcattctatagccccctcctaatccctcaagaatcccaggctgggaatggctgcaacttcaggattgtaaagttgtgtaaacacatctttacattgactacatcatggtccaacgtaacactttgaaacaaagggcttgagtgtgtccctgtaccccttcattcctgagttaaaaacaaagctccatcagtcgactcatatttatagagtgctccctgctcatctcctttcagtccttccgcttgccagggtaagaaaatttagtgcagacgatcccagccttcccagacttccctcctccttcctgacagaattagttgttgccccccaccccccatgttttatcatagccctttgcacactgtgttccccttatttatatgcttgtctctccagttgactctgagcttcttgaggttgggaacatcgtttgtgcctgtcacatctttatgggcccaagaatagagatgataggcaaaagtggagtaaagaataaaggaagaataaacatttttaaaatcagtctccaaagagttttccttctggcaggtaagacaaggcatacagtgagacatgaggcaaggcagtaagtaataagggtcagaataaaaaggaaaaagaaagcgactgttggacttggctgagtaggttgatagcaagctagtaagaaacatgagtaggtatcaaatagacacaggtgcaaaaacagggctgagaaaggtatgtcggaagggatgtctagttccaaagtgtgctgagattaaggaattagaaatgtaagctgagctccagatactggaagacttttagtatcaaacaaacaattccatttttttcttttgtctaaacattagagatgggtacacaaagaatatttacctggttggaatgtccagaaggactgtagtggactggaactcatggaagggagacccaatggaaactgtagaaacaggcttacacaatagcagaggaaacccttaatagttattttaatcaaataagattttcatttaaaagaatgaaagaattaagaagaccacagtataaaatgtaaggaataaagtttatagagagcaactggcatcggagacagaattcacaggtcagaagagaacttacaaacataagttccagttcttggagagatgcaagaacatactgctcctataagttaagaacaggttgtttgttcatcagaaaatagaattttatgccttacggttcacatgaagagttgtgaatgaaagtatgagcagtgcaaaggaacaatgagggatgccgggacaccaaagactagcaacgggaggaagccatgactaccacaactgctgaaaggacaagggcaaaacagcattactcaaagccactggcagccacagtcacggaggccaagatgactggtgggagatgtagttgcagaaggacacagttactatcgtctggcaaataaaggagggaatgagtatactcacctccttctcttcacaccctgtaaacttacactaatgcctcccattgagcaaacaccagggaggaagtccaggagacgcaagacagagacgggtagaagttgaacctcaggcaaaacaaagattacccaacacaaggctgtataaaaaaggaaaaaatcagtttaagaggcaagagcgtcattggaaattaagaatatgattggtaaaatttttttaaaaaatacaagaaatggaaggcaaggcaccaaacatttcctaggacaaaaagataaggaggtggaaaatatgagagaaacgtcaggaagcacagaagaggggtcccagagagagctctgagtttaataaacaccaagggtatggtgtctgcaaatgctccagggaaaaacacaagcaaaaggaaagaaatgcaacctgaaaattctttaggattcaataacacgtaatgataaaacagtttctttgccccgagtccttggagcataaaaaaatctgggacaatccgttcccttaccacatcagaaaagcaactttttgtttcgaaaggtctgtggtgaaacacaattccatgacgttaatcaatttatttcaattgggagtgaagcataaatgaaaagttcctatttcagaacagaccgtgaaaatgtgaagatgttattatttccaagctaaaaggagatgtgagattctctgcctggcacatttcagaaaggtacaatcagccggggcaggggaatagatttaaaatagaaaagtaatgggaaaagtgctttccatgtaacagacagggtggtggatgaaaacctatccccctaaagcccactttattaatatacattttactaggcactttggaaagtttgaaaatccacatgcttctcatttcccatagcttctgggtctaattacatatttgcatccatttgcatacacacacacacacacacacacacacacacaggtctcatccagtgatatagataattcaatattcaacttgtcgatcatcaccttaaaatagagatctaattatggaaaaaaattgtatgctgtttttcaaataaataaaaaggaggacactgattaaaaatataacacccctcattgatcaacaggtacctttttggttttaacctatcataaacatgaggtttggtactacatggttctggccctcccaaattaacactgagctagttcagggaacaagctctcacataccaaattctgaagctgcctttcagcagcaatttgagggaccaagaacataggctttccaaatgtctagaagctaaccagattcctctctccttaatttagccccttacattaggtgccccatgctctcttttgggtcaaaaataacagggacaatttaataccctatgactgtccattaaatatctgaattatgaggattcagatgtaaagtgcaatagtattttaataaaagtacactaaataaggaagctggtaatagacctcttaacgaaaacgtagtcaatggttcatttaatttgatggcagagtccactttcaaataatcccaaaagtgtatattttgtaagaaaaaggttgcagagttcacctcagggtattcttaaaaaattgtttgcacactgagaagacatcagtgctaagaggctttcctgattactgaaatttggttggaagtcttttttatttctattaaatgaatatatacaaccgttcggctgcctcaggacatttatgaaaatgagatgctctgtcttaaggaagttagctttaagagcgacatttgaatcattagatgcctcattggctgttacaaaaacaaacttcaatcttctgcttccccttttctaatattagctaacaataattaagttgcttagacaattccaggtgactcaaatttcatagcacgctcttcaaaaggctaagggatcactttaagttcctaaagccctaagactaagtgtgtttcactcactttgtgtagctccagcccagcatcatgtaccaaagggataacatgattaaaaatcatcaacttgtcttccgaaatctgtttctaaaccacagcacaaggaacagacatttaaatacagaaagggatggagaactacaatcttttaaaagtgcacactttagtgcccagtgtggtggctcacacctgtaatcccagcactttgggaggccgaggtgggtggatcacaaggtcaagatattgagaccatcctggccaacatggtgaatccctgtctctactaaaaatacaaaaattagctgagtatggtggtgtgcacttgtagtcccagctactcaggaggctgacgcaggagaatcacttgaacctgggaggcagaggttgcagtgagccgagatctcaccactgcactctggcctgggcgaaagagcatgactccatctacaaaacacacacacacacacacacacacacacacacacacgataaatattcacatcatctgcctttggttattcaacctatagtttatcatgggaaacaagatcttattcttataaagtacctgcatattttcatttgctagaaattaaccaattcagcttatatcatatgtggcacaaggttttgtcatgaggaggacatttaaagaataatttaaaagaaaacaagttcaaacgttcacataaaacaaaatagccatctctaaggagaaaatgggtattgctgatcctaatgttaatattctaaaataaatgaaacatttttgaagggagtattcaccaccacagctaaagaaagccacaaaaattagtgtatatgtgcctatatttatataggtacatttcccaattttattcttttactattacagatagctaattcctaggaaacattttctagatgtcttcttttatataccatgtctttggacattaattacaggcaaagaaagtaaacactcacaagaaaaagggaattttacaatctgatcttcaatgttatctcaagaaatgctgttatagctccttggttctggtttccatgcacctgcaaattgtcctttcacccatcacttgtaagtagtagaggagcaagcatacctgtacagtcatgcattgcttaacaatgagaagttctgagaaatgcatcattaggcaattttgtcatagcacaaacatcataagagtgcacttacacaaacctagataggtatagcccactatacacataggctatacgctatatgctatatgctgtaacctattgcttttaggcaacaattctttactgcatgttaacatactgaatactgtagataactgtaacacaagtatatttgtgtatctaaatatagaaaaggtacagtaaaaatatattataatcttatgaaacctcagttgtatgtgtactctaccactgatcaaaatgtcattatgtggtgcatgactgtatgtgaacatttcttgatcataaaaataaagtgtatgttgacttagttagtgccctggcaagttaatatgtatgttgacaaactataatgcttaacatgagtatggttaaaataacactatgtgaatatataaacacatgtctatacatatacacatatatacctatatatacacacacatataaatatatacatgcttataaattacagtctgtcttacattagctaaactattactacagtttgagataaatttgagatgttacaattggaaatctcctgtttcaatttgagaagggaaaatgttggcatattctcctgagtggagaaagaggctttctatgtcagcagatacttcagaggaacgttaatgtctcgaggtttctagcaaattaacagcccaggtaacaaaatgcagggaactctggccagttgcttacttactcagttggatctggccacttctccatgtattcccaccacactaaatggagcatgagtcatttgagtaatgagtcagaaaatgtctagcagcctccgtgcaatagcagacgtgatgcttaagataaatttcagagatactaggatggtgtttttcatgtctgcacatctctcattggtgatgaataaaattccttctcccttcccaagagacaaaaactgtatcatatgctatcctgaggctcgttccaactctaaaatttaaaatttcaagcaaaacctatagaaagaggcaaatacagtgtataaatgtctacaatttgtgtcctattcaaaattagtttttgtggaatgttgtctaatggattcagtggtcacgttaatgacaacttcactcccaagtactacatgccctgttaaagaaaaaatgcttaagtgaacaaaaaatttaaacaaattttggagttcagtgaaattaatgaataatctctttttcaatcatccctgattttttaaaatcacaatacctaaattatgatgataggaattactactagactttgagttttaatcccagtaacatctttagctgatttaaacctatttcaacttccattttaatatttcatctcattttatctgtatggttaatattaatttcctttttgcaccttctggttgtagcacaaagccagctatacaatagttgtgtgctgctgaatggaatttgaaggcaatataaaataatgtacagcatcactgaactggggattaaaaatcccaagtttgagtactgtcttggcaatgcactgcctttgtcactcaggtaagtcacttcttccttacaaaagtttcttccattacaggtttcacctctcatgacaattcctatcaattagttgaggctgtctggagtaattaggcaggacgctggtgggatggagtgccatgattgatgagtgatgcctgccaagggtgtatgacagcgaagtggtagcaattttgtcctgtacttggcaattgtagattagaacagggctgctcaaatgtgcatctatcaccaggaagcttttaaaatgcagattctgattaagtctggggcggtggctgagattgcatagttctaataggattccaggtggtgctgatgctgcggagttagagagtacacaagaagcaaggcaaagtcccttgcagctctgaatgaatatggaatctcaacctctcattctctcttgctcactcgcacacacattatttctactttatgtatgtgaaaaggtgcttacatatgccaagaatactgacaagcacattaaatacgtaattctcatcctcccccacaaaaggtagttagaagttttcaggtaagaaaatggagatttaaagagggtaagtaatttgtctaacatcacagagctgacaagtagtctagatgagagatgaacctagagaacttaattctagtaccttgctcttgacctctatcatatgctgtcttgatactgtaacaacattagactgcttacttagtgccagccactaggctgttttgtacatattatctcctctacttttcttaagaactctaggaggtaggtaatatttttgttttacagataacaaaattaattatccttccactgtctcaatctcggtaaaaccatagtgattcctattaagtaaaacattagattcatatctataatgaactaaacacaaagaacagtaggctaataaaagcaacatgtatatgcataaggctaagagtaaatatataaaaatattcttttataaattcatcctatgtaaatgcatttttgacaggtaaactcaaatgtttctgcagagtttagtgatgaggttatcaaagtccaagtgattattggtcccaaacagaatccatcagtgggatttacagtgggagaagtatcaaagattcttttttcatcatactcttttactacctaaaagttctttattagcaagcaaatgaaataagattggatcagtaaatttccctggagatgagatttcaatataagcaggtgacagtggatgctgcaccgatgcacacttaagaagagcaaacaccattgcaatgtgagggcaggatttttgctttactttgtttaaaaaaacaaaagtgtgcttcaaaacctaagggtctgaagcagtgattctcaaccttggctggaggctgcactttggaatcaagtgtgtagaggggacttaaaaaatactgatgcctagatcccctagagattctgatttatttggactggggtgcaaccgagacatcaggatatttttaagcttcttagtttttaaatgtataaccaaggttgagaatcatttgaatataggcatacctgtcccatgtggggggcgactagtcattaaaggcatgaatgtctaattgatgaatgccctcgtcagagcagactggtggcattcagagagcagcaaagactttctcccttgaagttaagcttaaatttcataagtaagtctattttaacagaaaattttataaaacatttgtagatagtctgaactacgaaaatcattttctccccttaccagaattatttccactggagggcagtctcctcttgggaagaaatgaatgcggatacaaccttcttaacagaccaaagtttaaaatattgactaagactgtggcattcacatgggtttcatttcaagacaatttctgggagatggagtatttgggataaaaaaaaatgtgtattctatgtgaagatactgccaaattaaaggtttatttctgtctgctaaaactaaaaggataaaagcttaacccaaaagataaacacatccacatatggaagaccctggggtgtacaaacataacaacaacaaatagaaagtagcatttattataggtttactgtgtgtcagatcctgtactaagcaatttaaatatcctacttgattctcagaacaaatctatattttataggtaagaaaactaaagctgagaagtgttcaaagaaatgtgtccaataccacatatcaaaaaagtagctgagctaggacttgaaccctatctgcctgacttcaaaaccagcccttgcaatcaccaatgataccgctttactgcttgagtgagaagcaacatggtccctatgcgtaagacaagcgtctaaatcagaacatgtcaacacaagaaaacaggaggaaaaaactctctttacacagcattaggtaatgaaagaaactgaaaggaggtgattcgggcagaatgagaaattccttattctccttactggttttatattttaacagttttcacaaactgtttttggttcctcttcatttcttatgcaaaccctttccaatccattaaaaataaatttggcattcccattgctatgtcttcagccgctgtacagaaccttggactagctggtcatattcctcagagacttatttcctagatcaggggttgtcaaacgttttctgtaaagagctggatagtaaatatttcaggttcttcaggccccacggtcttggctgcaactactcaattctgccagtgtagcatgaaagcagccagagatgatgtgaggatatagatgacagacgatatgaacaaaaagggcaagactggattccaataaaactttatttatggtcactaaaacttgagtttcacatcattttcatgtgtcaccaattattattcttctttctattctttttcaaccattcaaaaatgtaaaagttatctttagcttatgagccacataaaaacatgctgtggcctggattcagtgggcaggtggtaatttgccaatccccgtcctgaataaggtgtcctgtattcatttgccataacgcaaaggtcttgtcacaaagatatctagcaatggctccatgctcaaagagcaaatgtatccccagataccatcagctagtatttcagaatcagctgccttcccccaaaccactttttgctattgtatacaaattctctcagtagtaaaagtatcccagttaaatcacatcagcactctgggaaatattcttcttggggaaatattacagaatctggaatctgaaaatgatccagaaggtcacagagggctgtcatttcccaaaggcattctccagagcctccaagctcctcacagctgcagatacaggtataggtacagttccttagagaaaatagctccacagaatgaccaggacctaagaaagctcttagcaggggtgtgctagagccatctcctatcagctcatagaagaactcattatatttttcagcattttgtgagccagttgacatgagttgataacctgaaattggccatggtgggagcatcagcaccacagaaattcagaaatgtgtattcacaagtgttacaaattaggctttttttcccctctgagagcaattgttaaacattggccagcatacctctatccattacccctttccaacagacaaactcctcttagatctgttttacacatacacacatacaacccttgtgagctgcggtggcggtggcagtaactgtgggttcagggaaaggaaagaatttccccaagtaataaacaaatgtatttaggattaatcaccattttagatcatccttgagttactactccctttggaatcccaaatgcattccccttttatattaaatatggtcaactggagactaaggagttcaatcatttttgcataggatcagaaatttatcagaatcttttatcttcaattatcttctgtaattttatgtgttcatctaacatggacaaaaggaaagaagttacaaagtcctgcactgcattgtacaactgtgatccaagaggtgccattttcacttctgcatcatgctaattatccatgagcctattcccttttttatttttgctactactgaatgaagatccttacaatgtaatatctagcaatgttctaatgttcctgaactatatattatttgtttttaagcaagaggctctctgattatttctggttcctggtctcactccactaaactacatgagcccataaacctaatctaaacaaatcattttgaatttattttttctgcatttgctgccttcatcttagttttgcatcacttcaggcatcaacaaaactattttaatacaatcctttccctctacttctgcaagattagaaaataaaagagaacatttatagctactaggtgagctggaatatctaaaaagggattatatccctccctatttgtcaataaatatgacaatagttcatgtgagagtaagctgaagctgagtggcctataactaattctgaaaatttctaagctttagaaaaggatatccaggacttgaatgctcctgaaacgatacaacacattcatgcgtaatcagagatacgtagattcaaataaatctacctctacaatcttcagaaagcaatttttggagtcagacacaggtgcattttgttagagtttactgaaactctttacattgtaaagctgtagtggtagtcacccttaagttattcatagacaatttcaattatttattcatagactcacatgatgttatttttcattcagatccaaagcttgttacacattctgcaacaaaatatttaatgaaattccaagacttaaaaaatcttgcagtgaaagcaagaaagacctatcaatactgagtcaacagagtggacctaccaattcaaccaggcttggtacccaaaggcacaactcaacataaagttaacatttcactatgtaaattctaactccagtttctttttgaaacacaccttccggtcatctatttttccttcttgatctgttcataagtcataggacagaatcaattacctaggaccctttcattgtcaatgaaaatatatttcccaaagtgggttctgtgaaacactattataggcattattacagttgttttactattttttttaattccagatttggataaatttgggagatgtgggttttcactccttggggacttctcagagcccttagtatattaatgtacatcagaactctccaagtagggcattagaacatacagtattatccatacattttaaaacaaaagaattttcttctcatggagaatctcattggactagtatcccacgaagcacactttcaagaatgctggtttataagacacagctgagatttgcatataggcaccaaaagtggaaccacagagaaagggggaaatcatctgagatccctctcacatgagcacactggctgcagtaaaatgagcaatagaaactgctgagttcttttacatctatttccagatcctgtcaaaatgaataaataaaggtaagcagggtaggaggacagcaatcctgtgaaataacctccccccagtctatttgatagtttccatgacttgatcattgactcatcaaaatagacagatgtgctcttatccagcaaagtttaaagttagagataaaaacaacaacaaaaacctgagcttcaccttcagcaaagaagtgtcagctggagactttagaaattcaaagaggtaaaaacagaactatcattcaacccagaaatccccttactggatataaacccagagaaatataaatcattctaccataaagacacatgcacaagtatgttcactgcagcactattcacaaaagcaaagacatggaatcaacctaaatgcccagcaatgatagactgaataaagaaaatgttgtatatatacaccatggaatactatgcagccataaaaaaagaacaagatcacgtcttttgcagaaatgtggatagagctggaggccattatacttagaaaaccaaagcaagaacagaaaaccaaatactgcatgagcttactcataactaggtgctaaatgatgaaaactcatggatacaaagaggcgaacaatagacaatgggacctgcttgagggcagagggttggaggagaaagaggagcaaaaaaaataactattaggtactatgcctagtacctgggtgatgaaataaactgtacaataaacccacatgacatgagtttacctatgtaacaaacctgcacctgtacccctgaacctaaaataaaaattttaaaaaattcaaacatcctgcctaggattacaaatttattaaaaaattatttccttccatctaagctctctatcagaaaagtaatcatggaaccaacccaaatgcccatcaataacagactagataaagaaaaagtagtatatatacaccacggaatactatgcagccaaaaaaggaatgagataatgtcatttgcagggacgtggatgaagctggaaaccatcatcttcagcaaactaacacaggaacagaaaaccagacacgacatgttctcactcataagtgggagctgaacaatgagaacacatgaacactgggaggggaacatcacacactggggccagttggcgggtggggagcaagggaagagagagcattaggacaaatagctaatatatgcagggcttaaaacctagatgatgggttggtaggttcagtaaaccaccatggcacacatatgtaacatgtaacaaacctgcttgttctttacttgtatgctggaacttaaaataaaatttaaaaaaaactcaaaaagagaaaaaagtaatcacctgatattcaccgggataaagaaaggaatttagagaaatgtcttttgtccctacagttgaggcgtaaaacctgacagtgaggatgaaggcccttagaagccacgcagttccactaacaagcccatgtagttatttctacctccattacctgctgctttattaatataattaaccactatttattgagcttctgctaatgccaggcactatgctaggctgtatgcctatatttttattttatcctctgaccatggtaacatcggttgtcttattatcctgatttcacagacttggcacagagaagttccgtctcatgtcaaagatcacacagcctggctggggtagaatctgtatcaggaggcaagtctgcctgactccaaagatcatgcaatgccccttctccttttttttttcccttccaccactcttctgtcatgccttttccctagctattaccatttaaaagcagttgtgattaaaaacaaaggtcagctgtccataacttaactcaaatgttctttcttccttgctcttagagacaaattaccatcttccatcattcacgtggaccaagaaggatttaggctgagatgattatgcataataatctgggtctcattacaagctgagcacttggaagggccattctctcagcccttaaggcagctgaacttgatcatattttcattttcttttctccctatatccactaaagatcaactgacacagaacaaatgaagttactaacaatttactgatttctttaaaatatatatcttcaataaaggaagaacaaacagtcaaatgactgaaatctaagtacggaatgtgaaaaatgccactctctaaaattctcaaaggaagagaagaaaataaagaggggaaggagaaagagaggggaaggagaaagggagaaaaagaatcgaaggagggagagaggaatggaaggagggaaggaagggtatagagatcatctgcattagaatcttctcaggctgggggtccctgagcccactccagaccaactgattcagaacctctggggtgggatccaagactgcatttgcacacactcctctcgtgactataatttttttaattcatttatttttgagacagggtcttgctctgttgcctaggctggagtgcggtagcatgatcatggctcactacagcctcaacctctcaagctcaagtgatcctcttggcctcagcttcccaaagtgttgggattacaggtgtgagccatcatgcctgtcctggtgattgtaatttacaccagattcaccttaccctaagaagtgacttgtatatgtgttgcttatggaagtcagaagtttcccaagtttaagaattcagcatttagctccaggaaaaattggtcataaatatgatgatgacacatatgtgagacaatgactgcatgagtccaggaaagaataaagacattctcctgagaaagactcctcgttggagcctatgggttctaccgggcaggtgactcacccgttggagtcacaggtgactcagcaacagggttatgtaacaagaccaccttccttggtgctaattttagatttaaatagagaaactatttgaatgtcaaattaacctttttatatagagagagaaaaagtataacccaatgtaagcacaaggtaataagcacagggcaacacattcaaacagatgcaaagcacgtggagtgaaaagtgagttttccttccaggcccaaccacttctttctggcacttcagaaacacactttgtagaaccaatcacttgtatttgtgtgaactcctccctgttaatacaaagggaggaagcccattatacacacagttctctccttcacttttcccagaataacatatcctggaggccattctccacagtacatacacatttacatcgttcttttgaacatcatcacagtccatgtatttgaccagttcactttaataaacatttagactttttctaatcctttgctaatagaaatgatgctataaggaacactcttcttcatatggctttgtccacgtcgggggatatatttttaagataactctgtggaagcaaaatggcaagggcaaaggatacaggcacttttgagatattgccaaattttccctcccaggaagttgtagcaatttaaacttctattaatagtatatgatactacttgtttcccccacaccttcaccaaagcagtatatttttgattgtgatttaatttgccacttcgacttcttactggagaaagtgctgaccagcaaacatgaatgtaacttggcagctatatttctcctggagaatgaatacattggcattctaatttatcatcttcttatgcattaggtaagtatgaatctgtggccttgaccctcttcaactctgggtaaatttacaaactttagtttctgggcctgctaacacaggtgaacagtgatgcctccaagagaggacacatctacaagactgctggaaggagtcctcttttaattttactcttccaagttttaaaaataaattgcaaaataatttttctctaataagttaacgatttaaaattgtaattcaattagaaatttttttaaatattatgaaccaaatttttcttgctcaagtctgcaagaagggaggaactctgtggaacgcttcagatcagaccaccttggcggacatcaaagatctaattcaaatgacatctactcacagactcagtggtctgcttcatggattcaaaagttaatcaaaattcatactacaaatgctgttactaatcgccacagcagcaaactagaacccctccttgcccaccacttttacactccacccccagagaataacagacaacatgctgtttcttccagtaattcttaggatgttattgatgtattgtttatttttcatagagtccatgcacttaggaggaaacagggcataatatatatgcactttcagaaaactgttttaatgttataaataatatccaaaaccattaatgagttttagaggtggctgccttgcagcggggaattacttaagcactggaaagccaatcaacaaatatttattttgcaacttctgtgtgcatgcctaaaaaatcttattccattagtaaaataagtccatctagaaaaatacattaattcaacgcatatttactccacactcacatgttgcaccacagctccaagtgtgaatgaggcagagaccctgcactcgagttaggaagacacagccaactgaactgatgacttaaacgcaaagggacagagcacaggctatggcaggattacagaaaaagggctcctcatcaagccttgagggaatcagggaaggcttccaggaggaagcaaactgatatgatttccaagaaggattcatccaggggggaaaaatggacagaattagggaaatactattgcttaatcatagaagttcacctaaaccccatgaaagtcagcaatagtaccgtttctacctgaaatacagtcagcccaggattagaatatgttcagctctcatgtcataaaatccctaaagaactttctgaaaagctaagcccactgataagaataaaggaaaagcatagcaccccacaaactaaaacatattttccattacaaatacattttcaccaactctgaaaaaccaagtggacatttaacagatcctagaagactttgctccctaattgcctcccaataaccctcactctcattaaactacagcatgaccctctagtttggaggcccaccttctctttactcaaaaatttccaaacctaatgagagatagtcttagagaaagatgatggacttaacagactgagacgtattttccttccttggtgtttacattatttgacagcaaggagccccagagcaggagctagttccaagcaaagtccccaaagaatatcaacaaggaaaaacagccactaggctgtataaatccacttgctataaaattccaacacacacataataaccagcatatgaagctgaatccttataggaaaacaattcaaaatccaggtacattcatcaggccctccccatgtcgtggaagactaaagttagtagctcttccatatgttacactatgaaacaagatgaaaatggcagagaggaaaatgaaatgagccttctgagattcattctttagtttgttcgttcaaatacacggcagaagagggtgctttccatacagaaattattccgttttgacacactctaacttaggctatttggaggagaattgtctggctctaccttacagtacacacttcccaaagtcccacaaatcatgtggctttgggagaagagagagttcggggagcatttaccccgaccataccaaaatgaattaacagggattaatttgggttacatggtctatgtgccagtcagaacagcttccagtgtgtttcagaatttaaggtggggaaaaaagaaacagaaaatcggatttcaaaactaccctttaatgaaaagctgttaaagtgatttatcttaacaaaataatcatcaaattagaagctatatgtattcttaagacattttgaactccacattgtatcaaaattaggtagaatatatatattattatatatatattatctctctatatattctctatatgtaacctctatatatatatatactatatatattccatatatatactatatatactctctctctatatatatatatatataaaatcatagatacaccatgataatttactgagaatactaaaggagatgcgaataaaaaatatgtatctagtctatttgttagaaatcaggtatacctatctgcaacagacaaaaataacaatggcttaagcagacatggtctaatttgctcatgtaagtctgaggaccagcagaccagaacttgtctggccactggcaccgtggtcatctaaaacccaggctgctttcagattctcttctaccacctctgtgatggttcttattctcctagcccaagatggcattccagccatgccattcactgcctgggcagcaggatggaggcagggcaggcttccaatctttaatgacatgttccagaagttgcgcccatcacttctcattgtcacttgtcagaatttgattatacaaccccacctagaaacaaggaaggttagaaatgtaatccttcctctaggcagttgtgcaggctcccagaagaaacagagctggattattcaagaaaggtaagcgtcagaggtagtaggaaagtagcctgagtctggagagagtgagtagagcctccgtgagatcttgtcctctcttctagcccctcatctagcaagatttacagtgggttcctgtgcctgggatatagcactgtcttgatggttatagcaaaggtcccagtggctgtgcctggcttgaaagaagtcaacagcagcaatagcaaagcttgacctcaaattgatggcacagacaggcataaagagaagcctgcccatcgctgggtatcctgaagacctttctccaacatctagggggaaaatgtgggctttcattcagtgggcagagcccacactttcattttgactagaacatacattctgagtatgtaatcttctattggttaaacttagttatactctctcactttgtacccttaacaccacatacaagactgcttttgataaggaataaggacaggagatccttttttgtcctccaactagcctgcaaaaaagtattactgtagattgatattgtataatattacaaagaatagcactagcccaggtgacctgacacttctctataataattttctctggcacattaatttacacttgcatgcatatcactgaagaaaggtatttggggtttctatcaggacaataacaggcttgaaattagtgttgaaaaacattcacagccaggatttcaccccctgcccctgggttctctattttagctttctacattggcaactttcaacttttgctgctcaatgcaaataataactagcttaatgatttagaagaaaatattcttggagtatgttatagtcgtatgttaactgcaaatggctgccacctccaaataattgtctgacactatgtctgactatctgttcctccattctattgatctctcctatgaacaaagcagacagatatgcaggtacagctcttttaggaacaaattgccctttctccaagctgacatctttagaattaagaactcagagacagccaatgtggaaaaacatttctcccctgccacatgcttggtgggtcagaaagtcaatcaaattctatttcacaaaaaaaactaattcctatgagatgggaggctgcattaatatttctaagaccaaatattctccctcaagtaatataaatttataggtataacttttcccaatgctctatcgacttctcatggtatatgaaagtaattaggcttctctgaaagccagagctgcgttgagaactatatttgagtaaacacaaaagaaaagcattttgagtgttacttttaatgtttccagaaaagttaacacctataaaaatattgtttccagttttctgtatagaagtcactgaaggaggatgtgtgaaagtctgtggaaacagtacactggcaaactgccagctggaatcgcacggagctctgttgtaactcaaatctggccaggccgcaagtcaaagcatgtcctaagaaatatagtacacacatacagcgaacacaaccattgtaactctagcccatgggaagctgaacattcaatggacagtgtccagactatatagaaaaatagaacactgacccaccacctgcagaaaccagtcgaggaaaccacaacttttgcagccatcggccccaaatggttggtacttaatcaacaactgccaacttccccaagtgttgccccctgcatccaacacaggaccaaccagtgaaagctgactctgatcacataggacatctggcttctaggttagccacctccagcttcctgtgccaacagcctcaagtcaggtcacacctgaatcctcctcctcccttccctctcctctccccttccaacactataaagggttttctattcccctacttccttttgagtcttcaccagccacatgtgatgatggctgccacccttgttctagaaagcccagaatagcctctgcttcttctcatttgcattgctttttcccccatatctggttctccctgggggccttctatcctgcctgggccctctgctaggagttccttaacttttcccttctccatcctgcagcatcttcatccttccctgcttccaagggctgtgtttctgtagatgaactgtttctcccctatttgaggccagtccttccaactgtattctttcctcattatttctattccttcttcctggaccttttgtttccacctgttgtatcccttgctgtgttcctcacatgccactgggacagcacagaaacagtcccaaggcgtctacctggccaagcacagtggagctactgtgaggacaggatataaagaagcaacagtctggcctcaccaagaaaagggagcattacagattgattcatctgcattacatttcaagccaaagttgaacagtctagatttggatgcaaagagaacagagaaaaaagctaggagccaatagcaaccaattcaggggtcagagtggcaggcatcaagaaagtaggatggacaaaggagagccaacgaggagaaattaggggaaagcgaaacatcagtaggcagaaggcaattgtacaggattaagcctgaggacaccatgttagtcttttttttttttatacttggctcctgtaaattgcagtgagccatgtattaaagggaaagaacatggaggatcaccaagcatttctgtcctaaatatatacatatacatataaatatgtatatatgtgtgtgtgtgtatatatatatggacacacacacatatatatgtgtgtgtatatatggacatatgtgtatatatatatacgcacatacgtatgtgtatatacgtgtagatatatgtgtgtatgtatatatgtgtgtgtgtgtgtatagtgtgtgtatgtgtgtattttaagagactaggtgtcactcctgttgccagtgccgtcgtgcagttatagctcactgaagcctcaaactcctgggctcaagttattctcctacttcagcctcctaagtagctgtaactacaggcatgcaccgccatgcctggctaatttttttttaagagatggggtcttgctgtgttgcccaggctggtcttgaactcctggccttaagagatcctcccacagcacgggaattataggtgtgagccaccatgcctggtcccataatatattttcctttgcaatacagtctatagttaacatccaaatcccatgcaaagtataataaaacacctcttaccagcttcttctagggctcagaaaaactctcttctctccatttttgcctcccttctgatttctccattattattgctctattaattcttctttcttacaaataaaagtatacttacccattatgaacttttaaataatcaacttctttttctcctgtaattaaccaaaaaagttcttggaataatctactaaacacccagtctccactatctcctcagtcaaatacagtgttggcttcttccctaggccattcttagagaattcctctccaaggtcattcgagcccaaacctcatgcccttcttcagcacgcacaggctgcaggctctcctgaaccaccttgaagttctccaaccttggccttgccgacactgcactagcctttgggatcaccctttttcagctcagctatttttcattctttcactcctgcccatccctcttttatcatccctcagtctcatctgcaatggaaacatgacctaatctccaaaatcctttccaattgctatctccttctggatctccaaaacagacaagattgaggctcccgtttgctgttcttggtgtttgaatcactcctgcagcaatttcctacacagtctcatagtaaaggaatctgcacccctgtattctacttctcactgggactgtaagctccttgtgggtaatggctaaatctcatccacctttatatctccaagtctaacaatagtactagacacatctcaggtagagactctggagtgtgactgcctatagagagcatgataatactttctatctcataatacaacgcctagcatgctggctcttaccatcatcatcaagagatgagagttaaattaaatgaacctaataatgtgaagacagatgttagtattgtccccctgtgctgtttctactgtatttgatttcagatattttagtgaaaaaaaatgtgctttgaactatctagatgacaccaaaactgaaatttatcagagacctctggtattctgttttgtgcagacatactgcttcccaaattattttacacagcaccatccccacctcatttcctgtgcttatggacaacggaggcttgcagaattaaagtatgcctatttattccataagaaaatgggaataaatattaagataatggttgggggaggagaaagtgtacagaaaataattaagtcaaactcacccaacattaacatgggggagaagagatttttttcaaaaccctgcctccctagagccctaaaccttttcatcgatttccaataatagtgagaacttttgctataaaattgttttacagcagctaacaagcagtaaatgtttaatcattatacatacttaggagagcagcattgttattttatagattttaaaaccaggggctcatatagatctaagagctttcttcttgcacctagaaagcagcagaaccataccttgaactgtagtttttcagactcagttcttacccgctgtcattcatatccataccattctccaaaagactcatgtaagaaaataatcaccatgcaaagaaaccatccagctcttcatgaaaagctctagttcagtctctaggaggacccaaatgacagtgaagtctaagtctcagtctctaatgccaaggaaatgtcagggaattaagaccctcaagtgtgaacatgggagggtaactcaggctcctcttctaataaagtctaaatgggagttcatcaaactgtttaaaagccgatcttatcaacctaactaaacctaattcttcttgctttatctgaaaccctgttttaaagttcaaaatgaccaagctatgcaatttgtatgcagagaagctaagcagctgagagatattgagccaggactctctgtctagtaagttagaggaagaacaacaaaagtagattgccagatacaaagaaataagcaacatcagagagataccaaataaaagaatgttgacagctcttggcttcaggaaagccaagaagaatcatacattgaggaattggcatttgagcgaaggaggtttagatcatattctttcatcttgaaagtataaaaaggtctggaaagatgtatcatcctaagcacccaccatcgaagttagatagcagcaatttaattccagccttcatattggagagcacataggcaacttaatattcagaaacaagatttggggggacaatttaaagagagggcattttccagattaatggatacagctgaataaatgtgttctttgctttaaaaatccctcaaaataattagcaggaaaggtagcgatcaagcaaaatgttgactatttttcaagctgtgttttctctcctctcagaattattaataaacttaccatattttggttaaaatatttgctcacaaggagtattaattttcctaaaatgaatagggttataatattttaaaatgtatttcaccaacagcaattaatttgtgttgagtgtttgaggatagataattccactgggcaacaaaaatcacttaatcttccatgttgttgcaagagcaaagaaaagcaactgcattttaaaagtttaattagaagtaaaagcaagtttatataatgatatatcacactgctagcaagtaataaagataaacatcctcgcatattatcagcaccaaaaaacagtcaaatttcgctttgcttacagattgcagaaacttctatagtatgaaatggctttttcagataccgcttctgagtttggtggatttttttcccaagaacttgtggttaggataatttgagggattacagtgtagacagtgacattcccttgtatttgagagaagtttgtgcaattcagacatgactgtgtttgcttttagcaaacatactgttcacattttgagaaaaactgctgatgcagtctggtgaaagtgttctagcaatgccaaatcactgacagatgtgctgtctgccaagggatttccctaggaatgttctaattttcttctatctgtttagagaaagttcgtttaaaatctgttaaaatgtattaatgtgcagtgttccattgtatcttgctgtgggcatactagcaaaagaaaagttacaggaagattggtactggggtgcctaccaaaaacttgatcccgccagatcagaaacctgcccaatcctcgatcttacagaagggagagctcatatactctgtaataacttgcattgtctataattttattgtgttagaacacaaaggggctcactattcttccaaactcatttaaaaatatacctgctgttgaaactgcagtctagagagattaggtgatatatccacagtcacagtcaattggccagtgacaaacaatgtggtcacctgcaaatatcaatagaattaagaaaacaaaaggtagttcttaccagtgagttttgcatgaaggatgtgaggctcaaagataagatactttgagtacggatctaaaatttttatttgttaccaaatcaatgttttctatatttcctaaggtgactattaagtcggagtcaaatatcagaaacatcatcacagttataaacttaaccattgtggggaagattaacatggctttcattagtgaattaaaattgacttctgcatgttggtacaacagtaagacaatatcacaactgtactcccaaggaagtaaaatgctaaaaaggacaagttaaaaaaaaaaaaaggaatgcaatactaccagaagtcctaatggtaccagcacatacacactgtcccacatcaatgagaatgctcacctactgcctgagaagtataataatgaacagctatcgttcttgcccatctaaactccctttctttagggcaggagttcttgacctcagcactattgacattttagaccacataattctttgctgtgaagagctgtctgtgtactctaagatatttatggccactacttactagatgccagcagcatctccttcccagtagtgacaaccaaaaatgtatccagatgtcgctaaatgtgttcagatggggaaaggggagatataaaatcactcccttttgagaaacacaactttaaggaagcagccacttcctcactgtactggtagggctgccattcacatcatatgcccagaaggcacttagagctcagtaatctcatggccatggccttcccaatatccacagatccatcctgctaaaggcaccaatgatcagctcttctctgggacttgttctttaattccatatcctacacaacactctcccaaacctcttttttccataagttattcaaagttgggtctgctacttacaaacaaggaagcctacttgattaaaaaaaaataagcagcaaaaataattgttttcatttgtgtaagaaaaaaatagtgcatctgtcataaactaatagtagagtaaggcaggattacagaatcacactccccacctccaccctgcaagaaactaatttttaaaagtaagaaaatgataaggattttaaaaagctaataccttacccaacacctataaaaccaataaagtggtataagctttgctataaattttgaaagcctaagaaaagaaaacaaagattctgatacgtcagccccaccaactcaccctaatccaaccctacacacacccagaagcggtactaatcaaagaaggtaagtagacagatttctgaagtttctcagaactaccctaaatatgaaaaggtatggactgacagaaggggagtgatgaggcaaacccagacaaattcgagaaaaacaactttgttatagaagctcctacatgtccttttgagaccttatcaggactacagtacatattatagatgttctttttatgagaagatgccccctctgggcagaccaaattagaaaaatgcatccctctcatgagcggatgcaacagccctgcaccaagcatgcttttttggaggcagagcacagactggaattgagctccccttccgggcccctcacctatgtttctccattcaaggacaacctgcacacagcagcagttcacagcagccctgccagcagaggctggaagggtccccagagtttgttgacttccacagcaatgtgccaagtgacagaacctttgaaagcccaaagactgcaacaatgctggttgaggaatgggcccagggacagaatattaataggatctcggaagatacagcagggatcaggtcgcccagtgtgggctgcaccctgcttccccacagccttctccaccctcaccctccacatttcctaccgcagtggcttcctaatgtcagcatgtttcagagctgcctgaaagccttgtgataaaacaggttactgggccacatctccagagtttctgattcaatgtgtatgaggtgaggcccacagattccccctgttaaatgatgttgctggtctgaagaccacattctgaaaatcagtcatctttagaaaagtatgtaaaaagcagcagctagccctcaaaccatagctcagaatagggaagacaaactagtgtcaaggaacttgaaatcaaggaagatgaagatcaactcacaccagttaagaaaaacaacaataacaaaaacataaaacacccatcttaatagtgagcaggataaaaataaaaggcatgactaccatgcaaacttactacctgaatgaggagagggtggggaatggcagaaagaaaataacagaatgtaaaagacagatgaagaactcagctggaagaaaatgtaactgaaattaaacaacagtttcctcataagtgttttataatattaaggaaactaaaaagaatcttcaataacagctcaaaattgagaagataaaacacaaacaaggttttgaaaaggaaattccagagttaaggaagtactctgaatatattacataccaataaaaacttaattaattcattagaaacagaaatagaaaaagtcaaagctgaaaactaaattaccatgatggagaaactcaaaataatttcactgaatacctgagaaaaaaggcaaggaacttgttcaagcaaacaaagtaagcattaatttggaagacagatagagtaagccaagaaaatcatcatcagtgtccctgaaacactggaccgtaaaaagaaaaattctcagttttcacacaaaacatttatctaaagtgaagaaagaactgaatccatgggtggaaatgatacagtatcctgagaaaaatttaatgatcagcattgtcatcctaattaagctattacacatcaaggataaaactagagctgttcaaacatctaagaagaaagcaagtcaattacaatagggaaaagaaaatcagcctggcctcacactttctacagcaacagccaatctcggaaaaccatggagcaatgtctaaacttcagagaaaaagaaaaggtgacccaagaatgtcctatcagccaagttgttattcaggtataaaggtaataggtagatattctcaaaagtgaaaaatctcagagaatataaccttcatgaaaccttcttggagagaaaaaaaattgcttgatgatgaaaggtacccagctaagagataaataaaaagaaacaatcctggcatctagaaaccatggtaaaaagactaccagagctggatccaaataaaaatacaaccaggactaaacaaatgggagaatgacatttgcaaaacagaatgaggatgttatgagcctgtgcaatggactgaatacttatgtcttctccaaattcatatgttgaaatcctaacttccaaggtgacagtattaggcagtggaagtcatgagggctccattctcatgactgggattagtgcctgtataaaaaagacctcagagagctagctaatagccccttgcactaggtgagaaaatagcaagaaagtaccatctactcatgagaaagcaagcctttgccagacaccaaatctgccggtaccttgatcttagacttcccagtctctataactgcaagaaatatatttctgttgtttatgagctacccagtttatggtattttgctacagcagcccaaacagactaggacagcctgtcagggtaaaaataatatgagcaacatagtttgaaggtagtaagagaggtagctggaaagaaattagaaatcaatcatgtaatctctcctagtgaataacatctaaaattggtgtagttaaaaactcataaaaactccaacttttgaatgtttttatattttttcttaacctttagaaaagtctttaggaacaaatagctttaatggtgaaaaaatacatagctgaagctcaacaattccttggatttcactttcagtttctttttcttctgttaaattcaggtaaaattaaatttaacatctttattgataaagcagatatattatgatctctgaattattctcatccttacaatgttaattcttactatctatccattttactatcttcctatctgtacatgtgtattaagagatgtttagaacgatgctcttcaactgttcagagggtatttctcggtggtgggatttagggtattgtgttgctttcttctgtataattttgtatattgcctacattttttaatgatgagcataagtcacttgtaaaaatatacaatcaccactctaaaaaggaatacatgaaatataacaccacttttctgacacagtgagtataaatgtatctctttcaatgagcaacatcataaagtgcctctctgggtaaggcatcattgtgaatatccaccctcattgcaaagtacactagaagtgaatgatacgtaagaatgagtagaatgtatccaaggcaataacactataaggctctgtttcatttttgtaaatagatctctggcttaggctcctttaattagcagtacctaacatttcctgagcatttgctatgtgcccggctgcatgccaccatactttataggtattttgttatttaattctcacagtaactataaggtaataataataatggtgacgaagagactaagaacagctcagagttgttgagtgtctactatgtactaggcactgctccaagtgcttttcaggcaataacattcttcagtaggaagtacttatagcaatgggagtacattgtgcagcagaagagaaggctatcaaggccagcttttaaaaatacaaggatttacatttagtacagtgagagaaagtgcacaggtgagtctggccttgtgtagagagaaaacataaagagaaaaaactggcagaaccacgcaattaattaagtacttttgaccacaaaagtgaggggaatccagggtagagcaggactccgaccaagaagatataaaggccttggtcagcttctggttgtcgtggaaatgggatttcaaccattataatgagatcaaatcatatgctaacaaagaaatcagtaattagagttggggccacccacagagctcacctccatcttgggataagatctaggaagagccagacatgcatttttgccgcagataaaatcccaaaaggaaaggttttaagtatgaaagggttgggctgaaataacatactcaagaatattgctattctgagtgttgcttctgcttccagctctgaccaggtcactgcagataacaaattatgtcatttcttatagctctattccactcatcagctccccttctatgcaggaaggagcatgaaatgggaaaaaaaccgaggttcccactcttggtgtcctaagtgatcagccacaggaagaaaaagatctctgctcattttccctctcacttactattgcccaggaatcttggatctcttcagaatagtgggcaaactgagagaaagcaagttcatttaatcctcaaaacaaccctatagattccattctgttatcatcatccccatttcacagatttcacaatggacagggaggagcagcattgaagggatcagtaacctgcccaaggtccattttaacacaagagctttctgacttcattcaggctcccctctctgtgattgtgatttctctcatgtctaaaccattcacattttttaaaattaggatttctatgcttaagtatgtacctttgttcacaactaagttgaggattctatactcaaacacacacacacagagagagagagagagagatgcagttgattttccccaatactaatgtccatgaactgaaagcttaggcaataacttagtatagccacagctttggtttggttcagttctagggtactgctttgcaaattaaaggtgtaatcccttcaaatcactgcaataaaagtgatttgaaatcatactatttgcagtcataatagaaacaaatgcctacttaactactcatggctcagctctggtgagaacacatcaatagagtaaaatgcttttagctttccagagaaaggttccacctgacagataccaagagatcaaatattcactccgcttaggacaaagaagtgtacggattaggacatacttgagaagtcagtttcagaaggcaccagtttagaaaagaaccctgaaagacctctaccatttatttatatttcaatgtattcattccatttcttcctatgtcttttcattcatttgtttatctccttggtctgtgtgctgcaggctaaaactacagcaattaaacacaaggtccttgcatccaggagttcttctcaatccagtaatggaaacaactaacatcatatactattttgctttattttctgctagaggtacggacaggaggtgctgtgggaacacagctaatggggcacctggttcttgcctatgagagttttgagaaggatacctgaagtagggtttagaaactgaccatcacaggggatgggagaggaggaaagataaagttataaggaattctcaaactttgaacatgtgaatgtcctatatgtatctgtaaatagtatataaaaacactatagtatctgactgctctgtcacagatgaaaaccttcaaagagaagctgatcatagacacaattatagaaaccaggggatgttatctcgcccaagtctgcctgactacttttaaggatgctaaattcctaatctctcaaggatgacattcttcttgccccagagtgtgctagagccagagggaccaactctttctccctaacttcctacccaacaaagaatcctcctctacaatattcctaatggatgtttactatagcaaacatcacttgttcagttttggttcctcagtccctattccctcattgtaatagcattttttttttttttgagatggagtctcgttctgtcacccaggctggagtgcagtgacgcaatcttagctcactgcaacctctgcctcccggattcaagtgattctcatgcctcagcctcccaagtagctgggactacagatgcccactgccatgcccaggtaattttttgtgttttagtagagatggggtttcaccatgttacccaggctggtctcaaactcctgagttcaggcaatctgcccgcctcagcctcccaaagtgctgggattacaggcgtgagtcaccgagcccagcctgtgatagcatcttgattcacttttagggacttttctcctattataagccaccattaggatagtgaattgggtgccttttcattccactccagaatttgaggtcctggagacttctggtatattttctgctgtaatggaaaaaggatgagcatgtgtcctaagctcagttaattggaccttctcttccagggctctgaatcctaagaagagtgacatgccactcactcactcattgctgtaatggcttcttaatagccaagtagactccatcttgatactttcctgtttctaagcctagtccctcctgcccgcatcttgattctgttaactccccgatatccttctatttgtaacaaattccttttctacttatattaacctcagtctctgttacctgcttccactggaactctgattctgcttgaatccttccattaatgggaatattactacattgagaggctgctcattccattgctggacctctatatttgtttcaaaagttgttaattcaagctaaagccgggttctctattactagtgtctgtcatcaggaattagaaagaataaattttagtccctcttccatatggcagtcactatagtatccaaggaagggcaaataatcattgataaccacaccactaaagcccttctcccagctgaaaaccaccagggtttttataaatcttctagaataatataaattttcagacaccacagaaatagaagctttgaattgccgatgagcagattaatcattttcagatggtctcagggaactaaacagtcacttcctcggtgggcctctttcgaagagggcactttcatgtttattacttgcaagggttggcaaatggtagaattcttttttaggatgataaggatttatatttctatctagtctgccactaattaaaagtatattatcttccctactgaagttggggtaattggtggttattttcagagcaactcatcagggtgagacagattctttctgattgaggtagcagaggtgttgaacattcattgtgtactgagttcacgtttctagtatcacaatttcccacaccacatgcgtgatagatgtgtcttcaacatttgcaaacaattccaagtcatttctcccttcaattattccctcttctctgacatcctaacaaggttttcattttgtactaatttcactaatttaggaaaacttttgtctgcaatacatacatatacatatatacacacatatacatatatacacacatataaacatatatgtatatatattcatattcttgagaagtaggccagaaacttggcttgctgtgaaaatcagaggggaaataaaaaggatgaatggagaatagtgtctattccctttggcacttcttacctaatactcaagccccttacttgctgaaactcaagtcttctcctccctgctcccacttgccttatatcttctctcaatgagtgaggattaagggcaggtacttctcccattccagagaagcagcagctccatctggagcactctgcctctttctgatggagccctcaggggtgtacactgtaatgtccatcttccctcgtctgctcacgcagaggacaagactctcactctcaccctctttctttccctatctaattttctctcctttctctctctctttcctcttcatttctagtggccaccagctctgaaggtaacatcccagcctgagtaggcctgagccaattattctagaccagaatcagcgggggtaaacacaaacactctcattctctagctgtttcctcaggtgctatggctgttctggactgttctccccttccactgctcagatgatatatgacactcaattacagttgaagagaaatggatcaactgctctagatccaggcccctgaagctactttaatatgtacataagtgttcaccagaggttcagtccagctctctggggtgctacatgggtgcagaaggtccaaagacccagctaataacgaaagttgacttagcttttatttagcctcctttattttttttcccaccaggaaaaaaaggagttgggtcaaacaggaactgggcccaatatcattacaacaatactgcaaggtcccccttcatcccaatgccacaatctagactttgtttttaggaatatattttaggaataataaatacaaaagaaaaaataaatcctaaattatgaacatcgttatttggttttgcaagtcagtcaaagtcatgtaaagagagagacctagtcattatcaggaaataactatcttgaattagtctgtaacaatttcttctcattgagtatttttgtgtttcccttctcttcataataggtaacatgatttcctacttaaaacggtggcagagtttcccttaaaaacaaatttatgttttaaaagtcagttgattcaaataaatattaaatatatgaatgcatatgctggtcacgcacaatttggaaaaaaaaaaaaaaagtatataaatgtcctggagacttctggtagattttctgctgttcctactctgaatggacatggatcattttcatgccactttggggattgatgcatgactcctgttgcttccaaactgtctcaaaagaaaatagcattccacctgacagctgcatgaactcaagtctttctcatgtatgggaggcataagtatgtccatccaacaaatctgccagcattgcctttattctggtactgtctaaggctgcctattcccttctgcacagagttcagccttttgcttccttttttatttattttttttttgagactgagtctagctgtgtcgcccaggctggagtgcagtggcgccatctcagctcactgcaatctccgcctctcgggttcaagtgattctcctgcctcagcctcctgagtagctgggattacaggtgtgtgccaccacacccagctaaatttttgtatttttagtacagatggggtctaaccatgttggttagactggtcttgaactcctgaccttgtgactcacccacctcggcctcccacagtgctggaattacaggcatgagccaccgcgcccagcccttagccttttgcttcttatggaaaagcattcttcattgttttattcactaggcttaggcaagtaccaccctaactctcaaatagcctttccatctgggcacccttcttcatgatgtctttgttcctggaatgtgcctcaaaggtctgatttcttaggtgccaagcagagtaaaacttctaatcttccttctatcaatccggagttcctgctatctcaacaatatactgcatacccaaagcacatgcataaaataaagtttattacaacaagactttgtttacagaagaaagattagactgattgaatacattgttctacactgattttaattggtgctataatctgatctgtctctaaccagctaatcggtatttaatcggttgctttaattttattacaaggcagctagaatgcagctgtagctagagaccacacagtaaataaactacattattattatatttatgcatatgagttttattctgcttgtgtcaaaattatactcacttccactcccctcctaatttgtttgtattaaaccattgctgtgcacttgcatagtgggaagagttaaaaaatgcctttttattgccaagggtaagttatgtgataagtttccagatgtacccaccttcatttgccaaacaatcttgtgattgatttaaatatttatacagtgcttcaattactgacattgtttctattaattaatgatattagggtttaattctacagaatacagaaatagaaacagaacaaattcatgcacaaaaaagcatctgatatgatcaccctgaatgtagtttcatgctagagtttctacgcaattccccagagaatgaagcataccagcattaataaaactctaagtgttttaggggctttgaacatgggtgcgataggttccaaagccctatgtaagtatttgaacaacttgaccttatttcagcttcttgagagaactattagggacagtcacagaatcaacatgaaaaattattaagtacccacatactgcctgcctgaaaggactcagacaactacagcaaacttcgaaaaaatattaataatatcaaaacaccttgcggctgctcttttagatcgctgcacatttttaagatgtaatttactggaagctctcttttgctctttcctgtcatttcagttatgcaagaacacaatgctctcaccctacgccagtctggagagctttgcttttctcttgggaggaggcatggtgcaatgatgagaagaagggcttagcagcaggccgaccctggctccagtcccagcttttacatactccctgaatgacatcaggccatgtactcttaagcctaaatttcctcatctgtaaaataggagtcatcacagctactctgatattagtgtgaggattaaatgagacaacaccataaggctctagccaaggggtccagctgttcctttggctactgtgatctcaggctcatttagcccagtaattgtggctcatctcatagttgtcttctcatcctgctgagattcatttatttaacaaatgtttattgggtactgatgggggtgccaagcatgggctagaaacctggaacacaacactgaaggtccagtttgcaacacaaagtccagttggtccaatgaaaaagaggattagatttgccttttaacaaaacattcctaggtagatgtttatggtaaagctaacatcgagccaagtatcacagaaatatatggcaggacattaatgcctagtgttccattataggaacgctaagcatgtgggagttatttataacctacagctcaaggtcatcaccaaggtctgatttttcactcatgcaaaaattcaaaaaactgaaacctctggcataaacgggttaaggaagggaaggccccttagtccaagcctttccttataaaggtatggaaagaaaccattgttcctcatcagcatgagagcaatacgtgttgtttacatagtattttgccatctgtgatgatttttatgtagtgtaggacaaggactttctaacgctcggctctatactagaccaggtccaaaaatctacctgagtatcactacctctgtcactgaactactgtaacccaataacaggataagatggctaacaaaagatgccctcgtaggaggaactatccagtagtttgatttcatacttgtcctaaacctttaaacttgttctacccacatgtcacagatatggaggttagtgaaaactacctgtgtgtgtacagagcagctgggaggacattttggctctgttctaggcagtcatgtagggcccccttactttgctcctgcagagggtcctgatactgtcactgttctgctcagcttcaaaactctcagcaggatgtcccattcctcacctagccctcacctgctctacctaatgatgctcaatcactgaactggcccagaaataatacctgcctatcctgacttcttacccaaacctggggctacctccctgactggcatcctaggggggctctccatggcctttagtgaagtggtcaaagagaagggtcaactctttatacaaaagaaaaatgagtcatgagctaactgtgaaactctcaataagtcacatattctctgatctccatttcccaaatcacacaaattgagagccatctaaattgcctcccaactctgagactctatggatatacatatatgaatcatcatagcaaatatatatctattatagaagctaaaggaatcttctcactttctccaattagtaccaactagattactccacaaaagatacttgaccttgttaaaacaaaaagcaaaacaaaaatactcttttacactattatcaggaaatctatgcctggctttagcagcagagtataaatatttggttattggatacttttcaatttaggggaaaaggtatatctattgcttaaaaacatttgtgcccttcttatagccaggtcacccattccaagtctgaagaaaataaattgaagtggtggtaaaagttagttaaatttcagaatttttaaaagaagggatatcattcatctctggctagataactctgtaaaagatctatctgtaagaacagaaaatgctcttataagaactttgagactagataaacaaatgcatgccacacagaccaccactcccatctcctcaggctgtggcagacattattaatcaataacagaatccttcccactatgtctatacacagccttcaaatggctctcaatgcagtatctcaggtaactgccagcaacgaatcatatttggcatgaatgataaaaggtatttggaatccctggctttatgactttgactgttaccctgactgccatttagaggattaacagccaagaatgtcacagtgtcattatttaaataaaatagaaagggatcttgcctgcaggaacatgcctctgaatattagtaggggatttcaagcttgaaactctccagaagtttctttttcatcactctaatgcttgactttttcttcctctgccccctccttccttatgaactctcaaggatacttacaggtcagaagggtcttcaggttgagttctggccaaaatttgtggcatttccaagtctcacttcactgaatgagtacaaccctgagacctgtctgggaacatggagtgaaacagaaactaagagagccaccactgctgaggcagggagggatggcctggtgatacacaggaaaggtaagtgtggcagtgcagtgagagatgggctggggagtaaggtagacaaaaggatctaaagagtggagtccaaaagcacaatgatacaaagtgagtgaagctcagggtttagcaagttaacatgaaaaccctagctcctgaatgaagagtaccttttgcatggagcctggattatcttttctgcttatatctttcttttctcctccctccagcccttccctccttcctatatgctccattttcaactccctttatattccttcatctttctctccctacttccttttctttaacttccatttctttctttttcagtcattcctacatttccctttttctctcattctcctttgtctaagctttagacaaccctgctcactagctccttggcctttaagagcttataagggctaaggggctactagtagcttctccccatgcaacatatcacacaggtgtcttggagggacaaagtggggcttgagactcctggatgctacacagcagaggtaagggctcaggtacccaagagaagaaatcaatgaagtaggaagcagaggtgaaaagagtatatcagctcaacaggatcaacaaagtccaggaacactgtcaaaataagcttggcagaaaatcaacagagcagagaacagcatgaaacatgaagtgatacaggttgtgggtgggtggagaaagagaaatacaaggcaagcaaagtggcagcattaataagcagccatgactggacacagacctgaagatggatattaggaagtaggtgcccactgagaatgagagtaaaaaccaaagtgatgaactatgcctttgtaacacctgacacaaaagaaaagaggtatgccagttaaatggcagcaccatgtacagaaatgagtagatatttcttggttttgcttaatatcgctctggaagcacagaattcatgttctaagacttaagaataacctaaaccagcccagtgtggtggctcacacctacaatcccagcactttggaggtggatggatgacctgaggtcaggagtttgagaccagcctggccaacatggcaaaactccatctctaataaaaatacacaaattatctgggcatggtggcagatgcctctaatcccaactactcagaagcctaagtcaggagaattgcttgaacccgggaggcagaggttgcagtgagacgagatcgatcacgtcattgcactccagcctggacaagaacaaaacacctcaaaaaaaattaataaataaataaataacctaagtctatttgggtgccaaaaaatgtgtattctatttggacattacagtggattgacagcatagaaattatttattaaacccatcctactggacctgaaggtgaaccccatcgtaacagggtgcctggtagagtcattcttaactagccatcgatttgtaaaaaattgcaaaagttgttttttttttgttttttttttgttttttttttgttttttgagatggagccctgctctgtcgccagactggagtgcagtggcatgatctcggctcactacaacctccgcctcccaggttcaagcaattctcctgcctcagtctcccgggtagctgggactacaggcgcccacaaccacgcccggctaatttttgtactattagtagagacagggtttcaccatgttggccagaatggtcttgatctcttgacctcgtgatctgcctgccttggcctcccaaagtgctgggattacagtaaaaatttcttatatcaaatgaccgttcttgaattgttaccttggattaacagggagcaactattggcatttccatacagcaatctactatctggggataatctagctttcctggagggatggaaacaaagtgcataatggttgtttaccaatcatataatatcagacaccaataatttgtcattcactctagtgttctacaatcattagaggagctattcaactgctctcagacataccagctatgatcatgtaggaaacgtgattccgtgggctgaatgtaccaactcttcactaacatctcaatactctagactgaagttaatgaccagtgcaaaccaccagagtattacagtaaaagaacagcagtaaaaaggccttaataaatcagaaatttaaattggctattcattttagttacagccattcgtcagagcaaagtgatggtccaattcacctatgcggtaacttacattgatcataacagtactttaagtaatatcatccattaatttattaagcaaatatttgagtaatacctactatgtgtacaaccctctgccagatgctgcaagatatattcagacataaaagaaacaatcttaacctttaagaaacttgtaatccagtaggagaaaaagacattttgtagaagtcttattcaaataaaatatgattccataagataaggctccatctaagctctctgcattgcaaagctgatggcaagaactacatttcccagaatactcttccctggatggttcgagtgaagtttaccaataagaatagagtgagatgtggaagaaaaagagataaagaaactgttctttggaagtcagacaaatgtgcacaaatgaagtcttcctcattgctgtacattgagagatgtccctgctttccttatcgaaactctgatctgtctatgagttattaacacccttgtcagtaatatcacttgtcattaggtcacaattcttgggactaccattgtctaggttcttctattccacatgctttgtttctgtgcatgttgagtccaacatgtgtgtatattttaggtagtgtcacctgtttggatatccacaagacctatttacacaacacctgttacaaaaactcaccccagatgttttcttgtttgttcagtttaatttattatacaaatcttcacatttgaaaatataagcaaaagtgattctaagccactacaggaaattcacaaaagcaacacctggtgtcaacatatttcatcacattttaatgattatgatgtgcacaggtgtgctgaaagtttctcctccatactctttgattcttttttaaaatttttttaattatacaagtaatacacttctagaactaataagcaatcatagcaagcttgtgggacaaaagttaatatacaaagtcaattgtcttcttattgctagcaatgaacaattgggacttgaaattaaaaacacaataccatttacattaatgccaaaaatttaaatacttaggtataaatcaaacgtgaaagatctatataaggaaaactataaaactttgctgaaagaaatacaaaagatctaagaaaaaggaaagctatccacatacgcagacaggaaatctcaatattgtcaagatatcagttcttctcaacttgacctatacattcaatgcaacctcagttttaaaaatcccaagccaaagtaaaagccatctacggcacacagcattccgaaaggtttgggctacctgactattatggcaccaagaaatctctggtatatgagaactttcactttaattcaaaatgttggatgacctgattttcagcagaaatgctcttcaaatcagtttcacttaggctttttggtgtgaagtgaaacgatgcagacaatgagctttggagaatgaggaaccactgaataacttactatggaagtggatactgacatggcaaagaaacgacagcctggagtttttaacagaatgttcccaatgagcaggacctgaagatgtttcttcgttccaaaggagctagcaaagaagtgattgttagcatcatatcaaaataactaaaagctataacacacactcttgaacgtctttcaaaacaatgggatctatgaaggattatgatatcagatcttgatactgtaaatattttgggccattctcctgaatgctttcttttgtcccatgaaaacctaaacttagggattctatgagttcctctactcagctggatttacctgtaaatgcctttgttgattgttgaccaatgtcccttgtaccttttccaatagtctcgatctgaataaacagatggttaaagttttgcaggaagtatatttttcattgggtcacaatgatcccacagattttgtaagaaagatgattttttaaaaccctttcatcttaattcagggtaccaagcaggtaaaaactaacattgaatttttacaggcaagtttcaatttgaacagtagggaattgctattttaatatgtggtccaggaaccaaaatcctagacctttccaatgactatgccaaaacaaactacacaaatatcaaacagaagctgttttctctctgaggtactgaagaagaggtacaaaagcttgccttaagttatccagatgtggggaaaaaaagttatccagatgtgatcttttggcagagaaaaagtttagtgagaagaatattttagcttggtgcaaaagtaactatggtttttgggcaaaaaccatagttacttttgcaccaatctaatggattgtctcatagaataataaattagccttctgtgaaagtaatttgtgataactgaaaaatccttgggttctggattcaagcataagtactttataaagtcaaatcaaagaattagtaaatgctggctgtaacttgaggacatcaagcatcactcttctactctggagttaaaaaaaaaagatacaaagtaaatttaaaaagttaagcagaacactggggaatttttgaaagccagtcatataatgtagtggtatcttttcattttgaatttgggcctttcaaaaaggaggggtatgatttcttaaccacagatatatatatgtaataattctttggctattttgttttacaggtttatggaaactcatggttgatatgctcaggtgcagtcctcctagctacctattttccagtttgaattactccaacataccattatttgatacaggctgtgctgctgtagagatggtagtgccatggtgatttgctacacagatcatcccatcacctaggtattaagcccagcatccattagttactcttccttatgctctccctcccagcagcacccctccaacaggccccagtgtgtgttgttccctccatgtgttgacgtgtgctcattattcagctccctgttgtaagtgagaacatgtggtgcttggttttccgttcctgcgttaatttgctgagggcaaaacctgattactttgaaaacaagttctactgtggcaggcagaatcatggccacacctaaagatgtcaacgttttaatttgaagaagctgcgaatatgttatgcaaaaagattttgcaaatgtgattaagttgaaatttgattaagttaagggccttgagatgaccttgaatcatctgagtggacctaatataatgctaagggtccttaaaagtggaagaaggaggcaaaagaggtcagaatgatgctgtataagacagacttgaccactttgaaggaggtgaaaaggaggctttgaagaaggaagggaccataagccaaagaatgcagggggccacaaagaaaactgaaaagccaatgaaacagaatctcccctaaaggccccaaaaaggaatgcagtacggctggtaccttttcagcccagtgggcccagtatcatacttctgtcctacagaaccacaggatgataaatttgtgttgtttgaagccactgagtctgataatttgttacagcagcaaagattaacatagcaactaagtagatgatttgttgcattataggtggtcacaaaatacaatcctttagtatcatgtattttttcctcttacaagagtaattacatttaaaaaagctatctactgttctagaatcactgtcgttgtttacaataaagtcctttaaatgtgcgcataaaaaactaaatgtgaataaaatgtaaataaaggaatatttttgcctaataaatacaaagaaaatgaaaatcccagcaacctattttttgtggatattaacaaactgattctaaagtgtacatggaaaagcaaaagattcagaatatgcaagacaatattaaatgagaagaacaaagtaggagcactgacactatccgacttcaagagttagaacaaagctatagtaattgaaacagtgtggtattggcaaaagccaccaaatacatcagtgaaacagaagagaaagcccacatagtcttttccacaaatggatctagaacaaatggatacccacatgcaaaaaaaaaaaaaaaaaaaaaaaaaaagaatctagacaaagacctcacactattcacaaaaattgactcaaaatgaatcacagacctaaatgtaaaatgtaaaaccatagaactcctagaaaataatgtacaagaaagttcagctgatcttgagcatgaaagtgactttttatatataataccaaaggtgcaatccatgaaagaaatcattgataagctagacttcattaaaattgaaaacgtctccttgatataagacactgtcaactgagaaagacaagccaaaggctaggagaaaatatttgcaagaaacatgtatgataaagaactgttatccaaaatattttttttaaagtcttaaaactcattaagaaaaataatttaaaaatgggcaaaagacttgaacagacacctcaccaaaaaatacatacagatggaatacaggcatatgaaaagaagctcaacatatattattaggatattgcaaattaaaacaatgataccactatgtacctattagaattgtgaaaattcaaaacaatgacaacaccaagtgctagtgaggatgtggggcaacagaactcacattcactgtggatgggaatgcaaaatgatatagcaacctcagaagacccgcaatattttacaaaatgaaacgtactcttaccatacaatccagcaattataatccttggtatttacccaaagtagttgaaaacttatttctacacaaaaacctgcacacagatgtttatagtaactttattcaaaattgccaaaacctggaagtaattgagatgaccttcagtaagtgaatgaataaacaaatcatggtatacgcagaccattattcagccatactaaaaagaaatgagctgttgagccacagaaagacatggagttactttacaggcatactgcgaagcaaaaggagccaaattttaagggctgcatactgtgtgattccagtgatgggatacattggaaaaaaaaaaaaaactatgaagagaatacaaagatcaatggtttgcaagggctcagaggagggggagggaaagagggatggctagatagaacataggagattttttagggcagtaaaactattctgaatgatataacagtggttgcatgtcattcaacagctgtcaaaacccataggatgtacaatgcagactgaaccataacataacctacagacttggttaataatagtgtatcaaaattggctcatcaaatgtaaaaaatataccacactaatgcaagtgttaattataaaggaaactgggggagtggtggggcgtaggcaaactctgcactcgttgctcaatttttctgtaaacctaaaattgttaaaaaagaaatagtgtattgatttcttaaaaccaaataatatataaatagccttataaaaaatgtcaaaccactcagaagtatccagactaaaacatttaactcccaagtgatgttttcacaccaatcctttcattcctggggcaaatgctcctcacagtttggtatttatgcttccagtctacttttgattttttttttttttttttttttgagatggagtctcacatggtcacctaggctggagtgcagtggcactatctggacacaccacaacctccacctcctggattcaagcaattctcctacctcagcctcccaagtacctgtgattacaggtgcccacgactacgcctagctacttttttgtatttttagtagagacagggtttacattacaatggccaggctggtctcgaactcctgacctcatgatctgcccgcctcagcctcccaaagtgctgggattacagccactagctaccgtgcccagccccagtctaatttttaatatgcttactattacacttatttccaaaaagtgttcaaacataaatggaacattttataaatatcattctgaaatttggacagttccttaaagcaactactagtgactgcactgagcattatgtgaaaaaaaaaagactccagaaaatacatgtgcaaggtggtcactatacaaacacacttttggctttccagagcattgtacagcaatagtcacatagtatgggctctagaaatacttgagtggttggcaattaagtcaagatgaaaaggaatcaggccattaaaatatagctacaactgggaggctgaggagggaagatcgctggagcacaggagattaagggtacagggagctatgatcatgccactggactccagcctgggtgacagagtgagacactctccaaaaaaaaaaaaaaatacaattacatggtctgacagttaaattctagagagaatcaacctttcatccacacagctagtatgccaatgaggtgtccactgtgtagggagaattaaccctctgcatttttcttaaggatttgagctctcttagctacacaaacataggaattgttatccccatcttagaggcaagaaagctgggagtcagggagcttaaataacttgcttgagatgactcaatgattggtgatggagtcaagattgaaaacccgggcaagcctccatgtctcacggtgcccctaaaagtactttctacaggtaacaagcacccaagtggtcttttcctcatcagtcccaaattggccgaaaagatcatctgtgaccaactggaacaggattatatccatatctcaattaaaaccatgtttccatttgccccttccttaaagcaaatcacagttctttatgtggattttttgaaacgtacaaatctagatttttttttttaacacattctggtgctcagttgcttaggaaactgcttttgtcattaggtgggaaggactaacacacttaagagagagaaaggcaaagggggaatatatagtaaacccagtgctgatgtgaattgtatccacagggactataacaaaacaatcagaactcaaagggaaaaggagcttttgagtgggttgtgaaataagctattaagtcatgcaaataaatccaatgtcaacacttcagcctgggctgattggatgcatgcattaaaactcatacttcataagaatttaaggcctctggtgttctcagtttttcttctttttcactttggggttttttggttggagggaggcatttctagagaaagcatgcctgctttacgctagaatcgctcatgaagtagagaatttgtgcatcaaggtttgaaacaatacattattccaagaccttgtccttcatcagtagtttcagcctttgccacatttctgagctccgtgctcaaaagaagcatctcttctcccaggctcctgcacccaaccaggcagggatccaacattcagataattcagacggtacacacattcatgacttcaagatgctgctgttgacagtcgtacaccttaacttgcagtgggtgcaaacataatcagccttttctcccacgaagcccatctttagaagcactgtgagatttttgcctgtcttgttcaagaccatacctacagtgcctagtgcgggacctggcacacatagtagatacgtaacaagtaatcactagtctgttacatgagcaagaaataacttttttaatgcaattgcgtggctgatctatttgtcaccaaagtgtaacctcccctgtccaatatgccatcactttattttccactgcaagcacaagatcttgcagctcaagaaagaactgtgctacatggcatgctctaaattcgacatgccatctcaatttaacatgatacttatgtaagccaatagtcccactttacagatgagatattggagctttatagaaatcaagtaatctagccacagtcccagagctaataaatgataggacaaggatttatatcccatcattttagctgtaaaacatgttcatttttttctttttaaatctgtgctgggctgtgttctgacctcaagtgaaatactgtgtgtttgtatcactcaactcgcacataccaaagtttaagtcaagagcctttatgacttataaaaaacaattgcttgagaggcactgggtgatacataggctcagttaaagcagaaggaacagcactagcatgtcatattggtaagatacaaattaaattgcagttagaaatggactgtcatggtagtaaaactatgggaagagcaaggaagtcctcgtttcggcgtgtcttcaggaacacaccggttaaccatctatttgcccaacccgatttggtctttaaacttgcctgaagaagccagttggagggaacagaaggcttctctcaaggtcaatgtctccctccataccccccacttcaggatctcctatgcatcaggcactgtgctatacaacgagtaaaacatagtgtttgcttttgaaaaattctacaatacatgaacagataattatggcagaacatgctaagtacaatgttatagtaatacagagaaaaacagaaaaactgactcagagcacattcaaaagggctgtttaatccatgcctaagtggagtaaggaggccaaaagttaatgaggagagcatcccagagagaagaaatggtagagccagtggtgtgaaggcaaaagccagtaggacgtatgcagagaagtccatgcagttcagtggtgccagaatgcaaaatgagaagcaaggagtggtaagagacagcaggaaagcttagcttactttttaagtcagccatgctgagcagcttgggcttcaacttgacaatgatgaacacatatttggcaagatttggcagaggacaggttggatatgaagtttagaaaaatccctacagctggtgtggatttgaatggaattggacagaagaccagcccaagttaggaagctgatggagagtcccagcaaaatacaggaatctgagcaagttttatagttttataaatataggaacatgaatgagaataggaatgaagagagaggactgctttgacaatgattccaaaagtaaaatattcaagaagggtgggaatggagtctaccaagaagaaaaactggataaaggcagaataaaaacttggaataaataatattactgaaattacttagcaatgttaataatgttaaatgtgtctgtggtaggcctgaccctctggctgtccattattccatatgtggtcttttctgactggcttctttcacttactgtaatgtttataaggttcatccatgttgtaacatgtatcagtacttcattccttttttttacaagatgatattgaattgacaggatatgccatgtttgtccattcagaaattgataagatatttggcttgtttctagtttttttttttgtttgtttgtttgtttgtttttgagacagtcttgccctgttgctcaggctggagtacaatggcacaatctcagctcactgcaatctccgcctctcaggctcaagcaatcctcccacttcagcctcccaagtatctgggactacaggcacatgccaccatgcctggcaaatttttgtattttttgtagaggtgaggtttcaccatgttgcccagactggtcttgaacttctgagctcaagtgatccactcgcctcagcctcccaaaatgttgggattacaggcatgaacgaccacgcctggccttgtttctagtttttagcaaatttaatgttgctatgaacattcacgtacaagcttttgagtggacatatgttttcatttctcttgggtatatatctacaggtggaattgctgaatcatatggcaattcgtttttcaaccttttggggaaatgatagactgttttccaaagtggctataccatgttacattctcaccagcaatgtatgttcaagttcctctatgtcttcttttcaattatagccatcctatgaggtgatgtggtatctcactatggttttgatttgtattttcttgatgactagtgatgctgagtatctttttatgggcttattggtcatctgtatatcttctttggataaatatctattcagaccttttatccattttttaaattgggtttatacaaatatttatatattctagatacaagtctcttatcagatatatgatatgtaagtattttatcccattctgtggagtttcttttcagcttctggatgttatccatggaaacacaaaagtttttaatgcttgtgtctttttccatttgttgcttgtgttgtctttttccatatgttgttaagacatcatatctaaaatattttgcctaatccaaggccatttgttatgcttatgtttccttctaagagttttatagttttagcttttacatttgaggccaagattcattttgagataatctttgtatatggggtcaggtaaggatccaaattcattcttttgcatgtggagacctagttgccccagaatcatttgtttaaaaggtttttaccatgaattgtcttggcagcacttttgaaaatcagttgatagtaaatgtgagtttatttctggaatctcagttctatgccattgatctttattgttatgtcagcactacactctcttgatcactgtagagttgtcatgagttccgaaaccaggaaatcctccaagttcgcactttttttcaagactgtttcagctattctcaggatcccttgaatttctgtatgattttaggattatcctgtcaagttttacaacaatatctgctgagattttgataggagttgcattgaatctttatggcactcaacaatttttggcacttttaacaataactcttccaatccccaaacataaaaagtcttgccttgtatttagatattcttcaacttatttcaaatatacataaattcagagtttatattttttgttgcttttaatttattcccaagtatttattctttttgatgccctcataaatggaattttctcagtttcattttctgattgtctatcacaagtgaatagagagaatgagtttgtgtatattgttcttgtatcctaaaaacttgctcaacttgtttatttctgataggttttttagtggatttaagatcttctatatataagattatgccatttataataaagtttttcttcttttcaaatatgaatgcagtttctttttcttgcctaatttccctggttagaactgttagacaatgttgaatggaaatggcaagaggggatatctgtgccttcttccttatcttaggggaaaacactcttttttttttttttttttacgttaagtatgatatgagctgtgaatttttaataatgctttttatcaggttgagaaagtttcatactattctatttccttgagtgtttttatcatgaaagggtgttaaatgtttttcaaatattttttctatgtctattgatataatcatgttgcttttatcctttattctattgatatgctatattacatttattagttttcatatgttaaaatgatcttgcatttctgggataaattccacatggccatggtacaaaatatgttgctggatccagtttgcttgtcttccactgaggatttttacatctgtattgataagatattggtctgtagtttccttgcattgtgatgtctgtctgttttggttaacaggatgctattggcctcatagaatgtagtgataatttttggaagagtttctgaaaaactgatattaattttttaaatgtttggtagaattggccagtgaagtcatctgaacttggacttttatttgtgggtagttttttattataaaaaatatatattcagtctttttacttttgatgggttattcaggctttatatttgtagaatcagttttgtttgtatctgtttaggaatttgttcatttcatccaagttatccaattcatagtcatacatttattcattgttttcccttgtaatcctttttctttctgcaaggtgagtagtaaggtccccttttttaatttttgagatggagtctcgctctgccacccaggctggagtgcagtgacaggctggagtgcagtggcgggatctaggctcactgaaacctctgcctcccaggttcaagcaattcttctgcctcagcttcccgagtagctgggactacaggcatgtgccaccacacccggctaattttcgtatttttagtagagacggggtgtcaccatattggccaggctagtcacatactcctgaccacgtgatccgcccacctcagcctcccaaagggctggaattataggcgtgagccactgcgcctggccaggtcccactttttattcctgattttaataatttgagtcttctttctttcctgcttagtcagtctaggtaaagttttctctggtttgttcatcttttgaaccaactctggttacattgattctatttttctattctctatttcattaatttctgttccaacctttattattttcttctgctttgtgtggtttactcattttatagtttattaaggtgaaacataggttactgatttgagattttttaaaaatacaggtacttaagctatatgtttccctcaaagccctgttttagttgcattctatcagctgttatgttacatcttcattttcatcaatgacataaaattgtttctcattttcattgtgattttttaaattgactcattggatatttaggagtgtgttgtttaagttctgtgtatttgcaagtttccaaaaatatgttagatttctaatttcaccttattgtagctagagaatatactttatatgatttcaatcatttgaatatattgaggcttttatggcttagcatgtggtatatttggaaaatgttccatgtacacttgagaacaatgaatattgaaggttttatctctttctctgatatttctgttgtctgcctcaattggcctcacacccagctgttatgcttcactaattactggataatcattctattgttttgaaaaataccctagaggcataaatttctccacagtctgacccaattaaattcaagggcctttgggagttagatcttcaggccaatttttcgttactccaggagggctctcttacctttacctttctttgattctctctgatcatctaggtaatcgatgggttagcttgtagattttatagagctaccagcctccttttaatggcttatcaccacaatgtctattgctttggacaatgaccttagttaggcttgacattccccccactgtttcaaatgaaatcaattcctatgagcttcagagttcttatggactgcttctacccctagcaaaatctgagcctggagctccagagctggcaggcagagtaacacctatactttctgagtaggggacttgttgggggtggcagcctctggctttcttagcttgcctctctcagcttgcctctctcagcatagaatctgcctatgagtaagctgaggcaagggggactggggcctcaatattctcagcctcccatacccggggtagaacatccacctaattagttgggggtaggtggaagaaggtaattcctaaactttccgccactctcaccaagaacttagcctctgcagtttagggcagagggaatgagaaattctagtgacctgttcctcagtgagataccatatcccttgactggaagctgaggggaaaggcagcaccatctctttggccacatctgcccagagtggaggctccatctcacagagctacatgaaagggatagatagcaggctgtgtctgacatgctacagactctcatgttcttagggagattcttcagatttgctcacataagtgcttttgatttgtcatattccattacaataatttccagagactttaaatgagtttctttatatttttcatcagttatggatgttttctgggaaatggtccatggaacaccttattctgccattctggaaataaaactccaagaaacttctctttaagcctctgagacttagaggttgcttattactgcaggaaagcctagtttagcatgatgaaagccgtgtctagtattaaagcagaattaaagtcaactcaaggaaagtaaaatgattttccaactctatctttctctgataggttcttgtcccttaaagctgagtagccgtcactggccagattctagaataatgcccttcctgtttttcttttgttctgttgtccccacttgattgctttaatgtatctaggtagactgcctctattaagaagtcccaagttaatgtaggctacttgcagtctttgaaacacagtgcccatttaaagatgacaatcctagaatcataagagcagggatacaaactattttattcactctagtattctcagagcctaaaacagtgtctggctagcctgacacttgatagctgctcccaaaaggtattttttgaatgacagtgtcaggaccttgctcctgttcctttgttacactggctgccctggggatcaaagcgtatgggagggctatttgtcttatgttatctttctgaaagtatcctcccagagactggttcaaacaggaaccctacctgactcctatgtcctaaaggactctatcaataaagtattccaagattcttctagccaggaggtctggcttcattttcgaagttatctcagaaacctaaagtgtgtactctggtatcattaactgatgtgacacaactagtgtgattccatcagttttataaatgacaaccagtgtgaggaagtcgacaccaaaagaagacactactggacagaaggcaaatgattttgaataatcagcctctaccctattcccccagggagactaaaatgcctaagcaatgctctcgttgatcacaaaggatacatgtttgtcctcttgtttagagttgcaagaacccactctttccaaagcaatcaaaatcctatattaaggggaccatgtctagaagctctggaaaattcctggaatagtaacacaaaaaaggagtcactgtaccaccaccacaagcctctctgggaactaattgtgttctagatgcaagagacacttaacccagcatttgtcttagcagtgtctgcctactatgtgagccttacgccatccctgagactctgccaggcccctgcccatccactcaacacttacagttgaactttgccaggaaatctagctcatctagttctccagctttctaatccttcctctcacccaagactgacccactccttgtcctatcttgacgtccctctggtttatacagagtaattaaatcactggttaattgatgaattcaattaaatcaatgtcttacctgagtccctgttaggattctttaaccttttttggaaaatagccacatgtcaaatttactcacttcttcccaggtcattaaaaaaaaaaaaaaaaaaaaaacacacagaaataactgagtaaaaaacactctcaatctttgccctcttggtatcagctttgagacacctggccaagtacagcctgtgctaagtttcaaagaggaggcagataactttgaagattttatttcacaggggacaacagataaaagtctctgtcaagttgtcattagatgcttaatgctattcttggtggggagcttgaggcgcccctcctcctctgtagacttctagcagattaggtttcagagctttaatttgaggaaggatttacagctgtgaagaggtataatatcattttgatttgggttgtactaggctggggaagccagattacatttgtatgaaactgtattagaccatatgactgaaaccaccaaaatcaaataaagggaaaattttccagagagcctaaaaacaagagcctgtctttccagcacctgagcattgtttcactaactattattctgatttacatctaggggatccatgcagaaatgcggagggagatggcaacaatgcctgtgcttgctggacctatccattcattaatctgtcatcaacctaatccaggggcccatcccctagaacaagaggaaaaaaattaacacttagagaagaggggaagttggcagggggaggggagataactttatgaaaaatagccttctttcatctccggaggcactgtctaattcagagtctcaaagaaatccatcaaattgtctctctgggcctcagtccatccaccgccaccatatgctaccatgtgcgtgtgtcgcacggcatccccagataatgacttacgtgggcaccgtgcctttcctctagaaccatcttaatgctattttaaaatccgactctcatttgcatggaaaacaataaatcactttgggtaacacagaaaacccagtttcttctgagatgaaacatgaaaaaaagagttagctgttgtttgtaccacacagctacacagaactgggcagactaccagcatcttctactgggatttagagatggacgcaagaaacaccacgggtaggactctgaaaattgaaattatttttgtgccagtctctagattcaactagaatgtgctcttggctggggagaatttgggaaagaagtgttttttttttgttttttgtttttttttaattgcaactactaagtttcaaaaatgggggaaaatcatgaagacagccacagacatcttcaggggctgactaattcttaaatgattggttcctctaagagtggttagtggtgaaagagtaaatgatgtatgagaacgatttctctgatttctgccaggagttctactcactcagtaaccacagggaatagaaggatcaggttttccacagaaactacttttagcacatgctgtgtttctacacctgtacttctcttccgaacaactatcttagctccaagttgacatggcccgttaccaaggggctccatgtcttttgtttttgtagtaaagatgacttgaatacagaagaggtgttgtaggagagcgcgtcttctccaaatgctggcagatgacagtttccgcagggacgtaaagaggtgacaaaggcacagaatataatttagtcctgatttccaggtctggctcacaaaactaatcggatgaaaatgtggccaaaagaatacctcggagataaactttctagaacaagctaacgccataatttgaccctaattccaaaaatcatgggaaggacatacttcttagtatctttatcttattctcaattaatcaacaaaccttaatgtaaataaattttctaaaattcattgtcaccgaggaaagggttaaaaaaaactaaagttctcttttgagaatggatttctttccctcactaccttcttagacaatacaacagaggttatttctagacccagaggagacaatgcaacatagcttctccagcctttggacactaagcaagttatcaataatgcagaatcttgaaacctgacactaaactccttcagaggtaggtatcttgtgagcaaaagagaacagagtaaaaggggcaaggatgggagagtgtaagaagaaccatgctgtggacattttacttcttggggtgttagtttccttctatgcaaaatacaactgtagattgccacaagcctaaacaaaatctgtaagaaataaataaccttcaaagcaatttaataaaaagaaatgtgcccaaaatatcctcaaagactttattaatctagggaggcaatagttaggaatatgagacatgagtcaaaccacctgattccacatcccgattgcacgatgaactagctgtgtgatattgagcaagtgacttaacccccagatttcctacctgtataagaggaataatgaaagctccacaactactgcaaaagctaaatcaaataatatgtgtaaagctgttagtacaatacctgcccccacagtaaacacacaataagtattagaaatacaacaaattattatatttaagtataaagcggtaatctgtacatacttggaacatttctgacttgagaagctataaaatcatggatcaaaacagttgtacaaaagatggtgttatgtgaggtcctttggatttaatataaggagccaaataaaagcagtccaaatttagaaaaatctttcaagctattccgcgatgactgtgtctgtcatcacttgggaaaggaaactgtatgctactcgcattctagagagctgttaggaaatgctagctgaccctcaacaaaccttcagcctccccaggaacacagttaggcagcttaatttgggcaagcgaggagaaagcatgagcccgtacccaagcactgcctggtttccatctgcgcgatttaaccacaagccacagagcgcctctgcggacaccaagtccagctgccagggaaaggtttcagacccacggtggtgtcccaacaatttccagttcagtggaaatctggggaacgcacaggctcatagcatatgatttcttcatgtttcattagtttccaggttttaaacaattttaaccttctctctggcacagagctgctgtactgtaagtagaaatcactggactttgagtaacatgagcctgtttcacgtttgtgggtggacatccaattggcacagtgaccttggccatgtcctgactcctctgagcttcactttcctcatctgtaaaatgggtgaaagccaacttcagtgagttctggggacacaaacatgtttcacatgtgcctagatagatgctgttagtctcaactcatttgctatcctgaacttaaacgggttgccaatctactctcacaccactctaaaacaacaaaaaaaaaatcttttcaaaagctaacaaactgaactaggagacgaagaaagaaaattcaccgctacataaattagccaggagcaaagcaagaagctgcccgagtagggcagttggcttcccacaattgattctttaataacttctgtaatatttctgaggcacatcaaaggacagtaacagcccagtgttggtaatccctctcacatataaaaactttcattacagagtgttaaaggcatcactctgcttgagaaatcgcaatcaatagacgttggccttttttcttcttttctatcctggggtaacggcaccagcattttctctccagtaatgcagtgctgtgtggccagagtttcctctgatgctgcagacgagcaccaagatgaaaaaatctttgtgataaatgagaaagaggagaagaagtttgggagaatacctctctgtgttagaaacccgaagtgttccatgctaattcaccctaaatgctgtttgcaaatattggcttagacatgcatttaaaagtcacagggatttgttttaacatgatttcttttgcattcccatgtggaaaataccttattttagagtgagacgccatctctatttcccaggctggagtgcagtggctattcacaggtactatcctcaacccacaacagcctcaaacacctgggctcaagcaatcctcgcacctcagcctcctgagtagctagagctactgcatgccccactgcgcccagcctataaaagatttcaattgaaaaatgtttccaattagcaccctaagagcaggataattttggaatactgcagcagatcttagggacacaaactaaaaggacagcaggcagtcattaatttctttgttccttattatctataatacaattgttagagtcagaaatataaaattacttgcagaagtttttttaaattcagcctatttgtttcctttgaaagattactccaggttctttaaaaagccagaatcacatttttctttttattatgaatgcataaaggccaaaggccactcatagcatctccctcgtaaaccgcatcttgccaaagcccgtggccaatttctggcctccctttactgaaccacttagtggcatttggccagttgaccactcccctccttcataagccgttttcttgcacataaaccccccaaccacactaccctttccccacctctactacctggctccatttgtcttcatagttttataggaatttaagtcatctatttgtgtgtatgtttattatcttactccatgtcccatgcctagaaatccctggtaagttgtagatactccataaatatttgctgcctggctgactcttagtattttcttttgacagattaaaagctcagaggagtgaagccacttgcctaagactgcatagtaagtggccgagtcagaattggaactctgagcccatactcatgacctttatataatagaaaaagcagcctcgggataaatgtccaagagcagggttggcaaacttttcccttaaacgggcagacagcaagtatttttgcctttgtgagccacatatatatatagtctcttgcatttttaaaaaagaatactttaaatacataaatctattattagctcaaagggtcatacacacaggccacagctgaatttggtcttagtttgtcaacccctgctcaggagaataggagcattttctactggattcatgactttaacccaggcccaagaatcctgtgcagaatcaattaagctttgtacaatgattttttttttttgagacagagtcttgctctctcgcccagactggagtgcagtggcgccatctcaatctcggctcactgcaacctccacctctcaggttcaagtgagtctcctgcttcagcctccagagtagctggaactacaggcatgcaccaccacgcctagctaatttttatatttttagtagagatggggtttcaccatgttggtcaggatggtctcgatctcttgacctcatgatccacccgccttggcctcccaaagtgctgggattacaggcatgagccatcacgcctggccagaatgaatgaattttaccttcatcctctagacaacaagatcctcaaggttaccagacttgggcatgtcctacagttaaaaaacagttcactttccacaaaagggagctggataaattcctatggatggacacaatgatcaagaggaggaagaatcctgataaattcctatgtagtaagagaaaataacgcaagatcaagagtggcaaaatgctgaaaattttgtgttattctttttccaattaagaggctttcccccgctatgaagtaagcaggcatcaccagaagtgagaggaggaaaataaccgctctcacctctccagcgtcctgtgctcctatcctgctgagactgtcttttggctactacataaaaagccaaaaaagtgagtccttcacagcatgaggatacttttagctgttggacacggagaaggttttctcttggtcttttattcaatcattcacagaaagggacatcctgtgacctcattttcactctaaagtaacagagaaagccaagtggcttcctgactctgggttctatagaaacccttgctttgatggtgcctttctcctcctctgaggccaagtcatggtgggggctggtggggcttccttccatttccaagacaggtggatctccttgggaaacagctgctgtctgggaatcctggcagcaccagggatagagagagaagagaagctccagtttcaaccctctgagtcactgcaaaagaatccccttcattaaaactagttctcaagggaaaggtgcttagagaaaaaaaaagactcagcaaaatgcataggacacttgggtaggagacatttcattatggccactttgatagcaccactttgaagcagtcattttgattttggtatgaaacttcttggaattttagtagaagttagagaattacctaagtaaatgctttttgatcaaaaataatttatatttgccagtttgtctttcatttctccccttaaagataagggctatgcctgtctcgtttaccattccatctctagtactcaatatggtacctcacatataggaagggtatatttatttaaaaaataactactatgaccatcactactactgcctatgtccagtgcttacattagatacataataatttgttgaaaaaatgaactgctaccatcactactaccattattgccacataattactattgtcaccatcattattcctattggctgtctattgtaaagccaatgggacaagcattatgcttagattatttcaattatcattcccatttcatagatgtgaacactgaagtgcagagaagtatcctaaaacatatatacagtatgtggtaaaaaattgaattaggttattattatgattagtcttgtcaagtaaattgggagaaatgaataggctgagagataaggataaggttgtacttagtgcctctattttggacttttaagcatttcttttcacggaaagggaccagggattcttaaagaaatgactgattccagatctgctccaggaaatagacatgatgaattggcaaattttgttgtggaaagctatcaaaacctactagagtaatgtcaaaaggacttggagctaacttgaaaggggctcccactggccaagacaaatcaacttcaataaaaacaatgaaagtggtagaatgaaatagatcaaatacacaaacattcaaacatttcttaagagtaaaaatcaatggtcacccttagaagttgccaggacaccaacttatgatttagaaaatattaacaaaaagaaactaagggaaattaaacacttaccctgcctttcctgtatggacaacctttcaaagtaacaacacgacatggagggaacgtttttcctcatagaggaatcacagttaataaaagcaggaggaatgacagatttagaaaatcaccatttcacagctcttaatgaaataatgggtctagacaaccaccattcatagctgcaaaacctttgccttaaagcttaattggaaacttgatatttaaggcatcacactgacaacatgtgaatctaggatcaatcctaacttaactaaatgtgggataatagtacattacatcagtggttcccatactttgaagcacattagaatcacttggggaactcttaaaaatcttaatgttcaggtcgtgtaccagatcaatcaaatcacaatgtctggggtaagagtatcagtaattttaatttgagatgttttaggtgattccactgtggagcaaagttcaggaatcttttcattttatggctcatggtgtgatgctccctatgatatattaatgttactatcatagggagatatattaacatcctatgatatataaccaaatatttaccagaaacagaagaaacgtgtttaagaatgactacaaaaatgcaaatcagaaatcaaatgtgtgaaaaattcaaagagggtgtgaatggcatatcttctcaacaaacaaatgtcattttaaaaaatggtgtgttgggggtgggaatggagggctttccttaaaacatgactggaaaagttatgcttctggctatgaatgaataacttcatacatcagactaatcctcctgcagaaagtaattgtgatagatgcataaattaaaaaaaaaaaaaaagctgttcaaaagcatcagagcacaaccaaggcatgcaagattcaagcatcctagatgatgtaggcaaagaaagcccactgaggtgagctctatagttaaagcaactttgtgtcctaagggcatttgcgaatttgcatcgtgagggaataaaccaagtagaaagcagcagctagagcttgatgcagtttctgagctagagagagaagtttggaagttaagggctatagaagcagcagctaggacttgagggactaagatttgtgagaacggtgaaccaaagaaaagtgatcccaatactcctaacgtaatttccccttgagatatttgcaaattcctaaactgcaaacatatgaagagaccaattaactaagcaaaaatcaatgctaaaagaccaaaaacgaaggagccattttgtcagtctaaaagggttggggagacaaaattgcaatttagaagacactaaggagaaagggccatcgtaaatgccccaaaatttcatttgagaaactcaaaaggcttgaattgttaggacaaactagaaatagaccacagaatttgaaaaatatcatttctggattaaatcaatataacttgcttatactgtatccacctgccagaatgttaacatatctctgcaagaagataaaatccacattaaaggaaacactaaaaggaactaaagggggttatttgggcagattaaaaatttcccagatgaaagcatagaatgtaggatggaagaaagagtactaggtaaattggggtaagtaccactctaacaatttaatcaagagaaatgaatacatgtccacacaaatatctatacataagcagcttcattcacaataatccaaacttgtaaacaacccctatgtgaaccaagtgaatggatacacaaaatgtcgaataaccatacaatggaatactattctgcaataaaaaggaacattaacacatgcaaccactattctccaagtcattatgttcactaaaggaagcgagacacaagggagttcatattatgggttaattcattaaaaatcctagaaaatgcaaaatcaccgctagtgacagaaaataaaatcaacggttgcctgagagctgggagtgacagaaggaaatgtccacagtgtggcacaaggaaagttttaggggtggcagaaatgttctgcaccttgattttggtggactcatgggtgtatccctcttttaaagctcaatgaatgaattttacatgggcacagtttattatatacacactataccccaataagctttttttttcctaaaagacagttgaaattccccaaagacagatcaaaaagataagttgctgtattattctattgaagtttaaaaacagataaaatcaatccatgattattaaaatggtgtatatcttgcagagcaggtgttcacttagtgaacaggaaatttctgggtactagtgctagtgagtggtattttctacatctttgagaaatagttacatgggatgtttattttgaaaatatttattgagctaaacacttaaaatgtgtgcacttttgctgtttttgtcatacttcaataagaaaatttaaaggtggaggattgagagaaattaaagaaaatccaagagacaaagcaaccaaaggcaatgcatggatgtcatatggcttatgattttaaaaactcaactgaaaaaaatgtgaggaaatgaatgaaaatcaaacatggactatttatcatatattaaagaatgcttgctcattttattgcatgctactgtgattacatttaaagtccttatctgctaaataaacatactaaagtatttataggtgaaataattgagtaggatttgctttaaacatcagcaaaaaagaaacacacaggccaggtgtggtggctcatgcctgtaatcccagcactttgggtggctgaggcaggaggatcacctgaggtcaggagttcaagaccagcctgaccaacatggtgaaaccctgtctttaccaaaaatacaaaatttagccaggtatggtggtgggtacctgtaatcccagctacttgggaggctgaggcaggagaattgcttgaaactgggaggtggaggttgtagtaagccaagattatgccattgcactccggcctgggcaacaggagtgaaactctgtctcaaaaaaaagaaaagaaaaggaaaaaatacatgtgctcaagtataggttgatcatcatggaagttggatgacagatgcatgagaatccatactattctcttgagttttgcatatatgtaagaatatttttacaaagtaaaaatacaattcaagtgaagatgaggtacaaggatgaggcagagggcccaggagggtgtgaagatgtctattgtgcctatgacctatattctattctttgcactttgaagattaaaatacccacagcatcaaaatggctatgtcaaaatgtcttgcttcagaatttgcatggcaagaattttctcaggggcccagaaacatgacaagcatgaaaagaatgaaatttacgagagtccaattaggtcctgaatgacagccaggcagatatatgatgacaaacagtgtccttcgtttctccagagactgatctactttgggcccaaagagaggaaagtgagcttgtataatcctgggaatttcaccatccttcttctggtccctagttatctccatctgaagcctattcaggttttggaagggagagaataaaatgggcagccaaaaaccagattctgatggcatcagtcagaatcctgacaggacacagatgtcatactcctctgcaactttgaagagaaataaactattttcagaggtggaggttgggttacaaggtaaggatttgaagcccctggtactagctacagcagaatgcctttagtatcctgggcctaaaaaagcaaagaaagagaacatgttatcagagcctggtgaggtaaaggtgggtgggttaggggtagggggtggggagtgggacgactatcatcactgctacagccttgaagggacacagaccctgaaaaacatgatgagaaagacttccatgggagtaaacatcccccatctctctctctctgcccattgcctggtctctttccagtacctcccattgaccaagcccaaactggaagacagagacatggaagcccaggtgacacagtcaacctcctgggtcaacaagcagggcagacaaggtcgcctaataggctaggaaggcgggggatggagaattaccagcacatgcccccaaagggtaatttacaccacactggaatacataagatcttcaaagccacagttagttagaaatgatggccatttggcaaaagctaattcagtcagacccagggttgcagatccttaatttaaatggaactgagtatttctaagcatttcacaagaggcccaaagacaatgaatgataacagattctttacccacacacacacaccctccccatgggggaaacggtaaggagctactcatgctcattctcaagtttgtaaaacaaaaatcttttcttctatattagaaatttccaaagtaaatgcacaaaaaaggggagaaatgtggttgcattttccattgggctttaaccatcactctgcgaaagagaagagttcagagcaaagtcatcacaggtggaaacaatctcaagatcagatgggagaggagtatcctcttccccccacctcccccgctccaggggtatgtggtcctctcttggttggtgatgccaaccctgcttcctctggccctgggttttgtacctgctgctttctctgcccttaatgtgctttcctcccttccttcacttgttaactcctattcctatcttagctcaattgtcactttccagaggaaactttcccatgttcactaatgaggtcaaagcccctaagacatactgtcatagcatctggaacttttccttcatgaaagcactttcacagtttttggtatggctgtttgatattgtctatctccccagctgaactggtagttccacgtggcaaggactatgtgtatctttgagtaccattgcatttccagggcctcacatataatctggctcatagtaggcacccaactattgtcgaatgaatgagtcttcactgcaagataaagtgacaacagttttccactctagagaccatctacgtttttccctttcaatgtacaacatgattttgttttctttcccccaccccccacagcattaaattactggaaacacatcctatgctcatagatgggtagaatcaatattgtgaaaatgaccatatttccaagagcaacctacagattccatgcaattcccatcaaaataccatcatcattcttcacagaactagaaaaaacaatcctaaaattcatatggaaccaaaaaagaacctgcatagacaaagcaagactaagcaaaaagaacaaatcttaaggcatattacccgacttcagactatactacgaggcagagtgatcttaactgtaccaagctaaatcctacatctagattcacagatgcaaaagtgtttaataaaaccaagttacttgcattcttaggctcatgtagatgctgtacgcagatggtcttctaaataggttttagatatgtcaaaactttctccagccacaaagtcaagaatgatcaccttagggttgcagtatactcaattatttatactccttctatgatcaagggtagtagtatctgcattaagtagtttcctccaaaccagaaaggaacgaattggcagaatatatttccttgcctccagaaataacttatcatcattagaatcatctgatatttttgggatctggaatctatgttctgtatttgtgagggtaactatgagacttgaacagtccaccagggatcttaaaggcatgttttcaaaacacagcccccatcaaaacagtgtgctgttaccaaatatgtttgggcaatgccactgtgaaatttacaacatacactaacagagagtttgagaaatcccatggctggtagagcttggcaaagggaaatgtgtttccctcacatatctaactaggaaaccgtcatttcaaatacttcctcttactatcctgaaggccatattttaggaaatgctgcactggaggaaagatgttctagaatagacaggtactacaagactgaaaaagagaaaatttaacatgctttcctgctactgaatctattctatatatcctgtttttcttcataggtgtttgccccacaatatttttgttttctcattatctctaatattaaaatgggagaaaacagtaatacaagcatgttgaaaaactgataccgtgaaatattgaaaatttgaaattgattaatgttggttcctaaagcaaattattttactgaaaaaaatggttctattaatctaaatagatacatttattaatatgtgttgaatacataggtatgtacctaggagttttgtagagagcatgtctgtttagaaataagcatacaaatacataacttcatgtaacgagtatgctgaacaagcatgatccattgcataaaacacaacattttactctccttgcccctctaaatttgattaggtggtaataatcttcctttgcccttggataaaaactacagcaggcccacgagtttgctgttcacaggtaatgggcagttctaaaacaacttcaggttacacatacagtcccaggtgagaaaacaaactccacaaccatgttgcttttgtatggaatctttccccttctcagcttggccctgcttcagactgaaagcctccagatcaccctgtggcccctccaccttattagccagcattctgcctttctcaaggttgaagaaactaagagacagaagggctcctccttgtgctagttctgttataatctagcttggctgtctctgggcctggcagatagttagggctgacactttctcttttgataagcttttatggattctgcagaggtttcctgttgggttcttttctcaaacagctcactagatcccaggtgggtggccagggatcccccatcccaagccccaggtcatctaggcatctgccttggacttcatatgctacttttccatgactccttcagttactgtattgaagtatatcaaaaacaaccccacgttggccctctcctttgcacagtccagaactgatccccaggaaacacacacatctcatgccttgacaaaaactgggaaatattggccacttcgcaagcaggagcattcctaccctaccacccaagcagttggccagcccctcttctcctggccttccagagtttcagggtgagtctcaaatgcatgggccctctaaacttcccaggcttgatgcaggcacaagcctctggttttccaactgcaagaaataattcagagctttctgattagtcctcttaatgcctcctattggggttttgggttacaagatagtacactctactttttctcccaagagggtaatgatgactcaatacatggccacagttgtctctaaagagacatcttctcttgtctcctctggactcatatatacaaaagccatggaccaggatcatgactttctatatgaggcagctgtcttttggtcgctgtattatgggtggctctgtgaaactgagacaatagacaatacaaccattctaacatcctactacctacgtcgtacacatatatatgtgtgtacgtcatattttactatacggtttctataacaacttcaaatagttaacgctataagagcctcaacactccccaattcaattataatctccagctttcactgatcactgctgatttggttataaatgacttcacaaccaaaagcttaccttgagaatttttcaatccctatgttcccagattcaaataaataaaacctacttgaaatatgtggacttaaaatagtcttccaacgcattcctcacacatgaaattactctcgaataactagctattggtgacattcctgatagtgccctagatttctcaacttttgcaagagcccagatggtcagaaagaactttaccaaatttggttacttgtttttaatggaaggattttaaatgttcttttaacaatcatctcagctgcatttaaaggctacttagcagtgtttgcagctaggagaacagataattaccggagtgaactagcaaattcctactggttataacctgaaatgggaagtaatacatggtcaagaatgtaaaaaattacttatatatatatacatttacgcacacattttttaatatcaagtgagcaaaatggtattaaatctggttaattctgcccatgtccatttgaaaaacaaccgtgtaatttgcctaagaaaaaaattctctcatagttaagtcagatgcctaattatatcatcctttatctgggactgtcaaaaataaaacattttggatctattcacaataaaatgacattttcagattcaatttcatacaagttttttatccattatgctcacagatcaaaagtgactggattcatcagccaaaaagaatattttaaagagctgctgagaactttataaaaataattctgattttcttttgtgggggaaacaatttcttttagaggagttagaaaaaagtgagaaaaaattttttgaaagaaaaagaaccaccaatgttactagagagcagagttgacatggcgttactcacagtgactggttaagggtaaaagtgggggaaaaaagcaaaactgtaaagtaactgattatttcactgtcttcacctggccttaattcaaatcagaacacttctcccacctgcattacttcaaacaatttaccagaaaagaagagaaaatgtggattacataacccagagcatatagagcgaaactgcaatgctatcattcagcaatcacagtgctctagtttatttttaaaatagctcagaattggccatgctcaagaagtggtcctacatacagcaagagagctcttcgtttaatacaatacagatttttcctaacagcttcctctactacttcacatatttcttccatatccctacatggccctcctaagaaatatacctttagcaatgaacactaggaaaacatatcgttgtggaaaggcatgggagagagtctactctctttacttgctttagcgtgaggcagaaaatatttcttacagggtagccatccaatacctgagcactttcaaatactctgcagcaggtaatttgtttttcagaagggtgggagttaaaagtaacacagaaagtcataatggggtgagagattagacttttctccaaagttacagcctttagatttagctcctgcaattctgaagggcctcagagataaggaaatcatgttgcaaatgtgagaagtgagatttagagaggtgaagggacctgcccaaggcctcctagaaagaagaagagactctggtactcgaggccctcaagtccagggttctttccacttgcccaggtttatccctggttgtcctctcctctgccccttgatctgacaaatgttcaaaggattacttaaaatagtcccctgctcaaaataacaagggcttgccaaaagaagaaaaacaccttgaaatagagattccaattaactgcctctgattgctggataactcttcaagactcccagaaaccgattctagcagtatgtgttatttgtttatagccaacctttgttccaaaaataacttgatatgttttacagaaatatgtagaatacatacaatgcagaaaattattgcaaaggaggaaaaaggatgggaaaagctagtaatcttggggatgaattgtcatacaccaagaaagcaatttatatacctggtggcttaacagcaaatattataatcaatgcaataatagtgacccagcagaaatacactgtgagttgaaataaaatgttaacaagagtttgtggggaagaataagacacaaaagtcctgataatgtctcaatatgcagggtttggacttctgaagcaggtcactcctaagccttcaagcttaggaaaaaagggaaaaatgagaggacagaggatagatgggacgacaatggggtggggagtcagggagtgggtagagggaaccacaacaggttgacgtccacctaggtatcacttatcaatgaactgaaaatttatcaggtaattggaagctcaaattcatacgtcacctggactgaactgcgcttttgttatttataatgcaatatggtataaatcaattggcttggattttaaaattagagcccaattacctgtgtaagggaatcataaatccaacttgtatttttctaacagggttaacaactcatgatgccagcttaaactcaggaaaatcaatggtctgggcttaagaacaattgtgcgtggtactttatctccctggtctagtgtagcaggtgggcagtctaggagttgggggtgaaggatttgggggagggtagaagcctaaagcaaaggaaacaaacagaaaacattgaatattgctaaaaacaccacatgccaggtaaacaggaaggggggcacttacatatagtagacagtgaaaatctggacacctgttacttgatgaagcatcgcaggagcaaaggcaaaacactcctgttgcttttcttgttctgcaaaactctccagagctaagagagctaatgtgagatgaaaagctaaaaaaggagcgagtcagaactcccactgacagctcccaaatctggcccttcctaaaggcgtttgcgcctgccttaagccagagactcccttctcaggtgcagtttgttgaccctctcttcaattggaaacatctgaggttcactcagtgataaggggcacgtggaggaataaagctgtggcagtggtggaggaattaatagtccaacttttatggagggcagttaacattgtgtatgcctgtgtttatgtaagtatatatacctacatatacacacatatatgttatatattattgacatagaaattccattttcataaaattctccttgagaaatggttgaagaacagtgcaaagatatacatacaaaattcttcattgcggccgggcgcggtggctcacgcctgtaatcccagcactttgggaggccgagacgggtggatcaccaggtcaggagatcgagaccattctggctaacacggtgaaaccccgtctctactaaaaatacaaaaagaaattagccgggcgtggtggcgggcacctgtagtcccagctactcaggagtctgaggcaggaggctgaggcgttaacctgggaggcagagcttgcagctagccgagatggcaccactgcactccagcctgggtgacagagcgagagtccatctcaaaaaaacaaaacaaaacaaaaaattcttcattgcagcattgcttctaagaaccaaagttgcacacaaactagaagtcattcaaagggggtgatccaagccaagtgtattatatttcactcatacaatgtaatactatactgaaattataaatgacgatataaaattctatggacatgatacgtggtaaaataaaacaacaaaatagtattactggatgtgtcaattgtgtgagtgtgtgtatgtgtgtgaataagaacgtgtgggagaaaatcctgcatattaatcaagcttattgctgttgtaggataactgatattttttaatatttttctgttgtgttggatttttaaattttaattgttataaaatagtcaggtattacttttataatctggaaaaaaaaacccagcaatttccattttggatcttgaatacagtaggaaggatagcagggtagcagcagttactgggcaaagcagacgtcaaccagggcctaacaacaaggctctcactgcacaaagcaccagcacctgtcccataatggcttctgttttcacacaaaattccgccaactgggtacatcttctcaaagaggggaaacaaatgcaccaaaattaattgtagaacttatctttatgttctgggggccagaaaactcagtctatactgtgcttctgagagcaaataatcctttctaggcctaaaatacagtctgtcttctattttgggcttgtggtacctctgttgtctcattgttcaagtggatgtaaaagtattaattcaaaaaacccatgttctctgcttaaagcacagaattgtcaacaaaacatactacagaacacatgcctctcactcagtcatttctttgtcttagtttcttgtggtctattccatagtaaggaatttgcaatgttggagtaagagacctaagaggaccttagagatcaccccattcagcatcctcatttttcacaagagaaagcccagactagtcatcaagtgagctagccaggactaaagccgagggtctggtagtcagtccactgtttatcacttcagctctaattccattcaagacacagctatagcttcccccttctggacaatctgaatattcctttagctaatgttgaaataaatcagactttcgacatctgatgtgacatacagagagaaaaaggcaggaaatctaacataatgtactagttagcttttccaaatgcatgagaaatactttcaataatggaaaacactacatatactactttatgcagtcgacttttgcttctgtgatagaaaagggaaaaagttcaggggaagaaaactacgcgggtcatttggtgacgtttttaagatttttactttcagaggcacataatttaaagtgtttttctttttcttctatcaaaaccaaacatagttactagaaaacatctgaaaaatgcaacaaaattttaagaagcaaaaaaagaaaacatgtcacacaattcagccaacaaaaaaaccacagttaaaatgttagtatagttccttctaggtttttttcctttttgaatggttgagcacttcatatatataccatttccaagttttgttttgttttttacctaaattatacctaagcattttatgaattcattaaaaactatttataaacattatttaatgtatgaataatattccatggtatagagtgccaaattttattttttctttatttatgtcatttagggtttttctattatacattattctatgatgagcattgtaagaaatccatcttgatcttaatttctgattattttcttgtcttaaattcctaaaatggggaattgccagattaaatactatgagcattttaaattaccaggaagtttataacaaattttgttgttcctaccaaaagtacatagaagtacccattttataatcctttttcagtaaaacatattttcaaacctttgttaattttacaggtggcaaaattaaaattaaaatttattttaacttgaatctttattattgaaaaatttggtatacccattggccattgtggccatcctttggcagatctactcttgaggtcttggcccatttatttactgagaaaaaaggaaagcattttgatagatccaatctttttttttttcaataaataaataatgaatttttaaaataaattaataaacttatttaattcactaaagcttaagaaacacaaacttctgggctgatcagttggaggctgtagaaaaatgaacggaacacactttttttccaagtatattttgtataagctctatctaattaatgaaaccttcctgcaactttctgcatctgctcattccaagcattagattaacaaacggttgacataaaatgaagagctacatggtatttctttgacatgtggcatataaaaatcacaaactctgtctttaaaaatagagtgttctggttcacactggtccactgagcaaacctatttactgcctttcccacccaaaatactttctaaatgatactaaagaaatgcaaaagtgcaaactcataaccacaaagagaatgggaagaagccattagaagataaatgatttgaataaaagtctgttggcttctgaaccacacagcaaaggaaaccacagcctaaaaagggattgcggcaaaggagggccgacctgcctggttattccagaaagaatcgagcctcagaaatagcaggtacaacacaggatggaagagattggtggggctgaaaaggggggttaattacaggccaggctgaatatgtaacattgaccacccttcctcctggctctccatgtggactagcctgaggccaagcaccagcttcaaggcaataaaaaagtggggagaaccatcacagttatcattagtgttaaaacctcactctaggccaggcgtggtagttcacgtctgtaatcccagcactttgggaggccaaggcaggggggatcacttgaggttgggagttcgagaccagcctggtcaacacggtgaaatcccatctctactaaaatacaaaaagtagggccaggcgcggtcacgcctgtaatcccagcactttgggaggcccaggagggcggatcatgaggtcaggatatcgagaccatcctggctaatatggtgaaaccccatctctactaaaaatacaattagtcaggtgtggtggcaggcacctgtagtctcagctacttgggaggctgaagcaggagaatggcgtgaacccgggagcggagcttgcagtgagctgagattgtgccactgcactccagcctgggcaaaagagagagactccatctcaaaaaaaaaaaaaaaaaaaaaaaaattcaaaaagtacctcagcatggtggcaggtgcctgtaatcctagctactcaggaggctgaggcaggagaattgcttgaacctgggaggcagaggttgcagtgagccaagatcacagcattgcactccagcctgggcaacagagtgaaagttcatctcaaacaaaacaaaacaaaacaaaacaaaacaaaacaaaacaaaacaaaaccttactctagcacattgcgattccccagttcccatgcacacaccctaaactgaaactcttcaagcttgctattcacaagacccacccacttaaaaatagaccgcaacaatagccttcttattgcctcattctttcacacacaccacagatcaccagaaatttaatatgacaagaaagtctaccacagaaaagaaaatgagcaagtaaaacaacagaaaacatgacactggagaaaacagtttaggggaaagacacaaactttaaaaataaaatctagttaatatcgtcaagaaagatttgaggagatttggtaactacaaaacaaaaacagggttctattgaaaaggaataatcagataagaaagagctctttggaattttataaatgcgtaagtaaaaaattcaatagaaagtttgtaggcaacgttggaaaaaatctcctagactatagaccaagtacagaagtaagtgagaaaaaaataaaatatatagatgaacaattcaggaggtctaaggatgactaaccaaattttcacaataagaaaaaaagaaactggagtggagggaattatcaaagagattgcatggtaaaattccccagagttaaagagaaagatgaatgttcaaagtataggaatctacttgataccaagaataattaactgtaaagtggtagaaaaatgaaattcctaacaatttcctgaaaagtaaaaaaaaaaagaaggtggcctacaaaataagaatcagagtagcatcagacttagcagcagcaggattgcatactaaaagacaggaaaaaggattttcaacagagaagtctacacccaaactatcaattgtcttttgagggcaaaataaaaaattctaaacctgcaagcatgcagaaagtttacctcccattcaccctgatatggcttggatatttgttcctgcccaaatctcttcaaaatgtaatccccggtgctggaggtggggcctggtgggaggtgtttggatcatggggacagatccctcataaatggcttgggctatttccttggtgacaagtgagctattgctctgagttcacatgagatctggtggtttaaaattgtgtagcacctcgcttccccactctctctccctcttgctcctgtcttcgtcacattatgtgcctacttccccttccgccataattgtaagcttcctgaggcctccctagaagccgagccagcaccgtgcttcctgtaaagcctgcagaaccatgagccaattaaacctcttttctttataaattatccagtctcaggtatttatagcaatgcaaaaatggcctaatacacaccctttcttaggaagttaatagcaaaatcagaaggcaaattagaaaagaaagaaaacccattcaatccagcaaacagtgactccaaccctggagagcaatggggacatctcaggatgattctacacagcatgtctacagagccacctgtccaaatgggagcaaaatggaggtctgtaagagacaggaccaatagaacaaagagtgtaattatgagcttgaaaaaacttgaagatattattgaggtatatactcagaaaaggcaataggacatcagaaattccagcaaaaacaaacaaaaataactttataagaaaaacttgaaatatatattacagaaactaaaaggtggaatgattttgataaaatgatttaaaggaagagaatccatttgcacctgattctagacacaatgtctttgagtatcacaggaattgtgacagagaccatgtggggctgcactaaataatttagcaaatcttaattgtgcaaatattttcattatttccaactttggaaaaatcacaaaaaaagactactctggtgacagagcaaatgtcaattaaatttgacaatgcaaaaataatggtatatagctgaccgagaatggaaagtggaaggaaaagaaaagcagtgaagaaaagggtattgagtgcccatatctcatcctgtgatgtgtggaggcaagagacacaggctagattgatggaccaatcaggggaggtataaatacaatttagaagtggcaagcccaatagaagttgagaataatgtcatgttatggtgggagcatgtgaaaagtttagtgtaagttagtgtaaggcaaatacttcttgtctttagaagaaaatcagtagataacataaaaaataaataagtgttaactagcaatatggaagtaagaccaggaatgttgaaaagtgattgcatttagggagctcagctggaggtgggaagggtgggactgggaactgttactttgcactacaggtgtttcaaaaccatttgatttttaactacgtgcttatttttgctttcataaaaaacaattccaaattatgattataaaaagcaagtacattgttacaagctcttttactaaaaacaacaacgcataattgagcctgtatgaaatgctgtcttctaagccactggacacgctggaggaatagcgaataaagtataactggatttatttataacgaggagagagcaaatgcagtgtacggaaatgagacacatcattttatctcgacagaacaattaagctttcattagggcttaatgacaggatgacattcgggggtttggagggtaagcacatcaccttcattatcaaatcaaagattatccagtatcaagaggaacagttttatttattctgtattctcctcgaactccccaccccaagctctgtcatgaccctagataagatgggaattgaacaaaagtccccaagtgctaattgcatattctctcacatccccaagattgctgtctcctagccatttgatgttaatatcacagaaagcagacagcaagtgtatatttggatgcacagctaggtacatttcccagaatgtattttggaaggggttagttgttggaaggttggcaagacactagtgactccacgttttggctactacgcctttctgtcctgaaagcctggtgtccatgttatttagaacagcctgggtaaacttattactgcaccctgtgttcacagaaaaggttggttctgagttcaattacaatccctagcagtttaaacgatagctgctgtgctataatctaaaataaattgcttttctcaagaagccatgtaagcctttgcactgcatcttagcagagctgctggttttatctcatctgaaactcaagaagggtacaaaagcaggacctctgaactcctgttgttacctcaaatgtcattcttctacacttctggggctctctcttcaccccaaattcctatcccagaactagatttatgggaaagcaacagtgttttcattttttaatgcaaatcatcattttgtgtttattgttttctatataagctgcatactttgcctggggtcttttgaaagaactctattactgggggcaagatttgtttttcctcttcccacagctagaaggctaacctgctaccatgggccaagatagcaagtatgaggacgcccgcacccaaatgaattggggcacctctacagactctccattcaaacgcacatcctcctcctctctccaaagggaatggaggaaaaggaaacaaacttgtcaagcgctcaatacgtgaaatgataattctggctttctccaccctccacctccccaggagtttttcccaaaggtcccattggcccaagctcaagcctcagcacttctctaaacaagatgcttgtagatccctttgatgtctttccacaaaggcaattagaagggtttccaacgttaactatgtacattctttcagatttaacaaggcaacttaattaacactgctgtgtttctgctagtcaacaagagaaaattgtcctttcaagagattttgcacattgacaaaaataatccagtaatacttttccctttcaaatatttttcttctattgagattgaaagaggtggtttgcagagtgctatatggtatgtgctcagcagcatttttctgaaagggaatttttttatgtccacacaaaaaaaaacatccaggacaaataaaagccaaatgaatactttagacaaattcaaactcaaacttagagccactcagaaggcaaggaagtcctatttctttttataacatacatgcaaccatgccacgggaggatatgaaatgtagctcatgaattatgtttatccttaagttctcttggagctataataattagaaagagacaaagtgctgattctcaaccagtatccctaggaggcactaggaaatggaggaggtgaggacatttctttgatgtctcagcaattggagggcaaaactgacatttggagagttctcaaaatgttgctaaaagttctgtagtgtgttagcaccacagagcgaagacttttcctgcccagaatgccaatagatcccccttgggaaacactgacctcaaatgggaggttgtcaatgctgcactaaggcaaaatgagctccttgtcctgggtcctttgatttctcattttgcaaacttaggtgtctggcagatagtcaatgactaaaggaatcatctagtggtgaaatgatggtaagtcacttatccattcaataaatatgtattatgtaccatctgtgtacagtgaaagtactgctattgaccaagagtctctccttgaccaaacgttaatcaggctcctctgattctctccctaatcaggccttaacttttggacttctgtgtctttctctgtattgcccaattttagcaagaatcctcttagactggtttatccagaacccttcatcttcaatattggattaccctcaatatctgatcagattccatatccaccaccatcccttaggtggtttaatcacatggcctgcctttaggtacatttcataacaatgtatccaattttcctgatccaatttttctgcatccttgccagcatttggcgttattattatttttttccaatttttttgtggtaaaacatacataacataaaatttagcatcttaacaattttaagtgtatatttcagtagtattaagtacattcatattgttacaaccatcaccacctatctatctccagaactcttcatcttgcaaaactgaaactctataccatttaacaactctcaattcctacttctcctcagcccctagccaccattctactttctgtctctacgattttgaatactcaaagcaccacaaatagatgaaatcatacagtatttgtctttgcgtgactgtcttatttcacttagcataatgtcctcaagtttcaatcatgttgtagcatatgtcagaatttacttcctttttaaggccaactgataaggagggacttccttctgtcccattttgctattgattttctacacaccttacagtttttttctgtccctcatttcctgcatcactgtcttcttgtgtggttagtttattttttgtagtgaaacatttaaattcctttctcatttccccttgtgtatatctattttctttgtagttaccacagggattatatttaatatcctaaagttatcgattctaatttggaattataccagcttaactttaataacatacaaaaacattgctcctctacttctctgtccccacttctttaaattattgatgacaaaaaattaacatcttcatgcaatatgctctaaaatataaactgatattttaaaagatgtattagcttctcaaattatgtagaaaacaaaatgtggagttacaaaccaaagttacaataatactagcttttagactaataatttaaaaaaattagtctcatatcatgtagaaaaaaaatggagttaacaaagcattattacaataatactagcttttataattgcccacatttttacctttacggagaactttatttcttaactaagattcaagttactattagtgtcctttcatttcaacctgtagaactcattttagcatttcttacagagcatgtgtagtggtaataaacttcctcagctttttttttttttttaatatgagaatgccttaatttcttactcacttttgaaggacaatttgctgaatgtaggattcttggttggcagttttttttgttttgttttgttctttctgtagccctttgactatgtcagcccattgcattctggactcctacatttctgacaataattctgataatcgtattgatgattccttctacataatgagttgcttctctcatgttgttttcaagattctctctttgtctttcaacagtttgagtatactgtgtcttgtgtcttggggtggatctctttgagttcatcctatttggaattcattgagcttcttggatttttatgtttatgtcttgcatcagatttgggaagcttttggccattatgtctccaaataatctctctattctttctctctcttcttaagcttctgaactctcacaatgggtatgttggtctgcttcatggtgtccagcagctctgttccttcttcttcaatattttttctttctgttcctaagactcataatttccttgtcctatcttcaagtttactgactctttcttctacctgttcaaatatgcctttgaatatctccagtgaatttttcatttcagttattatacttttcaactgaaaaatttctcgttctatttttactttttctgaatctctgtattgatgttgctagttagttcatacatcatttattttttactttttccatatcttttagttttttgagcatctttaagatacttgttttagactctttgtctagtagatccacaattataactttttcagggacagacctcgttggttcattttctttcctttgaatgtgccatacttgcctgtttctttttatgtgctgtgattttgttgttgttgttgaaaaccggacattgaaataaaataatgtgataactgtgaaaatcagattctccttccccttccccagggtttgctttttcattctgaattgttgtaggttgtctctgtgctgaggataagcctgagatgtaaagttaagtccttctcacatcttttgtgagcctgcatctttctctaggtatgagcggtgactttctaatttcccatgtatatgtggctgctttaaaatgtactagtctttaatgtctggctccaaacacaaaaggggaaaagaaaaaaaatgaaaacaaaaggaaaagagtgctagccctttaaatcccctggaagtcacttcagctggagaaagaagggcttgcaacaatggaaggaaatgcaacaacaatggcccctggctctgtctgcacctttgtaatcagaagcaacaattagctatcagagaacagattcctgatttttgaatgacagtggcctttttgcacaccctggctcccataaactgtgtgcaggctactcctggaatctgtgcaaggatgcctgcgagtggggtatgagtagctgatattattctaagagctaaagtcaaccacagttaagggcaatttactgcccaagccttctcttggaaattaaaagccttcaatagactctagagttctaaaatagttacatcagacagattatgccatgcagttgttctctaggtgaggagatacattcctggtgctttctactttttgatcttcccagaatcccctccttatcaattttttttatttagccattttaatagatgggtaatgatatctcattatggtttatatttgcatttctctgatggctaatgatgtggaatatcttttattgtgctctttttttttttttttttttttgccatctgccattctcttcagtgaaatgtctcttcatgttttttgcccattttctaattggactgtttgggtttttttactcttgacttttcagagttctttatatattgtaaatactagttctttgtgtaatatgtggtttgcagatatttccaaccagcctgtaaattgacttttcattccttgtagttgggctttcacaaagcaaaagttttaatgttgatgaagttgaatctagcaattctccttttgtggattatgcctttggtgttaaatctaaggacactttggtttgtttttttatttttattttttatttctataggttttggaaaaataggtggtgtttggttacatgaataggttctttagccatggtttctgagattttggtgcacccaatacccaaacagtatacactgtacccaatttgtcgtctctcatccttcacctccctcctccctcacttgaatctccaaagtccattgtatcattcttatgcctttgcatcctcatagcttagctcccacttatgagtgagaacatagaatatttgcttttccattcctgagttactctacttagaataatgatctccaattccacccatgtaactgtgaatatcattatttcatttcttttttacggctgaatagtattccatggtatatatgttccacaatttctttatccactcattaactgttgggcatttgggatggttccatagttttgcaattggaaattgtgctgctataaacatgtgtgtgcaagtatcttttttgtataatagcttattttcctctgggtagatacccaatagtgggattgttggatcaaatggtagttttacttttagtgctttaaggaatctccacgctgttttccatagtggctgcactaatttacattcccaccagcagtgtaaaagtgttccttttcaccacatccccaccaacatctattattttttgattttttgattatggccattcttgcagctgtaaggtagtattacattgtggttttgactcgcatgttcctaataattagtgatgtcaagcagtttttcatatgtttgttggttatttgtatatcttcttctgacaattgtctattcatgtctttagcccagtttttgatgggattgtttgttttttttcttgctaatttgtttgagttccttatagattctggatattggtcctctgtcagatgtataaatggtgaagattttctcccactctgtgggttgtctgtttactgactgtttcttttgctgtgcagaagctttttagtttaattaagtcccatctatttatctttgtttttgcttttcgtttcgtagtcatgaagtctttgcctaagccaatatctagaagagttttccaatgttatcttctagaaattgtatggtttcaggtcttagatttaagtctttgaaccatcttgagttgatttttgtgcaaagtgagagatgaggatccagtttcattcttctacatgtggcttgccagttatcccagcaccatttgtggaatagggtgtctgttccccactttgtgtttttgtttgctttgttgacgattggttggctgtaagtatttggctttatttctgggttctctattctgctccattcgtctccgtgcctatgtttataccagtaccatgctgttttggtgactatggtcttatagtatagtttgaagttgggtaatgagatgcctccagatttgttctttttgcttagtcttgctttggctttgtgggctcttttttggttccatatgaatttttggattgtttttttctagttctatgaagaatgatggtggtattttgatgaaaattgacttgaatttgaaagaaaaagatttctttaggcaatataggcattttcacaatattgattctatccatccctgaacatgggatatgtttccatttgtttgcgtcatctatgatttccttaagtagtgttttgtagttttccttgtagtggtctttcacctccttggttaggtatatttctaactattttatataagaacattttgccttgccttacatacagagattttctcccacatttattttttaaaattgttattattttacatttaattctatgatccactttgagttaatttttgtatgaaggtatgagatttagatcaatgttcattttttttcccaatggatgtctaatgctctagcatcatttgttgaaaggctggacttccttcattaagttgcttttgcatctttgtcaaaaatcatttgagcctatttatggaagtctatttctgggtcctctattctgttccattttgtatattcttctgccaaaaccatgttggtttgattactatagctatatagccctaatattgggtggagatatatatctctttaatgttgggttggttgattcttcccactttattttatgtcaacattgttttagctattgtaggtcctgtgcatttccatataaatggagatcaaataagtttgctagaattttgttagaaatttaatttctcaaagatcaatttgggcagaactgacatctttaccatgctgagccttccaagtctctactcatttaagtctttaatttctttcatcagcattttgtaatttcattatataaactctgtacctgtttttatttacttatttatttatttatttctgagacggaatttcactcttgttgcccaggctggagtgcagtggtgcaatctcggctcactgcaacctccatctcctaggttcaagtgattctccagcctcaggctcctgagtagctgggattacaggcacccaccaccatgcccggctaattttttgtatttttacaagagagggggtttcatcatgttggccaggctggtctcaaactcttgacctcagcctctcaaagtgcagggattacaggcatgagccactgcacccggcctctgtacctgttttattaagtgtatacctgaatcttttattttctttggaactattgtaattgatacactgtttttgatattggttcctacacattctttgttagcatgtaaaaatacgattaactgttgtatgcatcctgcacccttgctgaactcacttgttctaggatttttgttgttgtagatttctagggattatatatgtagacaatcatatcatctacaaagagagatttatttcatttatttccaaactgcatgccttctattttcttttcttgccttattgttttggctagactttccagtactggttgaataaaagtcatgagagtgaacctcctggccttgtttctaatctcagggatgctctttagcaagtcgagataattcatcactatttctaaattgctgagaatttttattataaatagatgttggattttgtcagacgcctttttatatgatgatattatttactttttttatttttaatttcttccagtgtttcctcaatgaattttcttctgtagcttatttctatggtatattacattaattaattttaaaatgttgaaccaaccttacatacctggcatataataaatcctacttcatcatattacataattctttttattctttgctattatttcattaagaatttctgagtcaaaatttacaaaagacattgaactatagtcttctttcctccctcccccttcttcctcttcctccttcttcttctttgcctggttttggtatcagggtaataatgagttgaaaagtgttcctgcctcttctattttctagaaaagataatataaaattggcattatttttttttaacatttggtataattctccagtgaaacaatgtagtcctagagatttcttttttgggatatttttaattattaattcaattttttaaatagctataggactaggctagggctgttcatttcatgttggctgagtttagctagttttttttttttttttagaaattggtctatttcttctatgttcgttgaatatatgagtgtaaagttgttcatagtatttttattgtgttttagtgaccacaggatctgtatttatatttcctatttccttcctggtattggtaattttgttattgtcaattttgctagtagtttatcaattgtattaattttttagaagaacctgttctttgtctcattgactacctttttcttatttttaattccattgatttattcttttatccttattatttcctctgtctacttgcttttactttatttttctcgtttctcaaaataggaacttaggttattgatgtgaggcctttaaagacttactctttgacctgttgataacttagaagtgtgttataaattttcatgttttagagatttttctgctatttttttgttatggataacacattctgtaaaaatttgctaagcattttttatggcctatgatatgatctattttggtgaatgttcttcggttgcttgagataaaaagtatattctgctgttgttggatggagtattctatatatttcaattagattctatttgctgattgtgatggcgcaatcttctatattcttgatgattttctgtatagtagttctatttgttgttgagagaggacattgaagtcctgaaatataattgatgatttatttgtttctctttcagttctatcagtttttgctttgtgtattttgaggctctgttatttggtatgtacataagatcattttgtcttccaggtggatccattcttttatcattatataatgttccttcttgtttccagatattttctttgttccaaagtccacttttatcagatactagtataagcactcctgtttttttaaaaattaatatttgtatgatatatgtttttccacccttttactttcaacttaactaatcatagaatttgaagtgagtttcttgtaggcagcatacagttagattatgttctattattcactttgtttatctctgtcttttgatggtgtttagatgatttaccttcaaggtaactattgataagttagcatttcactataccatttcattacttgttttctatttgattcctctggttctcattcctctgtttctcttttcttgccttcctgtgtgtaacctaaacattttttaggatttcattttgatatacagtgttttgggaagtacttctttgtatagttttcactgtggtttccctgagtactaaaacctaatatgtgacttgttacaggctacattatcaacatttaactagtttgaaacttcactcccatttaaatctcttgtccttcccatttttcaataacattgaattgagtatcagatggtattataatttttgttttaatcatcaaacatgatttataaaactcaaagagaaaagaacagtttattgtatgtacccacaaatgtctttccaatgttctttcttccttcctaatcctctaagatttcatcttgtattgtttcctttctgtttaaagaactttctttagccaatctttaagagtaggtctgctagcaacaaattcatttacttttccttcatctgagaatgtttttatttcctcttcactctggaagtatagtttttccagacatagaatttacagttgataattctttcagtacttgaaaaatattgtggcatttccttctcatctccattttatgagaaatctgctgtcatttgaattggtattcctctataggtaatgtgtcatttctcttactgctttcaagatttcttcagtatattttatttttaaaagattaattatgatatatcatagcacagatttcattgggattacgtgtggggttcattcagcttcttgaagctgtaggtttctgtctttcaccaaattagttaagttttcagtcatcatttcttcaaatactcgtgtttatttgtttgtttgagacaggatctccctctatcacccaggctggagtatagtggcacaatcacagctcactgcatgcagccttgacctcataggtgcaagaaatcctcctgcctcagcctcctgagtagctgggaccacaggtgtgcatcaccatgcccaatttatctttttcttttttcttttcttttctttttttttttttttgagacagagtctcactttattatacagggcagtgacataatcaaggctcactgcaacctctgcctcctgggctcaaccaatcctctcacctcagcctcctgagtagctgggactacaggtgtgcaccaccatgcctggttaatttttttttttttttttttttttttttttggtagagacagggttttaccattttgcctaggctggtcttgaactcctgagctcaagcaatatggccacctcagcctcccaaaatgctgagattacaggcatgagccaccatgtctggctgtcagctaatcaaatactctttcagtcccattatctttatcctcttctgggactccaatgacatgaatgttgggccatttgtcattgtctcacagatctctggggtcctgttcattttttcagtctatttttggtctattgctctgattgggtggattccattgttttgtcctcaaatttagtaattctaccctctcttatctctaattaacagtagatagtctaacctatcgttaatactatccagcactatttttatttctgttattttttatttctagaatttttattcagttgttttataacttctatttcttttctaatattttctattttaaaaaattgtatcaaaaatttgcagctgctttataggtcatttatatgacagatgctttaaaattattgtcagataattccaatatctgattcatcttggtgtttgtgtcagttgattgtcttttctcattcaatttgtgattttcttggttcttggtatgaaggataattttttattgaatcctgggcattttgcctattatgataggagagactaggtcctatttaagtctttcgttgtaagtcagtaaccctgttaaattaatcatgtgggtcttggctacttttatcagctgtggctccagtggcactctaattttcacagactttgaggtgttattttgttctgcttgattaatctggttgcaagaggccactggttcctgcctctaccccactgccttgtggggcagaacagatttccccacactgggcctcaggtatctctcagtgggagaggaatacggtggggtctgccatctgcctcagtgtctttgggcagggaaggagagtctcaggcatgtgagaacaaagaggcttcctagaattggccactttttgtggttgcatccttgttgctggttatgtcttcttgccccagtgactctagacaggggaggatcatttgaggcacacagagaaaaagaggcttccctgacagtattatttgctatagttcattctttttttacgtgttctgcctgcccacttcagtatttcttggtggaaagggagagtctcagggctgagggagagcagagtccttcctctggccaattatttttggcgaggcttccaattaatctctttggctggtagcgttgaacttgtctgatagttccagagggacatccgctcaatcaggaaaaaaaaaaaaaaaaaaaaaaaaaatcagcctccctgagctgcttcttgttgccaggcttggacttaggaaacactcagttaggaaacactcggtctaggtgaccatcttctgttgggttgggacactctaaacactctgctactgtgctgttcctccaggcctagggaggccagctcattctttttttttttttttttttttttttgagacggaatctcgctctgtcgcccaggctggagtgcagtggcacgatcgcttctcactgcaagctccgcctcccaggttcacgccattctcctgcctcagcctcccaagtagctgggactacaagtgcccaccactacgcctggctaattttgtttttgtatttttagtagagacggggttccaccgtgttagccaggatggtctcgctctcctgacctcatgatccacctgcctcgccctcccaaagtgctgggcttacaggcgtgagcaaaccagctcattcttactgtctttcagcgctctcatttggttgtctcttgtaccattaccagagttggtagttgttcttagcaggaaaaagcaggggaaaatgggtctacatcatcttttctggaccagaaatctgtttattatattttaattgcatatttccattcattttttggcaattaacccttttagatcttattataattatttgtgtacatccacggatttgaaacatcttggtaatttatctttgtgtattttacagtgccttgaacaaagcagattcttccttaaaggtacttatacatgaatgaatgttcatgcatattttctctggggctgtacaatggaacaagacctacctgttaaaagagtggttgttggtagaatgtaaacatgacttataagtgttcatccttgcaaatggacataggagtaacagggagaaacttgcttaatgtgatttacagaaacctggttcagaacataggctcacttggtcatcacttccctctggtcatcacaatctcacaatcatttttctgctttcagcagatgggaacatgtgataatgctgtgacagatttccccaccattacttcctaaagccattacccgcttctagcttaaaaccttgaacacacaaacacacacatatatacacactaacatacacatacatgtatgtttcaagcatccaagataggaagtaggggaacatgatgaattttcttttctagaaataaaacaatcatttgtccaatgaaagatgagcataaaacacccatacctaataacaaatggcacagaacaacattgctgggaatccccaaatagacctcacgaaaacatcactgaagattgcatgtgagagctagaaggcctcaggcagggaatgccatggaatgtaagaccaggcccctgctggggctcagaaataggaatgatagaaaagcaagcaggaagagaccctgggcaattgagttctcccactgagcaagaaagaattgaaaataacagcattaggcaggaaaacaatggatgcctgacctcccatttaaccattgtaatcatgcattgttatcaattggcttggtcttttaagattcctagtcacttgtccctcatatctgtggcacatacttatcactgtgtggatttgctttttggcaaacagaagttttaatttttaatggagtcaaatctattactcttttcagaaacgatctttctctttgtcttcaagtttatgaagtcccctctcactccagtagggataaatactcatttctattctgggtttctaatgattgattttatacatttatttattgctttaatccagctggaattaacattagcatatggtgtaggaagactgtaattcttccaactctaatgcattcttgataagtaaaaaataggatttcctacagtagaaaactcagcctagaaacctgcctttcagtatcctgaggcaggaatggagtgaatgaggcactttcctcaaacctaaaaacctcatcctgttttactggggacttgggataaccttctttatttctcagtgtctcctcctttgtgtacagtagcgacacaaatatccactgtgtttccaaagagaagtcaagtgcttaagctcctcaaattttctgagtacattctatgtagaggattttccattactggttacacttaatacacagggccttgctggagaatgtgaccaggagaactagaacttcagaaaacacaaaatgagctatcaaaggcttggcactttgtaggggtgtaatcagaagaaaaacgagtcctaatatttagaacacattagatgtaacctcttaaactccaaagttctcttcaaatcttacctatttaatttgaaagcaagcaatgttccagtgttaacatttctgatttgggggatgccagatagtgaaatttggattaaacagagggaatttatagtcttattctaattaataaatggacttaacggggttctgaaaataaaacaacctcataattagttggtaattaacatagctaagagccaggtagaactgtccaacctgtgtcatattctcacaggtgtgcccacaaaatacaatattatatagaataaatacattgcccaccttcattcatccagcaagatgtactgacttttcactgtaggcatgaacctgaagggaattaaaaatgaaggatggtccttgctctcacaaaagctgccaaattgggtacactcactcagtgtcttcaaggaacacatggtcaggtttctagattatgcttaactagattgggagagtggattaccctcagaatacccttgataaaagctttcaaaattttcctttactcacaaaaccatgttttcagggaacctaaacagaagtccaatatataagatagaataatagataaaagtataaattatttggtcaaatgaggactactagtgttctcaaaacactaccccacttccaaaatacacacatacacacacacacacaattcctggaactttacagagtagagtttcaaaatcactgcagctgatgaattgacaaatagaaagaaggggtaacagataggtacaaatgtaatataataaacacaatagaatgttaatgttagacaccaagcggtggttacacagggtgttcactataaaattacttcagttttcatatacgtttaattttttcataatacaatattgaaaaaaaaatcccgctcttgattcctatatctgaaagttcttaaagttttagttgagtaaacatttagaattattggccgggtgcagtggctcatgcctgtaatcccagcattttgggaggctgaggcaagtggatcacctgaggtcaggagttcgtgaccagcctgaccaacatggtgaaaccccatctctactaaaaaaaaaaaaaaacacaaaaattagccgggtgtagtggcaggcacctgtaatcccagctacttggcaggctgaggcagcagaatcacttgaaaccaggagaagaagattgcagggagctgagaccatgccattgcactccatcctgggcaacaagagcaaaactctgtcttgaaaaaaaaattggaattattatttgttcttaattgacccctttatcattatgatatgtccctctttatctttggtaaaccttcttgtcttaaagtttactttgtgtaattgatgtagccacattggctttctaaaaattatttctataacatatatttgtattccttttacttttaactctttgtgtttttgtatttaaagtgcatatgttgtagtcagcatattattgggttttatttattttgtatctttcatgcacgtccgtgtgaagagaccaccaaacaggctttgtgtgagcaacatggctgtttatttcacctgggtgcaggcgggctgagtccaaaaagagagttagcgaagggagataagggtggggccattttataggatttgggtaggtaaaggaaaattacagtcaaagggggtttgttctctggctggcaggagtgggggtcgcaaggtgctcagtgggggtgctttttgagccaggatgagctaggaaaaggactttcacaaggtaatgtcatcacttaaggcaaggaccagccatttacacttcttttgtgatggaatgtcatcagttaaggtgaggcagggcatattcacttcttttgtgattcttcagttacttcgggccatctgggcgtatacgtgcaagtcacaggggatgcgatggcttggcttgggctcagaggcctgacagtatccatattgacaatctatgactattaattgggacatttagtccatttatatttaatgtaatgatataattcagttttaagtctaccatctgaatatttatgccatctttttttgtttccttcttccttctttcttgccttctttctgttaaaatgcatatttctaaagtttccatctttataccactattagggtttttaattatacctctttgtagcgtgtgtgtgtgtgtgtgtgtgtgtgtgtgtgtgcatgcatgctctaggactaacaatatgcatccttatcttatcaaaatctacctaaaattaatattatactatctcatgtaaaatataagaacctgacatttattacttccttgtccattatgctgtcacatgttttacttctatttgcattataatcctttcaatacattgtcatgagttttgctttaaatagtaagttaccccgtaagagcttaacagaaaataaagacggtttaaaaatatatatattattccatatatttaccatttctgtgctcctcattccttcctgttaatctgtttccatttgctttcactttcttttaggctgaagaatttgctttaacatttcttataatgcgggttgactagcagtacattttcttaggttttgtttatctaaaacttaggttttgtttatgcagccataaaaaggaattagatcatgtcctttgcaggggcatggatagagctggaagagatcatcctcaacaagctaacacaggaacagaaaaccaaacactgcatgttctcactcataagtgggagctgaccaatgagaacacatggccacagggagggaaacaacacacactggggcctgtctggggtgggatggggggcagcggtgggagggagagcatcaggataaatagctaatgcatgtgtggcttaatacctaggtgatggtttgataggtacagcaaaccaccatggcaaatgtttacatatgtaacaaagctacacatcctgcacacgtttcccagaatttaaaataaaataaatttaaatttaaaaaaagaatttaaaaatgtcattctattgtcttctggcttgaatagtttttatttaggagtctaaaataactcttactgttgttctcctatatgtaatgtctctccactcctcccatcctcagcagcttttttctttacttttggatttttatcagttggccgtcatacatccaggtatggttttctttgtttttatcctgctttggtttgctaaacatcttcaacctgtagtttgattttttcactatatttgggaaaatttgttcatttttttaaactattttttttcctccctcattctctctatcctcatttctggacctcaaattgtacaaatgttagacttctcgcttttgccccacagatcactgaagattcatatattttttctattttttcctcctgttcttcagatcagacaatttctactgatctgtcttaaagtttcctgatcttttctgtagtttctaatatgttgctaaggccattcagtaaacttttcattttggaaattattatttgcagttctataatatagatttgtttcttttttatagtttacatttgtttctctgagatttcccgcctcttcattttatgtcacccattttatgtcaagtccttgaatatacttatctagttattttaaattcctcattttctaattctaatgtctgagttatttcaaagtctgtttctatttattgcttttttctgattaatggagcttcctcttcacacatccagtaatttttttgttgtatgctaaacacagggcgacacatttagggaatctgcattatattgtcttccttatagggtactgagtttttttctggcaggaaattacatttctaaaatattctcttgaacctttcattgttagaactggtctagttcaaatttgtccttagttgtagaacacagccttatggtagtgtacaggtctcactcctgaggctggcctttctggggtttcaactgaatgcccaggttctcagggaaatctgccctctcagactaagaattccaacgtctcccatctctgggcaaccactagtgtctttgttcggctcttggtcccacagtgaaccctctctgctaggcctcatggtgtcttgccctgcttatacatagtcaatccttcagacaatgacctgcaaagaaacctccatgtacactacctccacatgccctacctcatgcatctctcttattcagtaccctactctgctaattccagcccctcagcagcaacaaagtacaaactctgccttatcagttcattgaaacaagcatgtaatgcttggccccacctccttactagccagtccagtgaatgcacccctaggcagaaagccaaggtgaatgcaaggcttgcctcaggggtttaccttgtctcaagggtcacagccctgcattgcctgttagccaatttctgaaaacagttgccgcatacattttatctaattttatagttattcatgaaatgaggtcaagaatgataccagttacttcattgtggcttgaaaactaaaatgctttagtatctctctccactaccaccatcaacacttgaactttacaaatgatcctatttattctaccacctgctactaaatgatgaaaaataattatcaagtgagttgccgaggcttcctgctcttatttctcttaccatgttctcagatatctgactgctagctaatgtctctgcccgggaacaaaagaagccagagaaggagaaagaggaagctcaagttctcccatattctctcttttcaaaagttacgaagagtagaaaatagtttaacaaggaagtttagagattacatgaaaattgtaatgagtctgatgcaccagcttccaataccgtcatcacaaccagcccttccttggtggtagttatgtattggttgcacctgatacctaagcagtagtctgctctcttttgcaataaatcacatctgtctctatgatagactctgacctcagcctaccaacagcatgttttttaatgacactggcttgcaaatgcatctgatttgaaataaactttctttgtaccatttttaggttctgtacttttgaataaaggtgcaatcacagcaaatcaaattctcagaagactacaataagtaaacattaagcagtgttcctttttgaaagcaggagagagtatatgtttaggaatgttcaaggattagtctggttcttttttaagtttttatttattgattttatcttaacagcaaaatacaatgcctggctagagcctttaaatacagataaacaatccaaacaagctgcaacttacgtatatcaatcttctaagatcacctcagaaaagagaaggtggctcccaacttgtcccaagttaaatacatttaagagaagcaaatgggaatagcagctaaagctgacggacagggcaattcgaggcatcagatgctccctttcaggttgctgagatgcttccagatggttcctgtatctgcatggccaaagtggtataatttattttcttagctttttcaatctctctgcatattacatcacaattttagctcaagtttatttttgttgtgtgtatttgacaatcctttggtggtgtggaacttaaatcatcacttcccagagcaagaaaacaaaggctgacacttctgatatagaaggctgcaatctggaaaggacgatggttggaagggcaggtggatgattgggaccaccactaggtttattctttatttgttcaacatgttttcattaaattagggtacagaggtggacaagtcagaagcagtctctctcattatggagtttacactctaccagaggtgagaatggaggacttaaaggtagacaaaaatgcctaatgtgtcacctagagaacacaaccaaaaatgagttacccaacaacttcatacagctgctacctgcagttagtatgtacatgccaggtaagctaggaagaggcctacagcctctcctggaaaatcttgggagaccaaataggttttgatcttgaccattccctgaaaatcctcatctataatcttcaaatgcaagaaggaaccaggaggtgccattatgtttcaccacaagaactcattttttttaattactgtttttttcttttagtgagcataattttttcttttgttgttattgttgttattgttgtttttgagacagggtctcataatgtcacctaggctggaatgccgtggcgccatcttggctcactacaacttccgcctcctgggttcaagggatcctctcacctgagcctccatagtagctgggattacaggcatgtggcaccatgcccagctaatttttgtatttttttggtagaggtggtgttttgccatgttgcccaggctagtctccaactcctgggctcaattgatctgcccgcctgggcctcccaaagtgtttggattacaggcatgagccactgtgcccagccaattttttaattacgtaaattaaaggggtacaagtgcagttttgttatatggatataccgcatagtggtcaagtctgggcttttaatgtaatcaacacctaaatagtgtacattgtactacctcactcccctcccaccccatcatcattctgagtctccagtgactattattctatactctatgtctacatacacacattattcagctcccacgtgtgaggacatgtggtatttcactatgtttctgagttttttcacttaagataatgacctcctattccatccatgttgttgtaaaagacatgttttcattcattttctgtggctgaatagtattctattatgtatacatatatacacacacatatacataaataaaatgtgctgtatgtatatatgtgtatatgtatatacatgtggtgtgtgtgtatatatgtgtatacatatgtatatgtgtatgtgtgtgtgtatatatatacatatgtatacacttatatacacacacagagcacattttctttatttaatcatcttgatttttttggaagagtttcagtaggatgagtatcagttcttctttgcacattttgtagaatttggctatgaagccatccagtcctgggcattttagggggaaggttttaaaattattgattcaatcttactattcattattggtctgtttaagatttctatttctttctggttcaatcttgggcagtcatatgtttacaagaatttgtcaatttcctctacattatctagattgtgagtgtacacttcttcatagtagtctctgatcatcttttgtattcctatggtatcatttgtaatgtcttctttttcatttctgacttttatttggatcttttcttggttagtacagccagaggcttatcaattttgttcatcttttcaaaaaaccaactttttgtttaacttatccttggtattgttatcttggttttcattttcattttatttttatttttaacaaccaatttatatcattcaaacagatagaactgccttgtgcttgtttcagccttgttttctggttattaaaagaagacctgaaccagatacaaattcaccatattttccttcaaggacacttctcataaaagctactaatatgcatattttggcatacaaaatcacatttgctaaaacttttttctgcttaaatacaattcttttttcatttagcaactgcatgttattatagaggtcaattcattgggttataagagaaaagaaacacttattgaagattcacaacatacattccattatatatcgctgttcaatagaatgcaaaattagtaaatatcacccctacaattggaccatgtaactgatagattttcctgtaaggagttaccaaaatgtcatcaaaatctagagtttgacaatttccaggccttatcctgaccttctcaatgcaagttgcacaaatgaaatcagttatccaagagaaaaactgggatagaaataggggttaatagattatgatcctaagttgaaaaatacagagctctcagtttccaagatttaccattttcaagtgtccctaattttgtcccaagagtggctccagcctgggcatgacagctggctgtaatggggacagatagctctttctttctaagaacaagatttaccatttgttttgtctgctctctccacaagctcttcctgaaacatatcagtggcataataaatatcatctcgttttccatcttaaggactttagtactcaaaggtaactgttttgagtccttaaaaaaaaaaaacaagcaaaaaaaaaagtggtttgcaaacttttgtctgtgacataacaccaaagccgtagtaaagtcaatgataataataataataggtacttacttgggctagggactgtgctaggcttcttttcattcattatctcatttaatattcacagttcctacatggcttagtatttcttgcagaccctttaaatgcttacatatagaaatctgccctactatttcaagtataggcagaagttggcaatacaagaaaagacaaagggataagaatccgtccaactggacaaaacaacttcaatccttaaaaagtcctacccattttagaaacaggtcaatgaagctacctgttatgattgtagaagtcatgtctgcttactgcacctaatttgagaattacagaaaaacatttttaaaaatcacatattattctatcactcagagataaacattgatagtgtttttatagttcccagtcttatttatatatttgccttctttttttgctatttgtttaatttttaaaccaaattcggattacatagcaatgcaattttcccatattattagatataatttttgaaagattttaaaacactaccttatgttccataatttatttaacaatttcactgtttactgacagataatttagagtacttaattattctataaatactataataccaaagtataataatgaatttttgcctgcatctctatttctttaagaaagatttctataaatgagattactagatcaaaaaacattaaaaaattctttttctagggagaatatccccatgcccaattccactacatttgccaactagctgaaaatgatggggttttttttgcatgttttaaattgttatataatggtattagattgcattcttctgaaactcattttcaaaacatctttactcaacatatatttatagttattcttgttactatatgttgtttttactcattctttttttgcttttcgaaaatcgtctcttagttgaataataatatttatgtattagctattggtgaacatgtacgttttcctgaattatcaaaaagatactattgtaagtatgttgtgcacattccccttggcatgtgggccatgggagttgcatgtcttcaactattctggatgatgccacactatattccacagtggctgtaccagtttgctctgtgaatgataatcttcattgctttacaacctctccaacacctagaattgttagatttatttttccctttaattttgacaattggatagatgtaaaaagctatactgtgctgattttagaaggcatttcctgattacttttgcagttgtacattctttcattcattaattgtccatttctgttgcttctccaatttatgtttcttcagaccccttagttatttttctattgatttttatttctgattacttgtttgtattaactctttttatatttcatattaattttctactatgaaacattctgcaaatacaggcataacctgaatgatgttgcctcgattaacattttcatggtaaaatgactcttggtttttaaaatccaaatttcatcatctatttttttttttttgccaatgttcatgtagcaaaactttagatttataataccaaactctgcaaaactttcaataaaaggaaatataggaaaatcatcaagatattttcaaaacatattcagtagaacatcagaataatatatagatattttggaaagcaagctgagtgacaacacacgaaacacccatttcagaagttgctgatgctaaaaggccatcataccatcagtgtgagccacacttggccaccaggcactagagcacatttcccagtgccttccccattttactttttttgcttattgttgaaatccccaaattgttgagaaaacactgaagacaattgtagagaagaaaacaaaacaagtgagaatagctactacgtacaaagcaaacattttataacatgttaattgtagaagtcatcaaggatataatttttttaagtacaagtgatcgaggatataatttttttaagtacaggcataccttgttttactgcactttgtttcattgcacttcacagataatgtggttttacaagttgaaggtttgtggcaactttgcatctagcaagtctattggcaccatttttccaacagcacgtgttcatttcacgtctatgtatcacaatttggtaattctcccaatatttcaaactaattcattattattatgtctgttgtggtgatctgtgatcagtgatcttagatgttcctattgtaagtgttatggagcccaatataagatggtgaactttatcagtaaatgtttgtgtgttctgactgctgcactgactagccatttttccctctcctcaggcttccctattccctgagacacaacaaattgaaattagtccaactaataagcagacaacagcttctaagtgttcaagtgaaaggaagagtcccatgtctctccctgtagatcaaaaattagaaatgattaagcttggcgaggaaggcatgtcaaaagctgagctaggatgaaagctaggcctcttgcaccaaatagccaagttgtgaatgcaaaggaaaagttcttgaaggaaattaaaagtgctactccaatgaacatacaaatgataagaaagtgaaacaggcttgttgaggatatgggaaagtttgagtggtctggatagaagatcaaactagccacaacattcccttaacccaaggcttaaaccagagaaaggccctaactatattcaattctatgaaggctaaaagaggtaaagaagctgcagaagaaaagtttgaagatagcagaggctgattcatgaggttcaaggagagaagccatctccagaacataaaaggcaaagcaggaagtgcttatatagatgctgcagcaagttatccagaagatctagctaagataactaatgaaggtggctacactaaacagcagattttttttttttttttgaaacatagtctcactctgtcactagggctggagtgcaatggtgcgatctcagctcactgcaacctctgcctcccgggttcaagcaattctcctgcctcagcctcccaagtacctgggattacaggtgcccaccactacgccctgctaattttttgtatttttagtagagacatggtttccccatgttggctaggctggtctcgaactcctgacctcattatttgcctgcctcggcctcccacaatgctgggattacaggggtaagccaccacacccggccaaaggcagattttcaagagagatgaaacagccctctgttggaagaagatgccatctaggattttcctagctagagaggagaagtcgatacctggcttcaaatcttcaaagaacaggctgattcttttgttagctgctaacgcagctggtgactttaagttgaagccaatgctcattgaccattctgaaaatgctaaggcccttaagaatgatactacaccaactcttcatgttctctgaaaagaaacaggaaagcctagatgacagtacatctgtttatagtatggtttactgaatattttaagccctctcttgagacctattgctcagaaaaaagattcctttcaaaatattactgctcactgaaaatgtacctggtcacccaagagttctgatggagatgtaaaaggaaatgaatgttgttttcatgcctgccaacacagcatccattctgcagcccatgggtgaaggagtaattttgactttcaagtctcattatttaagaaatacatttgtaagactatacatagtgatttatcagattgatctgggcaaagtaaaatgaaaaccttctggaaaggattcaccatgctggatgtcattgagaacattcatgatttatgggaggacaacaaaatattaacatgaaaaggtgtttgggagaagttgattccaactctcatggatgactttgaggggttcaagacttcagtggaggaaggagctgaagatgtggaagaaatagcgacaactagaatcagaagtaaagcttgaagatgtgactgaattactgtaattttacaataaaacttgaatgagtgaggagttgcttcttacgggtaagcaaagaaaaggatttcttgaggtaaaatctactcctgaagaagatgttatgaacatcgttgaaatgacaacaaaagctttagaatattacataaacttagttgataaagaagggttggagaggattcactcattttgaaaggagttttattgtgggtaaaatgctggcaaacagtgctgtatgcaacagagaagtcattcgtgaaagcaagaagccactgatgttgaaaactttactgttttcttactttaacaaattgccacagccacttctgccctcaacaaccaccagtctgatcagtcggcagccataaatatcaaggcaagaccctccaccagcagaaagattatgacttactgaaggctcaaatgatcaccagtatttttagcaaaaaaaatttttaaattaagataacatatttttttataatgctattgcatactagactactatagactgtaaacacaacttttatattcactgggaaacaaaaaagtttgtgtgccttgttttattgcaatattcactttattgtgatggtctggaagtgaacatgcagtatctctgagatatagatatgcctgcattttaagtctcagtgtgacattattgttctactatggttattttactgtgttttacttacacttcaagaaattcactagagggttggtttgacatataacacattttttcccatttaagtaatggcaaactgtctcaaggaaatcatttttgggtaatacatctgatcatcaggaatcaattagtaacatcaaacaaggggtgtctatatttttttctcagcatgttccttatcttttctttgtttgcttgtttgtttgttttctattttacatgtctcatttaatcctggaaaaatgctataaagtagctagctgattctatcttacagatgagggcactgagattcagagaggtcagtagctggctttattatcttcttcactgtggctgcaataaaaaataaccacaaactttgtggctctcacagctctggaagccagaagcccaaaattaagatgtttaagagcaaagatccctccagaggctctaggagggattccattccttgccactttcagcttctggtggttggtgggactcttgtaatagcatttaggtctcccaaaataatccaggatgatttcctcatctcaagatcctcaatttaatcatatctgcaaggaccattttttttgcaaacaaggtcacattcacaagctctagaaatttgatgtggatacgtttgcagagccaatattcaacttggcacactcaccgaaggccacatagcagaatacggtgtcaagtccagatataggagttccagactccagagttcatgttctttccactccatgtgcggttttccatcacattgtgtgacctgtcgtctccatccctcctcacacctcagattcccttagtcttcccaacctcagagtgaggttaatactctgttctctccgtgccagggtctcttccaaggagagtattcaagagctgtgccacccctttacaaattccattgcgcatccgtgacttcctttccaatacccagacagtttcctgagtctagttcacagactagatcaccaaagcaaccttcctgggagtaaatattacatctttcccattcatattagtttctcaaaagtgctcaagagcctgaagaatgacagaagagaaatgctaaagattgaaggagttcagaacacaatactccaaaatatgttgctctagtatattgactattttgagcttaaagacacttggaaaaacagcagatacaaaaaatatactctgagctttcttcttttccttagaaacaggagataacttgtcctccctacgccagagggaaagtagcgttcttatcatcaaagacgagaagttgatgctgagagaaatctgaacaaacacaccttattaaagtaacccttatcttcctagttacttctctacccaattaacctccctagcccaagcccgttggctttgtcacatactcacaattttctattcctttcccaattcagtacataggtgttcaactttcaactctgtctttgggtttcatttccttaagagggctcttgtgctcacataaaaattgaatgaattaaatttgtatgcttttctcccgctgatctgccttatgtcaattcaatcctcaggcccagctaaaaaaccctaagagagaaaatttggcctcccctacaatgtcatcctctttcttttttctggaccttctatctgctggtacttaagatactaaaatggacgggagaaagaaagcaaaccatgttatgtcttctgcattggcctggtacactccgtttgaaggttactcgaagccagcttgctttttgtcaagagattgcttgatctggagccatatagaaaatggtgacatctccaccccgtgacatatgggccagtaagggcttgcaaagttccattctgcacacttctcttcattctaagaacgagtattcattccatttaaacacatattaccaggaattcaatccaacctctctttttacagtctacctagaattactattatactatttacatacaatatggaaacctcacacatgtatgaatctatttacaaactccctctaaattcaagttgtcattgaaattacatctacctgtattataaatcccataaaaatgatgctatagtttttacttaaacaaacatacatattcttaaaacattaggaggaaaaaattgatttttatatttatcttactatttatgatttctttatttttacataaggatctgagttttcatctattttttcttgtcatcccaaagaacaaagcattttttacagtgtaagttggtctgctggcaataaatattctgtttttgtttttctgaatgcaactttattttgactccgttcctgaagtatgagtatctttggatatggacttcgggattggatagtcatatctccttacagcacattgaagatattgtttcattgtcttcttgctttcatagtttttgaaggtaggttggcagtatttagcagtgcagtttcatgtatatagtgtgttgtttttctccggctattttcaagatagtgtcttgggttttcagcagtttgattacaatgtgcctcagcatcttgaacgtgtacatttatctctcaccaattttgggaagtgtgtggggccactgtttcttcaaatattaggttggcacaaaagtaattgtgggttttgtaatgaaaagtaattgcaaaaccacgattacttttgcaccaacctaatatttttatgacccattctctatcacctttccttctggggaaccaattactcatatgttaaaagaattatcccataggaacctgaggctctggttgctttttttttaatcctttttaaaaatacaatctctgttcttcatagagaaaatctatattgatattatcaaattcactgactgctttggtctgcctgtgtatgtatattccaaaggtcagccagagatttgagcagaatttacaccaaaaatttgtaatgctccttttctggccctctttttaatgacattcctcccttactttccagtagctggggttgctccaaactctgtcccctggttcataaggccagaaagactgagcttcctacaggagtttcagccactctgtgtggccctacctgtggcttgacctcaggataatagtcataagaaatttaacctatactacttccaggtgtcttcaacccccttcgagaatcttgctgcctttgttcattcttcagatccctcagagagttttgttgttgctgctgtttgtgttttgtgagggtttacagactacatgggaagcagaaattgttctttgggatttaacttttacaaaaatcacaagcactcatctcatttgtggcagtgaaagtaatatttacaatgttaacgttaaataacataccttgctacaggtttccagtaaatatcttgtattatgctgcgtaagctcctcctatttctagctcattaaataaatattatttgcttgttggtcttatttaacagaaaaaaaaggagtctctatttattaattcattagttttattttccacagattgattttgttactctcctttaataatgaaagttctcagggctattaattttctgctaaatacagctttagccatttaaaatattgatacatagagttcttactctcctaacagtttattatatagtttcctttcctgtttgaatctggagtttttagaaaaaaatttggtttttgttatcattatttctcttttccaagctactgatttttgcatttaaacttttgctattaatgtctagctctatttcagtgtaggcagaacatggaggctgttaacactttatatttcataatttaatatggtttctttgagatataatatatgatcaatttttttctaaatgcttcatggctccttaaaaaagtgtattgcttatttctagagaacaaaatttaataaatatttattaaatcatctttgttagattattaaaatattctatcaattctgtgtttatttgacccatgaaagatcaataaaagtgtattaaagtgtcatacaacaattctacttccatcaatttttccttatatttctaacagcctttgtttcatgtattttgaggctgttaccaagtcaataaaaattcagaactgccttatcttcattgtgaagtctatcttaaagaaaatataaccttcttgattgcatttaatatttttatagcctttgattctatttcatctaaatattgccaagattacttttttttttaatttcgcttctgcctaataaatcttgtccattctattgttctttcttttttaatctaatgagttactttgttttaggtatatttcttctcagtaccctacagttagattttgctttttagctgaaatatacagttgttgtattttaatagactagtttaataaacatttcacaatgagattcagctttacacaatgctttcacatttatatttcctcttttcaacatatcaggtacaggggaaatgtcattcctatgttatgcataaggaaattcaaagccagataggttagatgcatttcccaaggtcattcaggtaatatatggcagtggcaagacttaaccaaaggatgataatactaagaaaatggctttttacaaacatatactatccccttgctgaacatcaatattcagatagactatttggtcaaattatgttttgtgtttttttttttgtttttttttttagacagagtttcgctcttactgccccagctggaatgcaatggtgcaatctcagctcactgcacccttcacctcctgggttcaagtgattctcccgcctcagcctcttgagtagctgggattacaggcactcaccacaaggccaggctaatttttgtatttttagtagagttggggtttctccatattggccaggctggtctcaaactcctggccccaggtgatccacccacctcagcctcccaaagtgctgggattacaggtgtaagcccctgtgtccggccatggtcaaattatctaatttttcttccactgggggactttatactatttatttttattgccgtaaatgatatgtttgtaacactgtaatcttatttcatgctttgtgtagtttatgctttactcttttttctttgttttatatactattggccctccttgtctgtgggttccacatctgtggattcaaccaatcatggattgaaaatgctcagtgatatggtgtggctctgtgtccccacccaaatctcatcttgtagctcccataattcccttgtgttgtaggagggacttggtggaagacaattgaatcatggggggtgggtctttctcatgctgttctcctgatagtgaataagtctcacaagatctgatggttttaaaaacaggagtttccctgcacaagctctctctttttgcctgctgccatccacataagatgtgacttgctcctccttgcctttcaccttctgccatgattgtgaggcctccccagccacgtggaactgcaagtcaaataaacgtctttgtttgtgaattgcccagtctcaggtatgtctttatcagcagcagtaaaaaggactaatacactcaggaaaaaaaaatggcatctatactgaatatgtacagacattttattgtcattattccctaaacaatacaactatttatatagcatttacactgcattaggtattataagtagtctagagataatttaaagtagtctgtaggttacatgcaaatattatgccattttattccagggacttgagcatccacaaattttggtatctggaagcaatccttcacagataccaagggacgacagtacttggtgatttagatcaggctgcacattcttttctctctccattggtttggaagtcatgcatcctacttttgtttctaatagtggcacctggtatatcaaaaagaatattaatatttgttgaacgaatacattttaaaactttcaaatatttagaatatttgagtctacccctagaaaaatgagaatttgtcacaaatttatttctggaccttgtaaatatgatcctgggtttcttattgcttagtgttaaatattaaggtattaaatatttaatgcttattaaagcattattttgtgtgacatattttctctttcaaaagcatagttttacatttgcattcagtattataattaaagttacaatcacttaaatctcactttttgttaacttggtttaattattaacaaccagccacttctctgttactgaattcttttgttgttgttgtggttgttatttagtttttatttcataatcataaacttaactctgcaatccagctaggcatggaagggaacaaggaaaacatggaacccaaagggaactgcagtgaaagcacaaagattctaggatactgcgagcaaatggggtggaggggtgctcccctgagcaacagaagaaatggtctggtggttaagataaaacacaagtcaaacttattagagctgtccacagtcagcaatagtgaccttcttgctagtcttgccattcctgaacacaaagcgctccatggcctccacaatatccatgccttctttcaccctgccaaagaccacttgcttgccatccaaccacttggtcttggcagggcacatgaaaaactgggaaccatttgcgttgggtccagcatttgccatggacaggatgccaggacctgtatgcttcaggatgaagttctcgtcatcaaatttctccctgtagatggacttgctaccagtgccattatggcatgtgaagtcaccaccctgacatacaaaccctggaataattctgtgaaagcagtaaccctcataatcaaatcctttttctccagtgctcagagcatgaaaattttctgctgtctttggaagcttgtctgcaaacagctcgaaggagacgcagcccaagggctcgctattgacagcaatgtcgaagaaaacagtggggttgaccatagctggtaatacggggctcccagtggcagcaccatctgtgaagtctctgttactgaattcttaacttcaatttctctctcagttacctgggcagtgcttcctaaatgttagtatgtttaagaatctcctagagagactgttaatgcacagattgctacagttcatccagagtcctaactgttctaagcagtaggttttatagcaatattttgtaccatatagtgtggccaaaaaaaaaatatctgattttttgctcctttataaggctaactgttttgtttgcctgtgtgtgtgaaggattttttttactttattctttaaaaaattaccaagttgaaatgatataaaacccttttcattaatgttgcctggagtacggaaagtcccttcaatttttgttttttggtatcgggttttgtttttgtttgttcgttgtgctccgaagagcttttattaatctttcactactatttgtgttctaattgcttctgcctcaagaacatctgtgattcttactttggttctgggtgttcaaatctatgatctctattttctatatttttaatcatctcttttgttattttaatttttattgcacctgttcatttcaacagaaattatcaatttttttcccctcttgattttttctttttcttctttttttttttcttgagacagggtctctgtcatccaggctggagggcaatggcacagccacagctcactgtagcctccacctccccaggctcaggtgatctacccacctcagcctcctaagtagctgggactgcaggtgtgtgccaccacacctggctaatttttgccttttttgaagtgacaggtttacatgttgcccaggctggtctcaaactcctgggcttgagcaatctgcctgcattgtctcccaaagtgctgagattacaggcttgaggtaccacacctggccatgagtgttttttaaatagtgatttcttttcagcttccaacacagacttcaattgtgttatgacattctggtctctttacaatattttcttgactaatccatctccttttccaaataatcctactttttacaatctaaacttattctctcatttcactttctgtttcctgatgctgttgaggatgacaaaaaatcccttcagatttctgtgacatatcatcttgggaggtcaacatttactctgagtctctgagatactgttcccttttccttgtccataatgatttctttttactttagtttatcatgaaagagaccgtgtttgccaagaaaaagatgaagattgtctttatgtgtcacttaaacataaatctcttacagctaaatgacatgttggtttacaaaacttatatcctaatttccatcctctagcaggttttccacctagcatacctgttgggattggcatagactcatcttgtatcactacctgcatctgtattatgaaaaacaacaatccccaaggccctcgtagtttcagcatagatatagtgctttaactgtgacagatcctgacaaacatatttccaaaaatattactgccctatttagtaagcaggataatggtcttccaaaggtgtctacatcctagtccctaaaatctgtgaatgtgttagattacatggcaaaggaaaattaaggtagcagatagaattaagtttgctaatcgtctgaccttaaaacagggagattatcctccagtaccagggtgggaccaatgtaatcacaagggtcattaaatctcaaaaacagaagtagaatagtcagagcaatgcaataggaaaaagagttgactggccattgctgatattgaagatgaaagggggccacaagctaaggaatgcaggcagcttctggaaggtaggaaggacaaggaaacacattttcccttagagacctcagaaaggaattcagcctaacatcttagcccactaatatccatctatttcaaacttctgacctcccaaactgtaaaataataaatctatgtcattttgaacctcaaagtttgtgttaatttattacagcagccacagaaaactaatatatgaccatttatttgagtaaccactatttgcattcttcacatgcatatgcaaaagatgtcttcattaaaagtgatgcttcacaaaagtacttacatgcatagtaattcttgttcacttttctgattagcgtttgcatgtttctgaagcaggggaaagatagcagccaaatgattaaaggtcttccctctgtttggccacagcataagggaatcacctgttgaaattgttcattctagttccaccaaacatctcattagtagaattctctacaagaatcaagactagcttgactataaaaacaaatttttagtggcagcgacttctttttggcatatatcttcttgagtatttttatagaaagttgaaccaggtataatagaggctactactccaatatgaatttaatttcattcattcttcaatcccttcttggataaggtgctgatccacctaagtcactccctcataagtgaatgcaaacttaagaaattataccttcataaaatgggcatatttttctaactgtaaaaatgttttctttaaataggcatgactatggcctgtctattttaatttcgtatagcagtaatttcccttggggaaggagtaaaagacaatattttttaaagtttctctctatctagataggatgctagtagaagcaagatttctatatgttctgatgtgaccaagtagatatttctctactcaccagcctctgaaaatccctgtgtttacccaagatttaactaaagaggctaaactcgtgggtaaatattaagagggaattgacaaaggcatattaagtctaaggagtagactatacttttctaaaataaacacataattacagagttaacacagcagcaccttctgccttgtcagtgctgaaggccccatggcagccagtactcttcacttgacctcgtcctgcaaactttctgtacagcagataaaggcccaaagtacactatagtttagtgaatagcataaactcattcatctgtaagtactagatattacaacatcaggcttctcactggtcctactataaaaataattttatgcttgcacattggacacaattgttctggtggcatagctctttagctacaccagcactgaatagaaagaggcatcctctactattagtctgcaacagaacccagcatttccaccattgcaaacatcaaactggatgaagactttttattcccagcaggattaagtcaaaacatagattgacctaggagaagaagcattagcccttgtcaaataagtataattacttgatgacattggttagtaaagctgcaaagaatactgaggaaattaaaccagctaatttgggaaagaccagaaaggcaatatgaacaccataaaaacatgggtaaggaacagtaagatgctgacctttactgttttctctgggcatgatcctgcctggcagagctatgtttaggctcctcagaaaacccgatgctctctttgcattactagccaatgtgaagcaacattaaataaaaaaaaaaagaaaggaaagaaagaaagaaaacaatcagagaaatgcaaattaaaaccacaatgagatatcacctcacaccagttagaatggcgatcattaaaaagtcaggaaacaataggtgctggagaggatgtggagaaataggaacacttttacattgttggtgggactgtaaactacttcaaccattgtggaagtcagtgtggcgattcctcaaggatctagaactagaaataccatttaacccagccatcccattactgggtatatacccaaaggattataaatattgctgctataaagacacatgcacacatatgtttattgcggcactattcacaatagcaaagacctggaaccaacccaaatgtccatcaatgatagactggattaagaaaatatggcacatatacacaatggaatactatgcagccataaaaaaggatgacttcatgtcctttgtagggacatggatgaagctggaaaccatcattctcagcaaactatggcaaggacaaaaaaccaaacaccacatgttctcactcacaggtgggaactgaacaatgaaaacacttggacacaagaaggggaacatcacacaccggggcctgttgtggggtgtgggggtgggagggatagcattaggagatatacctaatgtaaatgacgggttaatgggtgcagcacaccaacatggcacatgtatacatatgtaacaaacctgcacgttgtgcacatgtaccctagaacttaaagtataataataataaaaaaaagaaaaccattaaaacactttagaaatatataaaggtaggccgggtgctgtggctcactcttgtaatcccagcactatgggaagccaagacaggtgaatcacctaaggtcaggcgttggagaccagcctggccaaaatggcaaaagcccatctctactaaaaatacaaaaatttagccaggtgtggtggcgggtacctgtaatctcagctacttgggaggctgaagcaggagaatcacttaaacccaggaggcaaaggttgcagtgagccgagattgtgccactgcactccagcctgggcgacagagtgagactctgtctcagaaacaacaacaaaaaagaaatatataaatgttttcatttgtatgagaacttatgaaatagtgattaagagaatgggctccaaagtcaaactgtgagggttcagatgctggtcttccccttgtagaaatgttatgtaaattatttatgcttcatttcctacatctgtaaactgggggataatactgttacctcactggctgctttgggaggatcagctgtgataattcatgtaaagcttgtagcagagtgcctaatccctaacaagagttcaacataattgctgctgctgctagggagaggctgcaaagcattctgggtaagaacagggacgctgggacaagattgtagaggctctgccattgacaagctgtaatcttgagcaacgtatttaacttctttgtacctcacttccctcacctacaaaatggaagtaataataaccattatgagggttgttgtgagaattaaagagttaatatttgttaggtgtttagactagtatctgatacatgtctgacaaactattcagctgtacatgaatggttttaaagctgtgattatggaaaaccaagggctttgtacggaggaatggagataaggagagtgtgcagcccagtcccactctgtatgcaaacaaagtaattctagctcttttacatatttaactttcaagcaagattttctttgagtaaagggtaatgctgctttaaaagaagaaaggaaggaaggaaggaaagaaggaaggaaggaaggaaaccatggctctatatgtatgagcctcatataaaatatatcagtacaggtcttacaaaacactgaatgtttttatacacattccctagcagatttaaccagatcagttttaaggttccttctagaaaggaagttctccatacgttgaaaagtgaatttcagtacattcaaattttaaagacacgacttcccatacttcttcagggtaaacaaaaatctcaataattctaatttaacatgcaaaagccatgaatattcactacagtcaaatgaataataaatcacccctgggttcaagtgcttgccatgcaaaattgcctatttcctagaacatccagaaatctgtttttaaattgctttttattacttttgctcttgtgatggttgctcttcaaagcaacttggaaaaatgtgccattctcagcattaaggcgataaaggagaagtgaggacagcagaacacggtgccatccacaaaaggaaagagagtctgtggatcagagggctgggctccggaagacagtttttaaatgtcactagataaaatttatgagataaaagggaatgttccttagtcatcctgagcattgatatctacatgaataataaatcaaaaggctctttatccatttactggtaaacattacgaccttaggttgaagatgtgatttactccactgatatcaacacaacagaaatccagtgaaagtatcactggactggccccaagttctggaaaatcaatgatgcgtgggagaacaaacattttgaggggaagagtatttttttaaaagtaaatatttgtggcactagcaacatgagtgcactcattaagatttcttttaaaggattaccctttagtctctcctacatggaaaactcaagtatactcaagttgtcaattgtataatttgatggaaagttatccctagtattttcccccaaattggattgaattattaatatttcacctttacaaatacatgcagtataattcaatttatataaaatttaaaatatacagaacttacagtgattgcaagtacctaagctggtaataaaggtatcaattaatgaaggaaaatggatatgtcaaaggacaggatagtgactacctctaatatgatcagagagagggttcagatcagggaattttcagaggactgctggggatgctagaaatacaatgtattgacttgggtgaaccttgagataggtgtttatttatagttattcattaaactgttcatacatgtcatatgcacttttcctgtacaaattatatttcacaattttatttaaatagtatgtttcattctgagatgactctccaatctattacatgagacacacttatactcaaaaaggtgttcattctttttctctgaaattcagatttaactgggcatcctgaattttatctggcaattgtaaaccaatcagaatagcatggttagattacaaataatatatatattttaaaagacaggaaaataaaccacagataaaatgcattcttaaaagtcttagtcatttcatttcatattctattaatatgatacatttgtgtttcatggtttctgaccccttgtgtccagcggactataaacataagtatgctacctagacccaaactaatttacttaaaggaaggcaaagaagctgaccattataaatacagcatgccttagaaaggagagtttcaagtcaaaaacaaatctggaaaaaaaattaatttgcttcttttttgtaaagcaatgatgtgtcgtttttatgtgcatttgtttacacagtaaaagaaaagacaatcaaataggtaaaatggatgctgtattgctcccttatacacacaaggaattacacatctgtctaacaatgctaaccactctgagcgataattatggatcaatgctttaaaaaatatcctgaattgcctgcagaaatggcaaggagaatacaattaaattatttgtaaaagccagagtctttttttcctatccatctgctacttgaaatgggatgacctttcaaatagtgcttgctgttctcaatgcaaactctaaataaagaagtggagtgtggctttttttttcctttccaggttcagcatagatacagcatttgtactgacattctacaccactccataagaatgcagatttggcttctagaacataaaagaggcgtttcaggaatataaatcaggcttttgtcccataccttcagtcatgacatttggcttctatcagaaaggtgtgcggcttctgagataagtgtttgagaacaagctacatgaagtaatttactccctggagaaaaattgcaaacctcacccccaaacaaaccgcataaagtaaatgtgttagtgaagaaccttttgttaaactacctatggctggggagctaaatagaaaaggtcagatatttaagctaacaatgggctcaaaacaaaccttccaacaggtctctcaataggcctacattatcaactaacaacttgcactattaagactattaatagtaataagccatgctttcttcactgagtctatatatattttacattgttttattgctcccctaccctttttaatttttaaagcatttccagtttggtcctttgtgtgcttttttaaaaattaggattttggacaaactttcatgtatttttcttaataaaagtgtatcaagcacatttcaaaaagttcaaaaaatacagaaatataaaaaataatctattagcacatcacccagagaaactgacttttaacagtctggtgtttatactcccattcatcttaatacataagcgtatcacaaaattagatgatattatataacaatcaaaactaatcaactgttttatgaacatctttctatgccataagtaacaatctgtatcattatacaaaaattttcattacaccttttaaatgttttatgggtatctctgtgtgtgtatagttgtaaaatataacttttaagtgaatttatttaaatacccaactacttatgagtacatagatttacagctttttccactactgtaaacaaaattgaaatgagcatccatacacacatctttgcagttatttccttagtattactttccagaaatagtatagctggaccagaaagtataaacattattagagccttttggttaatattgtcaatctgccttccagaaagtttactaagcaaggtaggtagatttccctctactgtataatactgagaaatatcaattttttggatacttgtcagtgtgagcaaaaatgtcattattgctctaattattattgctttgataactaatggggctgagagttttactggtgttttataactcttcctttgtgaatcattattcagatacgtttcaaatggtaatttgtaaagtattttgaattttggcccatttttctataagataaaagcattatcgttagtgggtgcagcgcaccagcatggcacatgtatacatatgtaactaacctgcacaatgtgcacatgtaccctaaaacttagagtataataaaaaaaaattaaaaaaaaaagcattatcttaaagtacaacaccattaggatttaagataaatacacacacacacacacacacatacacacatacacacacacaatgagaaaaatcattttaattttaaaaacaatactcagcataacaaattaaacaaaaatgcacacatacgccaggtacagtggttcacacctgtaatcccaacactttgggaggccgaggcaggtggatcatctgaggtcatggagttcaagaccagcctggccaacctggtgaaaaaatacaaaaaaagtagccaggtgtggggtgcatgcctgtaatcccagcttctcaggaggctgaagcaggagaatcgcttgaacccgggaggcagaggttgccatgagccaagatcacgccactgcactccagcctgggcagcagagcgagagtctgtctcaaaaaaaaaaaaaaaatacacaggtatgtatgtatgtggtatataaaataagtcaatacgctatcccagcactatttccaattccattttcccatggcaactaaaaaaaacaaaacaaaaaatagaaacaattacttgtttatccttctacatctttttctagtttcataccagtacatacaaacaggttttgatatagtcattctttgctttctaattccaacggtctcatatcgttccaattagtcaaatgattagatgctgccatatcatggacatgctggacatcacatatagatgtatttagttattattattagttccataatatttcacagtatggttatagtataaatatattcaacaatctcactattcatgtgctgtttttatgttaatgttatttgtcttgatttttttttgccactactaaaaatgcagccatctttaaatatacattttcacatcagagattactgactcccaaaattaaggttgcagagtcaaagagcaagtgtaccattaattttgataaatatatccagatttagcaatatatgaaactcttccatttctaagcacctttaacaagcatggatattatcaatattttccaattttgtcaactacttgactggaaaagtatttatttcattgtgattttaatttgtatttccacaactactagtaaagttgagcagagttgcatgtctcttggtcacttaaattttccctctgtgaattgccaattaatatccctagccatttttctcaaatatggtatataactgtatgtcatcagtgtctaagaattcctatttttctaaaatttatattgtttaatgtacattcatatatttaattcatctgaatttttagatttttattgtaaaaaatagtggtctaacatttacaacttactgatgaaaagccaattttcatagcatcttttattagataaacatacatttcccaactgaactgaaaagacccttttttttttttttttttaagacaggatctccctttgttgtccaggctggagtgcaggggagtgacctcggctcactgcagcctcgacttccctggctctggtgatcctccaacctcagcctccaaagtagctgggactacaggcatgtgccactgtaattgcccagtgggttctccttgcctactgcctagacagagccaatttctcaagacgagggaactgcaatagagaaagagtttaattcacgcagagcaggctgtatgggagacgggagttttattattactcaaatcagtctcccccccaaactcagggatccaaacttttaagaataatgtggtggatagggggtcggaaaggggggagtgctgattggttgggtgggatatgaaatcacagggagtcgaagctgtcctcttttgctgagtcagttcctgggtgggggccacaagaccagatgagtcagtttatccatctaggtggtgccagctgatctatggagtgtagggtctacaaaatagctcaagtactgatcttaggttttccaatagtgatgtttccctgtggagcgatttgggaggtttagaatctcgcagcctccagctgcatgactcctaaaccataatttctaatcttgtagctagtgtgttagtcctataaaggcagtctagtccccagacaggaagggggtttgttttgggaaagggctgttatcatcttttttcaaagttaaactataaactgagttcctcccaaaagttagttcagcctacacccaggaatgaacaaggaaagcttggaggttagaagcaagatggaatcagtaaggtcagatctctttcactgtcataattttctcagttataatttttgccaaggtggtttcgccaccatgccttgctaattttttgtatattttatacagacagggtttcgccatgttgcccaggctggtctctaactcctggggctcaagcactctgcccatcttggcctcccaaaatgctgggattataggcgtgagccactgcatccagctgaaaagacacttttactgaatattaacttcatatatttggatctgtttctcttttttctgtttcatttataaaatgttctcgtggctaacaacataccattttaataacagtaactttatattacattttaatgtttagaagaaaaagtaaaaatgaaacctgttgccattctgataaattatattaacatatctattttataggaatgaatgacattttataataataaaaactattagggaatatgagtatgactcttttgacaggcagttttatctccataacatttttcttttttctatataggccttttttgttaaattgttactaaggattttatattttttgtttccaaagtaatttttttctatttctagataactagttattgaaagtataaagaaaaaatttgatttttatatatttattttgtgatcatccagctaacatgttttcttagtaactgtgtaacagtcataaattctctatgaatataatcatatcacatgacagtgaagagagtatcattttcttcgcttaatttttttgtttgattacaacaagcagaacccataacacagtgctaagtaacagtgctaatagcaaatattcctgtgtattcttcctgatttaatatgagtgacttttatattttactgtttaatgtaatgtttgattataggtctttataaatattccttattgtgtttaacttccttccatgcccattttatttagagtattgctagaaatttctaatacattttatcacatttcttatcagtatgcatactgagttgaatacagtcctccataatttatagtcatgtggaatctcaagtgactttattttgaaactgggtctttgcagatgtaatttgttagattacagtaattagaggtcataagggattagagcggcccctacccaatgactgttgccctcataagaagcaaaaccagagatatagtcagacacgcagagagaataccatgtgataaaggagacagagactggagtaatgtgtctgcatgccaagaaatgccaaggactgttggcagctactaaaaggtaggaaaaggcaagggagggccaccccttagagccttcaaaggcaggatgtccctgctggtaccttgattttgaacctctagctttcaaaactgacagacaataaatgtctgttattttaagccactcattaccaaattaccaaacggtaatttgttatggtggttttaggaaattaacaaagcatatgttgtataatcaaatcatttaatcttttaattaatggtataaagttccaattcagaaccagtttgtaatttttgaaatgaagcctattttaaacattttatcatgttttcataagcagatagatacaagttgctattttttaattatatacttccacatatgaaaatgaaattagcataaaatatctcattagtgttatttatctcaagttttgatataacattttgctagatttgtacagttgagccccattctattttctctatagtcttgaattgtttaagaaccatagggaatatctgttttttaaagctttcgtatgttacaagtatcttttaatcttttaaagtacctgtttttaaatatctagtttacatgtaaaactatctgggcctggtgccttttttctagtggtacatgtttaataattttccactttcttctatgattattggtattaaatgtttttattttgcctatgggaataatataatactgaatgtatatatacttttctaaagaatcatcattttcctagatttgaaagtgaatggctataaaatttttttttaaaaaaaatctagccgtaccagtattgattggcagagttgaccaagggaagctaagagggtacataccatcttcctcccacacgactacatatgcattaaatcagaagacgacagtcttccaagaataaaatgaatcatcaagggaataagagcagttctcatccctagttagaatctctaaacaaaccaaagcaaatgtttttatttgaatcatcaggactgtgtcacaatgaaacctagatggtttgtcttcaagtcatttactactcccctaaagtcttatcaaaagtatgctaaaaaagtttatgacatttccactgagctacaataaagcttctatttttttagatacttgacaaaattttaaaaagaattatttttcccccacacctgcacacattttaaaatatcttcaacttttctacaaaacaattttctctacagctctcccagacttcacaaacatattcttttattcatagcagatggaggaaattagagtaacatatttgctctaaaatcattagtgctgcatcagcacttctgatctaaatgacatttcaaggggttattgttacatagagcaagactttgctccaggcagaaagagacagaaaaacaacttgaaaaatgaacctttttttgcaattagcttctgcatcttaatttgttgaatgccattctatttggattttaaatacaaatcaaaggaagaataaagtgatccaattctgtcagggtcataccttccttactggtcagtcgtctgattaatcattatagctgcttcctaaaaaataatgttgttaaaacttaccatcaactacttgattctctggaaaactaacatattcttacttctcagagatatcttgagaggctgataagtctgctctttagcctcaagaaatgcctaaaattaaactatttaactggtgagcttcacatgactgccactctgtccaagagataaataaacatccctggctgaagaatgaaccaacccataggtgtttctttagcacatactctgttaagtccactgtggaattaaaaaaaaaaaaaaaagtttaaggtactacacacctggaaaatgcaatcttgtaaacataggagaaaccacagagaatgatacaagatagcaacaatcatactttatatttttacactgcattacaattttcaaactactttcatgacacttttcttattttatcctcacagtaaatccataatggaagcaggataaaagaggaaggagacataaacatagaacttcagagatgaaagcaacattaaaggcatcaataaccttctttacagataagaaaatggagaccaaagggaaataagaaccttcaccttgtttcagagtcaggcaagcaaagctaatgaagtgaaggcttgtcaccccaagttgcaaaaagaagtcacaaaaataagacaagaaagagaaagatgatagaaatacaggacactaatttggatttaatgtacttttttaaaaaatagaaaaggaaaagcaattctattgaattcgggtttgaaattcaacgttggtctctagggatcacttggctatggtggttttatgccattaccagatccctttgagaaaaatactattttgaaattcatggtttccagtaaatatgttcaaggctttgaagaacatactcctgtaggtgtaaatggtgtatacacatatacacaaaagcttgaaaacactacttaattactgaacggagtctaaacattctacagctcagttaagaagctacacatgcgtctcacacccaccatctctccagctgtcctccacacaccatcccagcaagtcctagctgaccctcttaatactgtgacctctctgttgtataataaaggttgaaaatcatccttcctttgaataagaatatattataactatattattttttgttacagccttctcaaaaatgtatttcaagccacacataggccattgtcatggcatcttttatttaacagacaatagctattttccatgactcagtccagaatattctttaacatctacatctaggatattatcataattataataagagacggcactacatggatgaagctggaagccatcattctcaggaaactaacacaggaacagaaaaccagacagcgtatgttctcactcataagtgggaattgaacaatgagaacacatggacacagggaggggaacatcacacatcggggcctgttgggggtttggggggcaaggggagggatagcattaggactaatgcatgcggggcttaaaacctagatgacaggttgatgggtgcagcaaaccaccatggcacatgtatacctatgtaacaaacctgcacgttctgcacatgtaacccagaactttaagtaaaaaagaaaagaaaggtgcaaaagtgaaaacattaaaagtggaatcatgattttaaaaaataaattcacagtggtgttgaaagatcatatcagggttagaggacaagtctttgggttagaatgaacacttaatttattatcagagtgaacaataattacctcgacattttaaaacagcattttgtcaccttttaaacgtttgggaacagagaaggcgaaacaccatgtctgacacactatggaaagttttataattctcctcaaaaaggaagaaaaaatatttctatttccattccagatctgcacaatatattcttgcatcccatttggtctgattcatttacattttgctgaattctgtttttgtccattttcatcattcaaaagattttaaaaattcaacaacatcaaaaagccatcaaaagatgctttcagatgaaattgcaaagaaaataagcacatgaattagtgaagcaacttccaagttatacaattgtggcacttacatcttttctcatcttgtccgagaattaattgtactgctgaaattagacatccagcctgctccatgcagacaggagcccaagccggaagaaaactctttgaataacaacactgccttctgattcttttcacatggctacatttttgacatttacttcaatattctacccagttgcagtgtgactatgacaaaatatttctgtaggcatgactggcacctctgcggtaagtggcagggaatggaataggaaacgagtccctttagtagctccaaaaagcccacaggcactctgcaaaccttttgcatacatgctgttaagtaaaggatgtgaaaaatggaaaccgtgatgacaattttaatcaccttacagatgattctatgatctactataactttataatggcaaagccactgacacaggagactgacaggcatatattctctctctgcctctaagtctattaaatgtttatttggggggtttacacatggatagagatgaacttaacagagtatttattgaatctatccacggataaattataaatgactacaactttaactaggtggaattttcatggttatttttaatttctaggcccaaatcacttccctaggctctagaactgtcttccaggagatgtcagatgtcagtaatcagagggaacccatctacagtcaatgcagccaaaagttctgcctacaaggtagcaattagagtccagcagtctcttctggaagtgccaattactgttctgtcttcccttttgaatgcctccttaatataagaataacatatcatttttatcctatcagattagaaaatattgtttaaaataacactcacagttggcaagaatgcagagagagaagcactcccaaacagatgctggtgaggatgtaaattggaatgtcctttctggaaaacagtccagcaaaatttatcatgatgtttttatcttcctgacattagtttgggtatactgttgcatatttttaaatagtcttcaaaagctagagttttaaaactctgtgtggcattttgttacgtgaatacgctatagttttcaattatttccacatttgtcagcattttagttgatttcaacttggggtattataaataatgctccagtgaacatcttcataaatacacatttaactcacattctgtttatttcttagtatagattcaaagtgaaaatacagtggttggcaaggcttatattcaagtataattttatcctagtaattatggaattagtatcagcaaacggattcctaagctagaattcaccatcatttactaggagaaagatctgtggtggtaaaacagactctgcttatttacacagccttactaatgggcaatttgccagaggaatccaaaccagagagcatgtatgattgactaaccattacatggaaagaagaaatcagctcctaccaaaagcacattcatttcaagtaatgccagcaacctgctgagtcagttgtattcagcccctatagaaacccttcccaagttcattgatatgtgacacccatgacatatttttaccatcattggttttcatgaatttgcctgtctttgagacctgaaaaacaatctgatttattgaactgaaaaaggcgaatgtagtgaaaccctatcctgtaattggcaaaccttttacctccctggtggcttgagtagagaagttactggctggaggctgttctaaaggaaaacatgaatggccctaaaattaaaattccagactttaggagccaattaatgaggacataccacttttaatccatcactttgcaatatatttaaaatgttaagactcattgttggcaagggaacagtattccccaaagcttattccatgggaaaatgtttttgtggacaaaagagtttgggaaagagtgatattggaatgaagttcaagctgaacttttaatgtgctattaccaactgtgaatctccatggggggctgtagctagtaacatttgtaaacttcttcaaccacaaattattcctgctttatattgcctttgtttctggcaactgggtttctatagcgcattgcaaggcagagcattctatggaacgtactttagagaatgtttctctaggtcagcagttctcaaacattttggtctcaggatccatttccactcctaaaaactgtggaaggccccaaagagtttgtggttatgttggttatatctatggatatttaccatgttagaaattaaaacagaaaactttcaaaacactatgaatttattttaaaatgacagtaataaccaattacatgtaaatatacatattttcccgaaaaaagagctagtgagaagagtggcattgtctcaacatcacattaatatttagcctaatagaagacaggtggattctcctatctgtttctgcattgtgttgtgatatattattagggttgaagtgtgccaagaaaatctagaaggaatattttaatagccttttcaaataactggattttttctctaatactgcatcaaaacttaacaaatggtagtttctttaaaagttacttgcagagtagaacccgaaaccacatcaagaaatttttagtgctctgttatgtgaaaaatccatggtctgtgtagcattttgaatggatcctttccccatgtgaaattttgtaacagtgcacattgctctggacaaaaatagtggttcattggattatgcagatcttccaaatgttgacacctttcattgcatgatataaaaaagaattatatttgcaatatcatcattgaccttttattagaaaaagtctttaagtattgggaagctgtcaagctcatggtggcatatccaagtttcccaaaatttgaatttttgcttagaagcttgaattttatcactatcaacaaatactggccaacggtttacttaaagcaacagactcactttgtgcattttaaagaaaatatgttaaatacttgagtttgcataattatagtttgtctttcaatgcttctttcatgcagaaaaatagtgttccatataaaaggtagctggttcatttcactacccagtctcacaagtgcttttccttgagacaaccatgatatgtcagtacacagcagcagttctttctgcatacttcccatttcagcacacagaatgctaaaaaaaaaaaaaaaaaaaaactcaacaatcaaaatgcaattaaattaataatttttacttttcaacaaggatattcttagaaaaagttgactttttattttttttaaccatagtgcatggcagtgaaaaatgaaaggccaaaagtacagttcagtgccactgtcttgattcatgctatggtgccagtagttttaaaaaacattacatttggaggagccaagatgtccgaagaggaacagctccggtctacagctcccagagtgagcgacacagaagatgggtgatttctgcatttccatctgaggtacccggttcatctcactagggagtgccagacagtgggcgcaggagagtgggtgcagtgcaccgtgcaccagctgaagcagggcaaggcattgcctcactcgggaagcgcaagggatcagggagttccctttcctgctcaaggaaaggggtgacagacggcacctggaaaatcgggcccctcccacctgaataccacgcttttccgatgggcttaggaaatggcgcaccaggagattatatcccacacctggctcggagggtcctacacccacggagtctcactgattgctagcacagcaatctgagatcaaactgcaaggcggcagcgaggctggggaaggggcgaccgccattgcccaggctcacttaggtaaacaaagcagcctggaagctccaactgggtggagcccatcacagatcaaggaggcctgcctgcctctgtaggctccacctctgggggcagggcacagacaaacaaaaagacagcagtaacctctgcagacttaaatgtccctgactgacagctttgaggagagcagtggttctcccagcatgcagctggagatctgagaatgggcagactgcctcctcaagtgggtccctgacccctgacccccgagcagcctaacagggaggcaccccccagtaggggcagactgacacctcacacggctgggtacttctctgagacaatacttccagaggaactatcagacagcagcattcacagatcacgaaaatccatggttctgcagacaccactgctgatacccacacaaacagggtctggagtggacctctagcaactccaacagacctgcagctgagggtcctgtctgttagaaggaaaactaaaaaacagaaaggacatccacaccaaaaacccatctgtacatcaccatcatcaaagaccaaaagtagataaaaccacaaagatggggaaaaaacaagagcaaaaaaactggaaactctaaaaagcagagcgcctctcctcctccaaaggaacgcagctcctcaccagcaatggaacaaagctggacagagaatgactttgacaagttgagagaagaagtcttcatatgatccaaccactccgagctacaggaggaaattcaaaccaaaggcaaagaagttgaaaactttgaaaaaaatttagacaaatgtataactagaataaccaatacagagaagtgcttaaaggagctgatggagttcaaagccaaggctcgagaactacgtgaagaatgcagaggcctcaggagccaatgtgatcaactggaagaaagggtgtcagtgatggaagatgaaatgaatgaaatgaagtgagaagggaagtttagagaaagaagaataaaaagaaatgaacaaagcctccaagaaatatgggactatgtgaaaagaccaaatctgcatgtttggtgtacctgaaggtgacggggagaatggaaccaagttggaaaacactctgcaggatattatccaggagaacttccacaatctagcaaggcaggccaacattcagattcaggaaatacagagaacgccacaaagatactcctcaagaagagcaactccaagacacataattgtcagattcaccaaagttgaaatgaaggaaaaaatgttaagggcagccagacagaaaggtcgggttacccacaaagggaagcccatcagactaacagctgatctctcggcagaaatactacaagccagaagagactgggggccaatattcaacattcttaaagaaaagaattttcaacccagaatttcatatccagccaaacaaactaagcttcataagtgaaggagaaataaaatcctttacagacaagcaaatgctgagagattttgtcaccaccaggctgccctaaaagagctcctgaaggaagcactgaacatggaaaggaacaaccggtaccagccgctgcaaaatcatgccaaaatgtaaagaccatcgaaactaggaagaaattgcatcaactaacaagcaaaataaccagctaacatcataatgacaggatcaaattcacacataacaatattaactataaatgtaaatggactaaattatccaattaaaagacacagactggcaaactggataaagagtcaagacccatcagtgtgctgtattcaggaaacccatctcacatacagagacacacataggctcaaaataaagggatggaggaagatctaccaagcaaatggaaaacaaaaaaaggcaagggttgcaatcctactctctgataaaacagactttaaaccaacaaagatcaaaagagacaaagaagcccattacataatggtaaagggatcaattcaacaagaagagctaactatcctaaatatatatgcacccaatacaggagcacccagattcataaagcaagtcctgagcgacctacaaagagacttagactcccacacaataataatgggagactttaacaccccactgtcaacattagacagatcaacgagacagaaagttaacaaggatacccaggaattgaactcagctctgcagcaagcggacctaatagacatctacagaactctccaactcaaatcaacagaatatacattcttttcagcaccacaccacacctgttctaaaattgaccacatagttggaagtaaagctctcctcaacaaacgtaaaagaagagaaattataacaaactgtctctcagaccacagtgcaatcaaagtagaactcaggattaagaaactcactcaaaaccgctcaactacatggaaactgaacaacctgttcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcatcactgatcccacagaaatacaaactaccatcagagaatactataaacacctctatgcaaataaactagaaaatctagaagaaatggataaattcctcgacacatacactctcccaagactaaacgaaacgaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaactgaatccagcagcacaacaaaaagcttatccaccatgagcaggtgggcttcatccctgggatgcaaggctggttcaatatacgcaaatcaataaatgtaatccagcatataaacagaaccaaagacaaaaaccatacgattatctcaatagatgcagaaaaggcctttgacaaaattcaacaacccttcatgctaaaaactctcaataaatcaggtattgatgggacatatctcaaaataataagagctatctatgacaaacccacagcaaatatcatactgaatgggcaaaaaccggaagcattccctttgaaaactggcacaagacagggatgccctctctcaccactcctattcaacatagtgttggaagttctggccagggcaattaggcaggaggaggaaataaagggtattcaattaggaaaagaggaagtcaaattgttcctgtttgcagatgacatgattgtatatctagaaaaccccattgcctcagcccaaaatctccttaagctgataagcaacttcagcaaagtctcaggatacaaaatcaatgtacaaaaatcacaagcattcttatacaccaatgacagacaaacagagagccaaatcatgagtgaactcccattcacaactgcttcaaagagaagaaaatacctaggaatccaacttacaagggacgtgaaggacctcttcaaggagaactacaaaccactgctcaatgaaataaaagaggatacaaacaaatggaagaacattccatgctcatgagtaggaagaatcaatagcatgaaaatggccatactgcccaaggtaatttatagattcaatgtcatccccatcaagctaccaatgtctttcttcacggaattggaaaaaactactttaaagttcatatggaaccaaaaaagagcccgcatcgccaagtcaatcctaagccaaaagaacaaagttggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccataggtagaaagctgaaactggatccctttcttacaccttatacaaaaatcaattcaagatggattaaagacttaaacattagacctaaaaccataccatatgaggcactattcgcaatagcaaagacttggaaccaaccaaaatgtccaacaatgatagactggattaagaaattgtggcacatatacaccatggaataccatgcagccgtaaaaaaatgatgagttcatgtcctttgtagggacatggatgaaattggaaatcatcattctcagtaaactatcacaaggacaaaaaaccaaacaccacgtgttctcactcatagatgggaattgaacaatgagaacacatggacgcaggaaggggaacatcacactctggggactgttgtggggtggggggaggggggaggggtagccttaggagatatacctaatgctaaatgatgagttaatgggtgcagcacaccagcatggcacatgtatacatatgtaactaacctgcacattgtgctcatgtaccctaaaacttaaagtataataataataaaaaacaaaacaaaacattacatttgcatcattaatgaaaatattaacatagtgaaaaagaaaaagagcaacttagtattacagtaatatagtttcgaccttgcagactccctggaaggatctcagggatcaccaggagtctgtgaagcaccctttgagcattgtggttctagattcaaaatgtggccttggctgagcacggtggctcatgcctgtaatcccagcacttcgggaggccaaggcaggcggatcacctgaggtcaggagttcgagaccaacattgcaaaaccctgtctttactaaaaatacaaacaaattagccaggtgtggtggtgcatgcctgtaatcccagctactcgggaggctgaggcaggagaatcacttgaacccaggaggcagagtttgcagtttagctgagatcacaccgctacactccagcctgggcaacagagtaagactgtctcaataaaacttacacacacacactcacacacacacacatgcaaaaaacccttagtttaaaacacaaacacatcgtacagctgcacaaaaatattttctttctttatatcctttttctataagcttttttatatttttaaatatttgtattatttttttaaacttttttttgttaaaaactaagaaaaacacaaacattaggttaagcctacacccggatggtatcatcaatatcactgcctcccacctccacatctcatccaactggcaggtcttcaggggcagtaacaggcatgaagttcttacctccaatgaaaacaatgccttcttctgaatacctcctggagttcttgcctgagactgttttatagttaactgttctttaataagtagaagtacatgctaaaataatgataaaaagcacagtagatagttcataaaccagtaacagtcatttgttatcattatcaagtattatgtactgtatgtaattgtatgtgctatacagctggcagcacagtagatttgtttacaccagcatcaccacaagcacgtgagtaattcgtgacgctatgatattagcacactacaatgtcactaggcaataggaactttttagctccattataatcttaagggaccaccctcatatctgcagtctgtcattgaccagaccattgttaagtggcacatgactgtatatacaatggaatactattcagcatttagaaagaaggaaatcttgccatctgcaacacgaatgaacctggggaatgttatgctaagttaaataagccaaacatagaaagacaaatactgcatgatctcacttatatgtagaatctaaaaaagttaaattcatagaagcaggtagtagaaggttggttgccaggggctgtggtgtgggagaggaaaaaaatggggaggtgttggtcaaagggtacaaagtttgagttaagcaagataagtaagttttggagatctattatacagcataataactatagttaataataatttatacttgaaaattggtaagaggttagatcttaaattgctaagagagtagcatttaagatctactctcaccacaaaaatttatgagatgatggatatgttaattagcttgatttcatcatttagcaatgtatacatatatcaaaacatcactttttaccctgtaaatatacacaagttttatttgtcaactataccttaataaaggtggggtgaaaatgcatattcctgaaacccatcatgggcctactcaaacagagtatctgaggaggaggcagggctacccgagcagcagcgcaggttgtacactgcacaccttgcacaaaggtatacagttagcgaagatttgagcttgaagtttgccttttaaagaaattgcatatgtgaatcttggttatagtagaactttaagtgttctagagcagttgttcttcaactttatgtgcatcagaattacctgtcttggggttgaaaacacaaatttctttgtgccatgcttgaactacctaattagaaacctgagcatctgtattttcaaggaactacttagccaactctgccacctaccaaaatgtgacagccatttttctagactaaaaatggtatagctgtctacaagaaatcaactcaacaaaagctgaagacaacacacacacggcttaggatactcaggcatcatttggacagagtctattcaacagctataaatttgttgtttaaaatagccaatgttttttaaaatgcaactttccatagttttctgttgttatatttgttttcattctgtcagtatggtattggatctcaaccttgtatgttatttcaccaacatcttgaaatttatttagccatattttcatggttttatatgaatgcttactaaacatagtctgattttttaaaaggttttatcttatgcaagattcttcaagagaaaagacaaacttagtttactgtcaaattaccaaactgactcagatttttaaaaaccattcgaagtttcatgttatgcacttaacataaaaaaatgactcaatgtaaatgtcatgtctcgtaatgatcctattcctgggatctttcacatgaaacagagtgggcaggaacattctatggctgccaaaatggaattaaacacatggaaacaaagaaacaaaagcacaactcaccccttccagacaacaggaaaacatgtagataaatcagtgattttccttccagctaaccaatgaagtagagacatgtattttaacaattgtaagggcactgggcttaaggaaaggcaaagtaaaaactaggttataatgttcttctagatgcgaaaatgccaaatctgccagtcactcatgaaaagaacacagccccaggcaactgatattgatacattcaaagattatagttatgtatgattacagaatagcatttcataaactctatcagacagaacaactctttaatggaatgttaagagttgggagagagagaaaagttggtcattctaaggtccaattaatttgaaaactcatgagttatatagaattaaacaaatttttttgactgtggaacttctcagagcccttctgtactaatgtgcattacacctctccaagaagaaaaaagcatgcagcatttttcaaacttttgatactttgatgcttttttatttagcttctgactgggctagagttctctgggacacacccagggaaatattgatacagacaggtcaaacaattaaggcaaatgctcaggcatatacctgaactgtggtagaacaatctagatgccacagaaatggtgaaggcatgcccaacagccagccccactatatcaagtcccttagcctctctccattggccttagctctgaaagaaagatgatgcttattagtaaagtgccttgggatggttgggcaagaaacactaaataagaacaaattattaccctcattacagggtagatgatctaataaaccatctctattacttacaaagtttggaggcctgctatttttttccttttaactacactccaatttgaccttaaaaatctatgctaaaaataacttataggaaatatcccaaaaccataccataaactttcttatcggacctctgtctgtttgcacattctcaatgactgccaatcacctacaggtaaatgcaaatttcttagcctgctgtataactctccatctttcaggagctgtagagtttatgattaagatcatggtctttgtagggagacagacaaggttcacatgcaggctccactctactacatctgaagttatttctcttctctaagccctagattatcaaagtatggtccatgaactggcagcgtcagcagcatttggggcttcctagaagggcagaaattcaggctccattgaaaacctactgaatcagaatctacatttcaacaagagcctcacactgtagtttgagaagaactacacaaattctcatacgctttgaccagctcctctgcaaattggaggtaataatagtaaacttggagatggcattcatcgtctactcctttgaatccatcctcaagtcctaaggtccacgcaaatatccttacctgtctctttcccttcattaccttagtccaagctgttctcatttctctccagatctcctgcaatggccactcaactcattacaatgcatctcctcttgcttccttctattctgtttcacttactgcaaccagagagatctcccaggaaaagcaaatgtgatcagagcttccatgagctctcaaaataaaggccaaaagcctttcacagaactacaacctctgttgagggggtcgcttcccacctctatatcttatcttgcatgatgctccacctggtttcctctgctccagaagcactggtaaattcttttttccactccttgaactagccatcctccttcccgatacagaatatttgcaaaaccatcctcctggtcatcagtgccttcccctcaactctttacctggttaactccttctcaatctttagatgtcagctcaaatgtcatctcccctgaaagctttccctgaacctcctacccagcagccaaacacactgcctgacctgttgcctgtgccccataaatatttgttgaataaatgaaggaattaatgaatgttcattcatatggttattgtgacaatcaaatggattgaaacctgtaaatcatttagcacagtgcctggtagagagcaagagcttacttaatgcagtaccaatggtaatatattttgaatattagtcttgctaaaaactagaccccaagcagtacttaacaggggctaacaattagaatcacctgggaaatgttacacttctcaatgtccaggctctgctgcagaccaattaagtcagaatctctaggtggtgggacccatgcacctgaggattttaaaactctacaggagattctaacgtacagccaaagtgtgactgctttactcgttgtctcactgtggtctcccagccttccagagaatagcatactgggcgtcaagaagagtcctcattaatcatggcatgagtctgtggcccacagaaaggggcagtaatatgaatacatgtagtaaaaatctagcaattcatttcccctggctccttgacagcagccagatggtggaaactctccatctattacccaagccagaagaaaacctttctgggaaaatccaagttgcctgaactactgttgggaggaagtatggtaacacgtgaagatgactctggtcctttgggttaagtgatgacttaacaaaattcatcaggattccattataaatctgtcataattgttttgttgaagcaattgctttgtgggagcaattaattcctactgctaaaaaaaaaggtgagaactcctgagtgttccatcaggcaccaagaaataggtgagccgggaagcatttgcccttaccttctgtcttcttcactactcaagtatttggagtgtcaagagaccacactgtacttcaaaggcctcctcttccaaataaccaaccttctgctatgtaaaaacatgattaagaacacacatatttgtactgtatgtctcactcattttgaacttttcaaaatgtgatattgccaaagaagctttatctcttttaagggtttcacacacacacacatacactgccttggtttgaaaaacaacatagaatgcaggcctcatacaatttgagaaccatttacaattataacctaccaagtcagagctgataccaagccaacacaaaggcctcagaattgttataaaaggaacagaattgctctctggaaataatatcccagtgggctaaattccccctccccctgttcctccaaggtggtaaattgcaacaacaacaaaaaagcatgattcatgaatataaatttttcttggcttttaaaatcatacactggcatagtcctccccgaacttcagccaaatgagaatacacagataatgacaattttacaataagtggttccaggacacaggcttttcaagatccacaaatgaaaggcactataaaaaagagtattattattattattatttcaagcacccagaaaaaccacaatcaatgattagccataacaattaaactaacaatagtacatctggaatcagctccatggtaatatgtacttcatgcttaatagttcaaattaattcaatctgatggtgttagacataccagttaggagctggagagcaccaaaattcacattagcttccacttcaaaagatattatgaaaagagaaggaaggaaatgaggctataaacagcagtggtaaatacgaaaggctcagagatgatatggtcaggaataactctcagctattaggaattcagtgatgaaaatatgaaggctgatatttctatccttgcacattcctccagagtcaatgactgagccacccatctgagcgacagaactgaaaccctaaaatcagggcaattatattcaaagaagagggggccttcttcattctgcttacagcatcctttactagtagcccatttatattgcagaatgcatggagaatttctcattttcaggttatagacttcaagtaataagaaaagagagcaggagttggggcaggcataaaaggtgaggtagttattgcctgattaccttatttgtctcactcctccttgaagattcactagataactgtcttaagctgcactataaatattctctaaggcaggatttctcaaccttggcactgtagacactttggcctaggtcattctttgctgtgaagtgctatcctgtgcactgtaggatgtttagaaacatccctagtctccaccttgtagatgctagtagcatcccccacccccagttgtgacaacaaaatgtcttcagacatggccgtatgtcctcttgggggaaaaatcatactggttgaaaactgttaccttaaatcttttttttttttttttttttttttagatggagtcttgctctgttgaccaggctggaatgcagtggaatgcagtggcgcgatctcggctcattgccacctctgcttccaggattcaaatgattctcctgcctcagcctcccaagtaactgagattacaggcaggagccgccacatccagcgaattttttgtagttttagtagagactgggtttcaccacattggcgctggtctcgaactcctgacctcaagtgatttgcccgcctcggcctcccaaagtgctgggattacaggcatgaaccaccgttcctggcctactttaagtcttaattcacttgtttctgggcatcgggaggaaaatccagagggcagactcccctctagactcttcttcctcagagatgagcatggattgtattgccagctgtgtgcaaggcagcactcttcccacggcatgctgaatcctcctcctaacaccttttgcacatataggcttgttgcatataatacagaaatttggaacctggcagtcttctattcattgtgcagaaaagagttaacacagagcaggctcgagaaggcctatccttagaaggcctgtttgcaatgttggcctttggttagcagctgggaattggagctggtaaacagttccctacactaatatgacatttttcctaaattatagagtggccactatgcctcacctgtttgtacaaacagtgtggtttatgctgaacacctgctttccttctgggagtctggaatttgggtatgtgctaggcagatcagctcccagcagtagccttgggcactgagtctctaatgagtgccctagtaggcaacacttcaaacttgttgtcgcagcttgttgcttaaggaactaagagcatcctgtgtgactgcattggaagaggactcttggacgcttactcctgatttctccagactgcacaccatgcaccttttccctatgttgattttactttgtgttctttcactgtagcaaatcagaaccagaagataacaatgctgagtcctaggagtcctcctagagatttacagaaccttgcaagtggtcttggggaccaccaatgcagggactcattcagcattctatttgtgtgcctctatttctagatacagcaaagacttaaactccaagtcctcacagaatttatgtggtagcagcgagcaaagcattaattctagcatatttcaagcttctttcatagaaaacaagccctgtggcatctcttttttgtttttataacagctttttagagatataattcacatatcatactgttaatcaatctaatgtgtacaattcaagatttatattcatagagtcgtgcaaccacgaccacaatcaattttaggacattttcatcaccccacaaagaaaccctatatccatttacagtcactacccattttctcccaaccacccagctaggcaaccactagagtttctgccgctatggatttacctatttttgacacttcacaattggtcatatgatatgtggtcttttgtgagtggcttctttcacttaccaaaatgttttcaaggttcctccatgatgtaacatgtatcagcactacatttatttttattgctgaataatatttcattgcatggatataccacatttcatttatccattcatcagtaaatggaactttgtattgtttctactttttggctactatgaatagtgctactatgaacatttgcatacaatttttttatgcacatatgatttcattccccttgaatagctacctaagtgtggaatttctgggtcatacatatgtttaacttttaggacattttcaaactgttttccaaagtagctgcaccatttacttaccaatggcagtgtaacagagttctaatttctccacatccttgctaatagttactattaactgtctgttttttttttttgttttttttttttttgagacagcctgtcacccaggctggagtgcagtgatgcaatcttgactcactgcaaccaccacctcccaggttcaagcagttctgctgccttagcctcatgagtagctgggattacaggcacgccccaccatgcctggctaatttttgtcattttagttgagatggggtttcaccatgttggccaggctggtctcaaactcctggcctcaagtgatcttcccgcctcagcctcccaaagtgctgggattacaggcatgagccaacgcgcccaaacttatctgtctttttgctaataaccgtcttagtgggtgtgatgtggtatctcgtaatggttttgatttgcacttccctgatggctaatgatgttgagcatcttttcatgggcttattagccatttgcatatcttctttggagaaatgtctattcagacctatttgccccattttaactgggctatttgtctttttattattgatttgtaagaattctttttatattcatattctatctccaagtttcttatcagatatatgatttgcaaaacacttcttccattttgtgggttagttttattatttcaatcatgtcctttaaagcataaaagttttaatttttaggatgtccaatttatccatttttttcttgcattactgtgcttttggcaccgtagctaagaaaccattgcctaacacaaggtcatgaagatttatccctatggttttgtctaataatgttatagttttagcttttccatttaggactttgatactttaaggtaatttttgtatacagtgtgaggtagggggtccaactttattcttttgtgtgtggatatccagttgtctatggcatcttttgcatcactccaagacatagtttcaggtaatttttgtctatacaaattaaggtaacaggtaccaaaacacagaacctatgtatgtgacaaactgcctgaaagcctttataaaaacttttgcaattggtgttctttttttctattttcagaatatgctcagtattttgctatatcaggaagcagtaccaccattattaccactggtgctactgctgctaataataatagtaactagcagatattttgtacttagtatgtgccagacactacacttgcatttaacattcattaacttttaagcactacacatgctttaacttacatgatcttcctgccaacaccacgagataggtagaatcattatcttcattttacagatgatgatattaaggctcactgatgtaaaaaaattttccttaggtcatagaacaagcaggaaaaccgatttaaaaaaattgagggaaggaatggcactggaaagtggaggtcaagtaatgtcggatagcaaattctaacaaacagtagctaagcacgtatgcgaaatatacaaaaataaacaagccaaaatctagcactggtagatgacattcccagttctgatcaagttgctgacaacaaaggattggtctccccttctaactcaacaaagggtaggaaatcttatcactcaagatatcaatcaagatttatttgatcgctgaaagggttttgtcaacactccaaaaattgtattagtgactagatgattgatggaataagtcaattagaaccagattagaaatcgagatatgaagtcaattacttccaatctgaaaattaggaatcattaaacaataatataatagatggcatcaattttcaaaactacccttcgtgtgtttgtctatagggcaaaattcaagtaaaaaataactttgaaaagactaaaactatagagcaacttgatcttgggagtgttttcccagatgggtagtgggctgagtctggtcagttttcagtggagaaaatgtagacgagataagcagttgatgttcccaaattcaaataactttatggcagaaaagtcagtcaagtttaattctctttccctatactagctgtgtccttaatgataaatacaataataatagctgacatgtattgagtcttacattatatagctctctaggtacctaaaagatgacaactaatttatttaaaccaaggcatatgaagtaagtactattattattcccattttatataagaggaaaaggatgtgtaaagtgctaattgacctgcttaagaggtagagtgagaccttgaaccctgtagtctatgtttgtcctcctaatagtgtctctatatggtttcagaatagaagcaaatagacacataagggttaagcatggctaacctaactccaagttgagtctttttacactaggcaatgctgtcttcaatatatttataataactttatacaccaaataacattttgaagtttatttcctcccaatacagaaacatcactgcatttccactgggattttcagtactgtctgttgtggaactgatctgggcttagtgagtattgctttatcattcttaaataaaaaccattatagagaatgcagaaaacaatttccctttcagtttgcccacttctacccataccgagaaagacggatccttaaagctcagaatgtaataaaagctcacaatataataaaagctcagtatcagaaatgttccaagtccctccactctttctctatagttaggaaactaaaatttaatatagggcacaacgctccagagaattcagtgtatcgaaatgttaatacacttttatatattttaactgagataaacaagaaagagatagggaagccagagcagctatggcaaagacataattatgataagactaatccagctaacagcaatagaagcagatagtgactccactgtgatgctgtggtagagtttgtatggtcagaaaactatatcagtatacaatgttaatgacgcaggagccccattataggaaagcaaagataacttactatgtgactctataaagtaaagttcatccaaaagatcaaagagcatttgtcctattactaaaatattatccaaatgtattttatcaattaaaacttggataaaatcatttgcttcattgaacagtaatttaaaaggagcataggctgggcactgtggctcacgcctgtgatcccagcactttcggaggccgaggcgggcggatcacaaggtcaggagatagagaccatcctggctaacatggtgaaaccccatctctactaaaaaatacaaaaaattagctgggcatggtggcgggtgcctgcggtcccagctaatcgggaggctgaggcaggagaatggcgtgaacccgggaggcagagcttgcagtgagccgagatcacgccaccgcactccagcctgggcgacagggcgagactccgtctcaaaaataaataaataaaataaaaggagcatagtatgtccataaccaaataggaaggaaaatgcctattttgattttcataacagagcttaaacattgtggcaaaactttaaaatgcaggacataatgtaaaaattcttctaccagctctaaattcgtggttgtgctatcaactatgtcacatttctcagtgttgaccacaaaaataccatgagatacatacacattgctgaaatacactatttctcaaactcaactttatcttctactccaataaccctgtcaaaaggaaaactagtctggttacttcatttctggcagatccacattaactcctttcttttaatgctcattaatctttctgttaacaatacttctgaccctcaatacccaccctttcagacaggtcaaaactaaattcttcagtttaccatttaagcctttccttcaagtttttgcaggtaaaatgagataaaaacagacgtttgtattccagccagattgaaattttctactaccctctttgctcttcccattaaattctacctcgcagtttgtttgtttttgttttattttgttttgcgtcgtttttttaaaaaaaattgtttattgtttatttactaaatctggggcatattagatacttgaccaatttaaaatttacatcttttaaatcaattttgaagtgttttcacacacacatacacacacacacacacacacacacacaattggcatgcaacagttgtcctaaggtgaaacaatcacctcatcaacaaagtgtcataggtgttctcacccaaggttgcttatcctaaacctgaaaacctgtaacaaatttaaattacttatataaaactcattacttgtagttttccccttgcaaagatctccagaaatgtacaaataactaatatacatcagtcacaacataatcctggatcatccccacatcaaaaccagatgctcctttaattttaaactcattatcagagagcaagagaaagtcatttcgttttacacaaaacaaaattcacatatgccaaaaaagaaagacccaagagaaacaaaaacaaaaaccctagtgctgacactgatgttcagtgccctggttaaacagtggcccgaaggccacggatcaaaaataaaatagcggctgtatatcactgcaatgaagtttaacaggctttaaccttctggcttcagaaatccagatttttccaattacatgaatgcatacttcctacattccaagagtggagaaagtggatgcgccagtgtggaaatgaaaagagccaccattcactgggacaaccacagaactggctttaacagagactccttagaaagttacgcaaaaaataaagacaaaaaatggttgtatgcggcttgtgtcatcaattttaagtggaggtgactgagtcctaaggtacaatgtaaaatgtatgggggaaaataggtgctggggcaagtcttacctttaaaagcaaaacttgaaaacaaagtataaaagtgcccagcctggcagcatacacccaagccagagagctctgccatgagcatgcatagaaaatgtcaggattcatactattgtttctcataaggactcaacaaaatgaatccttaatagcttaaaccacagaatgagggaatacacagaatgcagtcatttcagtaaagtactatcaggctttgtgctgatttcctgaactaactgcattttattatcaaaacaaaaggaaaagaagattttaaaaatatatatatatatatattcctatatttcaattccagtgtttaatttctggaaggacctatataatggaggcagcatttaattaggaaattatgccaatcaattgtcaaattttcactatgactttcctaaaaaggtgttttcttccaatttctattaatcacaaagaaacataagctgtgactgtatagttcagaaaattaaaacatagaaattaatggcctatgacgttatcaccaaggtgtttggtaaacagtaaactatgagtttggaatcatcaggaagaggcttttgaaacaaccctctggacttcaaaaaatctcttcaggtagtagatgtgtcccaatgtcatggcaattagaacaagagcttcaaagaagcaccgaaggaccactgggctgtttgtgttgtcactaatggctctgtgtatcctctcccagattttcgtgtattcctctttgtgctgtacagctgtcatggccacagccagctcactgatcatttcttctagtttgttctggtgagcttctgtttccatgtcttctctttttgtagcctccccaatatcaatggtgaatatcactatctttggagtcatggtggacactcggtcactaaaacaaaatgtatttgttccatccatgtgagcagaaaatgtgtatttcccactggattctttgtctcctttataaatccttttattcttaggtcctgtaatctccatgttgatgcccaggaagccaccttcgaagatgaggcccatcttggtgcctgaggtgactcacttaagcattcttcagcatgtgcgtggatgctgatgaaatagcccaagaccatggtcaggagagtgttctggagcaacagcagctcagcgagcgtcaccacagtggggctggagcagaggccaggactcgcactgcggcctccagagccactgccgccatcaccaccctactgccttcgcctacctggcactttttgctaatcctaggaaaaacgcaaactcaaatgccttttgtgctgggaggtactgtaaataaatgaacagagaagtctagtgttaagaaaaataagacaggccaagtgcagtggctcacgcctgtaatcctagcactttgggaggctgaggcaggtggatcacgaggtcaggagatagagaccatccaggctaacacagtgaaacccagtctctaataaaaatacaaaaaaaaaaaaaaaaaaaaattagcccagcgtggtggcacgcgcccgtaatcccagctacttgcgaggctgaggcaggagaattgcttgaacttggcaggcgaaggttgcagtgagccagggtctcgccactacactccagcctgggtgatagagcgagactctgtctcaaaaataaataaataaataaaaataaaaaataaaaataagacagcagtacgttactggccgaacatatctgagtcatgcgtcatcaaagaatgttaccagcagtgaatctgtatgggtctgcagcaacctcagttcttacctcttcagaagaaagagttcaaccaaggggcataaggcagaaggagacaccaaagcaagttttagagcaggagtgaaagtttattagaaagctttagagctggaatgaaaggaagtaaagtacacttggaggagggccaagtgagtgacttgagagatcgagtgcatggtttgaccttttgacttggggtttcatatattggcatacttccagggtcttgcctcccttctcccctgagtcttcccatggagtgggctgttcacgtgctgggtggcctgcatgcacagtgtgtttactgcagtggtatgcatacccacttgaggcatgcttcccttacctatcaagcgtccctataaggtcatacaccagttaaactccaccattttgcctcttagtgcacatacttgatcccacgcacccacctcctgagatcttattaggaagctgctgatcaccggttttaggtttcttctgtctgttgggagactattgttccctggtgccagctgcaaccaattattatttgagagaaccatcttaacaactgcctgaccatcacctgatggtcgcctgacattcctggtgggatgtggggtgtccctttactgccccaactcatatctgactagctgactagctacctactgtaacaattacacttgattgcatttttttgttgttatttaatttttatttcataatcataaacttaactctgcaatccagctagggaacaaggaaaacatggaacccaaagggaattgcagcgacaatacaaagattctaggatactgcgagcaaatggggtggaggggtagtctcctgagctacagaaggaatggtctggtggttaagagaaaacacaagtcaaacttagtagagctgtccacagtcagcaatggtgatcttcttgctggccttatcattcctggacccaaagtgttccatggcctccatgatattcatgccttcaccatgccaaagaccacatgcttgccatccaaccactgagtcttggcagggcacatgaaaaactgggaaccatttgtgttgggtccagcatttgccatgggcaagatgccagtacctctatgcttcaggatgaagttctcctcatcaaatttctacctgtagatggacttgccaccagtgccatatggcatgtgaagtcaccaccctgacatataaaccctgtaataattctgtgaaagcaggaaccctcacacccaaatcctttctttccagcgctcagagcacgaaagttttctgctgtctttggaacctcgtctgcaaacagctcgaaggagacgcggcccaagggctccgtgtcaatggcaatgtggaagtacacggtggggttgaccatggctgatagtagggtgctcccggcagtggcagcgtctgcaaagactgcttttttttttttttttttttttgacaaagtctcgctctgtcacccaggctggagtgcagcggcacaatctcggctcactgcaatctccaccttccgggttcaagtgattctcctgcctcagtctccggagtagctgggactacagatgcgagctaccacacctggctaatttcttttgtatttttagtagaggcggggttttgccatgttggccaggtctcaaactcctgacctcaggtgatcggcccacctcggcatcccaaagtgctgggattacaggcgtgagccaccacgcctggcctgattgcatatgaaatgcactatttccccatcctatctcacccccatctttttttaacaaagacttctgaaaatgtatttttcatctttcaaactttgctggacaagtttttatgaatagtctcaacagtgcaagcatgatgctagagagcaattaacctttgacttcagtgttgggagactgcagggagaggtgaagactgcgacaaaccactcgtgtatcatggcaatcgctactccctctcagccatttcttgccaactaggaattcaggcagaatgttgtcagatctttcagttattacagaaaagtaagaaaacctgcattttatgtgaaacttccagattttctagtattttctaatttttgcttgaaatcttttattgttccaatatattttatttctatattcctgtgtagcacacatctggttttttatttgtgtggtttttgttttgttttgttttgttttgtttttaggccagtgagctgacagatcgagacctctgggttatgtcattccttggtcagtagctttcagtctttttcaccactacacccacctcaaccaaccatcctttccaccaaccgatgcccatcacttcctttcagatgttgctgaagaaactatttctccatataattttccctagatcactctatccttcattcctcattaccaaactgttttactcttttagcctttagtatgtatgctctgtggtccattggtgagccctttatctttctctaattacacctggactatagatttctaatgccgaggacccttggtctcctgccacattcacattcccttagcagaatgttgcacacccagcagacagtacatgtatactgtgagtaaatattttgtattcctagtcttgctaggatagaagtttttattctatacttgatgcatttctggatcaaaatattaagtctaagtcaagtctccatagttaaggtaatcttgaggattaaaacacttaggtggacaggcaacataaaacactttatctgaataatgaaagaagaatccgtctgttggtctgaagtatcaaagcaactgtcccaatcctacaaactttcagcattgggacttcctttcaagatgtaagcagggatggaaaatatacaatgcaagcgccattgtttcactctcctgggcctgtgacagacatcattaagtgatcacaacgttcttttcttctaaggctgaatgcagtcttagaaaccattttaacatggtatcctagatgtatcgtgtccatcttgtttatttctattaagaaatagagttggcatgagagctgaagatcctatcatatgaaggtacacatacaatttattattcaaaagccagagaacaacatacaactgctgctgcatctcagtctctctatattttaatttatttattgttttgagacagggtcttgctttgtgcaggagtgcaggctggagtgcagtgataccaacacagcttactgcaacctttgccacccaggctcagaaggtcctcccacctcagcccccaagaagctgggaccacaggcatggcaccaccggcatcccgccatgttaccaaggtctcaaacttctgagctcaagcaatccactcatcttggcctcccaaagtcctgggattacaggggtgagccatcccacctggcctcaatctctgtatattttagaggatagataacttcgaatgggaaaagttgtctctaaagttgaccagtcaagaagaaacaatgcttccactttaatgcctatgccagacttaccttacccattaacttttaatcctgtaagaaagatttgctatgtgatgaggctgcttttgttgcaccttgtaaaacatactgaaataaacaaactgtaaatgactttgcagggattgctgatttaaataaataaattgttataattgtagttacagttatagtcaaggggctatttcatttctcagactctgaaccaaagcaattaggaacaactcagacacaaaatgaccagcatcaagaattacaatgaaaagccaattacctttaactataagaaaccttatttgcatttattaaaacaaatgatctctcagtactggagaaaattatgtggattggttgattaacccttcacttgtaagagaccagaaattacttttcagagagcctgtatcttttctaaatttacagacaggaaaccagtaaatgataaatgatcaaggcccaaggaaaaaactgcatagcacaatggacatctatgagtttcacttgtgctagcatgcattcctcattgtgctggtaccatcatcctcactttcctctggggaatccccttctccagttctgactccagatggtgtagatggagctaacttcactccccactgagaatgagcaaatgaccaatcaatgtatttcaccgatgaatgattcagggagccaatcattaattcgagtcagtccagtactactcaatgctaagatttgagaactactgaaggaactattgtgaaagggaagaatttaaaaaaaatcttgctggcattctgagctggtaagataaaaactttgagcgtctagcggccatctaaccactacaaagtgagaccatgcctatgcgtgagaccaacccaatggaaagaaaactaagagatgatagagacatatttctgatgccatctttgagaagctgcatccaatcattctggaggcaaaaagctcttaactttatagataggcaagccaaaatcttcttactttcattaagccacagttagagctaggtttctgtcatttgtaaataaagaagttaagactaaatgcaaatcacttatagcttattttattactaggtactcaatgtctatgcttttgcatagctaagtgagagaacttaaattccaatactgatgggctattacctcatgcaggtaccctaataaatcttgtttcctctcagtgccattgtttcctcatttctaaaatggagattaaaatggtagctcacaaagaagaaatacaaatggcctataatcacatgaaaaaactgttgaacatcattagtcaagaaggaaatgcaaatcagctctacaatgataccacttcacactcactagaatggctatgatcaaaaagatagacaataacaagtgttttctaggctgtggagaaatttgaagtctcatattggcaagtgggattataaaatggtgcttcaaaaagcatctggcagttccttaaaaagttaaacatagagttaccgtgtgacccagcaagtctactcctaggtatatacctctgaggaaataaatatacaagtacacacacacatacaaattaaaaagtccataaccacattattcttaacagccaaaatgtgggaaaaaaaaccttaaatttccatttactaatgaatggataaacaaaatgtgtcatatccacacaatgggcattatttggcaataaaaagaaatgaagttctgttacatctcacaacatggatgagccttgaaaacattatgctatgtgagaaaagctagtcacaaagaccacatatcatatgattccatttatgtgaaatgtccagaataggtaaattcacagagatagcaagtagattggcagtcaccaggacataggaggagaggaaggacagtgactgttaatggctaggggtttcttttcagagtgatgaaaatgttctagaattagatagtggtaatggctactcaactttgtatttatactaaaaccaccaagtttcacattataaacggataaacattgtgctatgtgaattatttcaataagaaaaatatcttatagaaaaaaaatggtagcctattctgattctcacaaatgaccattataagaaatccatgatgataacaatattaaagtgacgttcttgttggagcctaaggaaaaacaatccatacaaatgcaaaggcctattgtttttaaggcctcagcaagtgctaagagaatgggaaaagaaaattaccaaatagattttcccagatcacttagcttcctttgtatccagcaatggtcaacaaatatatagcaggcatacataaaagctattcggagatctcttgaggttaacagcatgcaacatattgccactgcccccagcctggccaggaatattatttatgccaccctttcacagctgtatcaatctcccatgaaacattcagagcctccttgttaataaactacattatgagccggatgcattgtctggataaactgcattgtccaaaacactgccccattattacagaaaatgcagaatgtaattagtattcttctttgcataaactgcagcttccaaaaatggtgccatattataaagccttaattaataaacaagagttgggccatgaccagttacacttatctgaattttatattgtgaagaaaggccactgttcaaattccgtttacaaatatctaaattctggctagcctacatgaagatagtctaaacagaaagcctgagaattctgtgttgctaatagcattgtgttggtacaccaacaatagcaagccattaactgctgggacataaaccatcctgagaaatgttcagagtggaaggatgataacattgtatttcagctgcatcgtatggtgcaattcttctatttgttcatatgcatttcccatttaatagatggaggaaccagggtggcttttcatatctctgtgaaaccttaaatgtgggggagaaaagtgagctggcaaaaaaacaaaaaggataagtacgaggtattgtggggtgggagcagggttacatcacaatggaatgtaagtacacagttgctttctccatttccagctggtttttattgattttcccctaacctaaccccaaagcaaggccatttacataagtcatgagcattgaactaatatttgggaccataatattaagcagcccattttatgaacctcggctaaaggagcatttgcattaaactgcactcacctgattaaaatccatcaactctagcaccttgagaattgtagagtacctgttaagctcggctgtgggactctgcatactgaggcagaccataatcagaaggcagcaaggaatccgaccgggagaggaaagggaggaggagaacatgtgatgtgtgttgaaaagcagatcgcatgaaagaccgccagtgctcaaatctgaaaagagtcctaagcctactgcaaacacagagctgtgcgaacatgataattctttcagcaaagtccataatatggcttatagggccctgtgaaaacaaggtggatgagatagtattacagttcagtgaagagtaactggcccagcaatggaatgtagcatacacaggaggccccaaaatggtccctgcctcagcagaatgagcaagagctcagagagtccaagccgagggactttctgcagcctaaacaagccgtcttagatcactgccctttccatcagctccaggtaccaagcacaggctcagagtcctatctgtctcagaaggacctgctttaccgtgaccgcaaggatggcatttgaatcagtaataggctgtcagaggccaccttgatgcatttgaagaagagctatccctgagacattggttcaagttctcgatctgtaccacctagctgtgtggtcacggacaagcagtcttgctcatctgaccaagtggatgcagataataaacacatgtgaaatgaatgaatgagagaataagacctctgaagcagaatttctctccccagtgatacagacagaagacaaggaaatactgggtagaagagggaggttccctggcaaaggccccaacctcaagcctggagacctgcggcccctaagtggggcatttctgtttttgtacccaaacggttgccttttggcatgccacactcccttatcctgtacccatataaatcccggaccccaggctccaggagcagacaaggagaagaggagaaaagcagacaaatgacacaacagagaaagagagaggagaaggaatgtctgaacgccgagaggaactcagctgggggcagtcggagaagagtttggccgctgaacagccaaaactccaggggaagatcatcttcccattccatcccccagccagctccccatccatcccattgagagccacctccaccactgaataaaacccctgcatgcatccttcaagcctgtgtgtgacccaattcttctaggatgctggacaagagcttgggatacagaaagctgtcacactggccctctgcccttgcagaaaggcagagggagcactgagctggttaacacttaagctatctgtgaatggcagagctaaaagagcattgtaacactggggccacaggcacccacccctagacactaccatgggactggagcccaaagcactcactcttgctcctgcacctggccatctgtgtgctccctctcccacaaggggtttgagttcatggtggttgaacagagagccgcacccctgtcgcatgccccatgagtggggccagggaactcttctgtttcatcaacactattgacatttgaggtgggatgattctttactggggaggctgtcctgtgcattgcaggatgttcatccctggcctctacctacaagatggtagtagcacacatactccctcaattataacaaccaaaaagtctccagacattgccatatgtctctcaagagccaaaattattcccagttgagaatctctaatttatccttcagaatgtacattccaggatctaaattaatgagccatacacccagatagtgccccctaattattaggaaaacttacatagataccttcattatcactggaaattcatcaagacaaaaattttactgagcacctattatctgccatgtagaaagatactgttcctgctcctgagaagctcacaagtttaagtggaaagtggcattttacaacttcacatcaaagaaaagagaaatgttcaggtaaccatctttccaataaataatagaatatccttctatctgattagagaggtgaactgtaaagacaggcaagaatcagagcatatctctttgctattaaaagaatactacatgtatcaaagttgctgacatttgataaggtgaatttttggtaattttgactcattttagatgtttgctgcagttgtttattgctgggtgcagggagtctcagactcaaaggacaatcttatgaggtggtttagcctaagagcataagccaaaagagagagctctggaatgaaactgcctggttttaaatctagattctgccatttgcttgttacgtgacccctggcaattcattaaccccttcaatcctcaaatccttctctatgaaaaggagataatcaatgtacctacctcacggatttgttaaaagggttaaataacttatgtaaagtgctgaacacaatgcctcccacaaagcaaaaattgtaagaacaatagctgttagcattgttatattgatattgctgcctctccattttattatgatcttttttattgtagtaaaatacatgtaatataaaatgtgccatttcaatcatctttaagtctacagttcagtggcattaggtacattcatattattttgcaaccattaccatcatccatctctagaacatcttttattttccccagttgaaatttcccattcctccctccaccagggttgttctcttaaaccagtccttacccagcaaaataccttctaaggaaatgaggacaaagcttttgtaaatgagactaaaggcaattcaaactcaggtaccctggaaactgaatagaggtagtgcttaaaatggccatttgggccacttggggttatgttgatgagtttagtcaccatgaaccaactcctaggagtaacattctaagtgggtttttgttttgttttgttttttgttttgaggcaaatggttcctggctctgtggccttcccatcttaccatcacagaagcattcactctactcctctaatcaatattaacccagaaaaaaagtccagggacatatatattttggtagcctagaattaatgggaaaagacaagttgctgggtctaaactatcaaagtcacgtactttttaacagagaatgaacaaacctcctcccttcaagaatccacctgtttttgcaagagcattctggggtgggaggaaaaccttctgatttctagccagctcctcaaaatagctaaagagttcctaatttcacctcaaacctctgtttcagcacctactgtgttgtgccaagttatttctcatccactatcatttttgacagtggatctgaccctattgcaatcgagtttaaggagtttgtagacaggaaccctatctgagctgtcagcacgttgcctgatcatcttcagcaagtggtctggcagaagcatgcaggtaaggatgccctgaagcaggctgtcaagaaaactgaccaatgagaaaggtgttttgtgctccacagctgaagccaattctgctgggacatcccaagacagactccactcggactcaactgataatacacactttacatctgtcactatctgcccaggcatattgactttgtaacattccccccaggcacttcaagtccagtttcgactctgtgacttttgcctgtggtcactttgcctgaaatgccctttctccttctccttcttatccattcattaggatctagcaaaatgtacctcctttgaaaagcactttctgtagccctcaggcacaagtggggatggctgtgttggaccagaaaaagcaaccattgaaatttccaaactgaatctgtactttgatttatttcagtgtggtataatgtatggtataatatatggcaatgttttccaagtctgactgtacatcacagtgacctgggggacttttgaaaaatagattcccaggctcccctccaattaagacagcaggtcagaaggttgcaactcaggaagctttacttaatgtctagaagtttcccaggatattctgatgcatgaaccgtacttgaaacaatagtcagacattgctacttatcagctgtgtgatttggggcactctgagcttgtttcctcatctgtaaaatagcggggaagtaggggagtgtcacaaggtcttagaaaggaccacatgagggaatgagtgcaaaattcttaaatgatgcctcagtaagtgaaattatgatgctaattacaacgaatgtccttaaaaagctacttttcacttccaatagtccagcttgcaaaaccttcctctatcagagaaaaatttagtgaaagagtaaatgggcttcacaccaggatgatagcctggaaaaatcaaaagagacattgagacattgcccacatagaaagcaggggaagagcatgttcagtttttctgaaggtctatattcttcattcctactgtccatttctcctgattaaaagtctctcccaatagctgagaccattaacaaatataagcccatcaaatggtagctaccccactttgtaaaattaggcttttgtgtctctcatagaataatgttctaacacttcactacctgtaataaagtatttgcaccacaagaaaaaaatgtatttcatgaccagcaggctacaaccagcattctgcttttaggaacccatgcgtttgattgtatcctaagttggtaatgagtcaccacttttgcatttagttaaggacaccaaacaatgactctgtgaacctcagctcagactgcccctgagtcctcagaagatgcctaaatatggactgttctgtagcgcttaaggatatcaaatgacagtataccatgacaatcacaactaatcgaagtcccctgcagagtagttcctcataaagagatggagatggaaaagtaggaacgtttttcaatgctatgcagaaggaaaataatacctactgaccatattcatcctttcaaaggtctgccctgaaggcaagttgacaacacccaggcttggttctcccttttggaagagctaacgctaggagagttcacccttgctccctctggcgggaatcagcagaacagagcgggaggcactgtggcattaggattgcaaaccctggcttcggacacagtgctgcttgaatcagaatctacactgcagctgggcaactggctgaggtcacatttttaggctctgagctgctttctctatttgcaaagtgagaatacacagcttctaaggtcataatgcagatcaaattatatataaagcacttaacatgtgctcagtaaaaagtcattgatctaattattgttgtactttattgtcattaatatcaagggaatgacagcatagtgagtctcctagggatgcaggtcaatagatgttgaactgctattatgcagcaggtactgtgctaggtcctgggtaataccagagcaaacaagatcaacacaatctgcacctccaggaagcttatggtctagttcagaggtaggaaaaatgtgttttgtttggcctgcaccttgtgtataaacacaaaacatagagcaaacattttaaacttggatgacttcacaccacagtccagatttctggcttctctttgaaaacatcagaaattctgagagtaagggagatttctgtccacatgccaagccttctaagtcccaaagcaccaaccttccactggagagtggcctgctggctcttctcattaagaaaaatctccctctggctacacatgatgaggggcctggaggaattaagagagatgaggtagctgaggacacaggtccaggggaccagaactgaagcaaggaaggagaaaggagactcagcgctggttctctttcacggggtttttttgtctctcagctcagctcgctctgtttggctggacacagaaaaccctggaggagaattctgattccaacttgctctttgcacagttaattatttggagctcccagaaggttggagagaacaatgacttcccctgcagtggcagctggactagcttagttcccttttctgcccccaggggtcagaacccaaggaaggggggctatttgttttggccttaaaccaaatctgcctagagacacagagcgatgctctgacctgagaccacaaaagctactatttcaatgcctggtaaagctcctctctcttgccgtccacagcagtctactgacgaaaaacgcgttttccctatgcaaactgtttacttctctcctttgcaaattggaagtaatgtaaaaaaaaaaacaaaacaaaacaaaaaaaaaaaaaaacagaaagaaaagaaaagaaaaaaacctatatgcacaagaattccatctctccttgcaaataagatatttcacatttccttaggcagatagcatgcagacaagtaggggaactaattgggatggatcagtgaaaacaacgaaagctcatttatacacaacttgctaagtgtccacaactttgttctaataggggatccatgacaagtccctcaaaaacagagaaacaggagagaataatttacactttatagttgtgagccctgtaacagtagaacaaccttcctgcagtcccagagagattgtccccacatctaaccaaaaccattaccatcaatggtgtcctgcattttgaacagttgttaatgaagtcttgcctgacccaatacagagtgaaatgggtgtagttgctgctacaggctgccttctagccttcctgcatctgaatacattttctctgttggctgttctgatagagattcatctggaattcttaactagataaatccctcaatgacaaggtaaggcccatcttctgattaaacttgtattgaatttatttatttggccaatcatgtaatccatatttattaggtaccttttaagcaccaagcattgtgctgagtgacggggatatcaaggtgagtcaaaacaaccatagtccctgtccttagaagtccagaggggctgggtgcagtggctcacacctgtaatcccagcttttagggaggcagaggcgggaggatagcatgagcccaggagtttgagacctgccagggcaatataggaagaccccattctccacaaaaagggggaaaaaagcaagtccagagaaaaggaagctactaatcaaaagatctcacaaatataaaactgaccctctgaaaggtgtataagaagtattttggtactaggaggctctattacaaagagttcgtctagatatggggtggcagataatttgtctcagaagaaacagtacttgagctgacatttaaagccaggggaaaagcatcataggcagcgggaatcaaacactcaaaggccttgccgtgaggctgagcagtaaacataaggactgaataaagaccagtgagattggtgtggagaatgcaaggaatagagtgatgaagatggagagttggtagggaccgtgcaaggccttgtggagcacttcaaagatttccagcaacataaagctatttaaagatgtttaagcagggtataatggtggtagttgatgtgatcagatttacgctttgaaaaaatatagattagagttggcattttggggggacacagagtagatccaggtagatccaggtagaccaagtagtctagacctcctaggtcacaggtgtctaggaggggatggtaatttggacttggatggtatggcgctagaggtgatgtagccacattgacatattctaacaatagttactctggtaccaacccaatataccagagtcatccaatggcccaagagtggtactaactgtaattcctgattctgtgaagctgagtaaaaacatttagaaagaccaaactaaaaaggatctgaacgcatctgtactccctcatccccagcagcaaggtaccaccacgtactctgagtgatcatagctttatacttgaattgacaaattctgcataagactccacaggaaacccattaaataggcagggaagaaaatgctcaccattcagcattgacaagaaagatgataacaagcaagttttcagtcaaagtgggtaaaatgttgaatttctactctagtgtcattagcactgcacctgattttttaaaacaatattttggttaatcaaaactctgggtcaatcaactgttccacagtgacagctcctgtggtcatcaatctttgttatcgcttgaagctgacatggtctcggtccacaggagagtaagcagcaaaagacaaaggtttctcttcatttcccccaaagggagttaagcaatgagtcataaaagcatctaaattattcacatggctttccagaagtttatgattcaagatttgggagagataattgaaggaggtggggtgggaaacgtaacactggatgaacacatttattttgaaaatgaaaggatgagtttctgaggtagacccaattaccacacacagggcttcaggagcgacagcagcggcctatggttccgccacacaatgcttcattcattccttacatgggttcggacgatcattattaacctacagtcacctgagaaaagctcagtgtctgccaatcagtcacactggacttttgtggaaatggaaaaaggaagagagagtaagaagggagggatggagcaagggtatggagggaatgtgaggaaagcacaaggaggggccagaaggtgtcagctggtggaggagataaaatgttttctgtttctgttttacttgtagggtataagaaagagacatcagtgtgaagatatgccactgggtaggggctgagggttgtttgtatgtttgtttgttaataaacgtggcttgaattagatatatggctctccgttttagtatataagaaatacaagtaaaagagttcagctattgtgaaacttcattctcttgccaaatggagtttccttgactgtaatgctccaagactgaaccatgtacattcactatttataaaagctagacatgcatttattgaacctaccagatgtaggtactgtaaccaggcatgattaacagtagaaagaactgaaaaacccttcatgattcagccttagtttaccttactggttttatctcctgtgaattctcctttaaaactaagatcacagttctgtggttcttggaattcacaaaaaaaaaaaaaaatgctctacttcccctctgtgtatgtgagtattctctctgcactgaatgcccttcctccttcatctagcagcactgctcctctctgcctggaattgtctaattcctgccattcctcggatctgtttagacataacttcctcaggatgccatcctgaattctgagctgagtcaggtatcccttctcagggctctcactgagcttatctcaacagtagtctaggtagcattcaatcataattagatagtgtgcaagctttctgatggcagaggctaagacgttatcatgtttgtatccccagcccctagcacaccatgaaacacaaaatgcccaataaatttttgctgaataaataaaaaaatacaatacttgatacccaactccaaggcactttcagtgtagttagtaaagatagaacattttgaaacataacacagcacagggcaatatgaaagaaaataaaaaattaaataaatctgttataagcaacaaagcaggtatttagagaaggcaaagattacttttagctggggtgacaggagcaacagaatcaacgacaattcaatgtgtgttcatgacacaagtcctgtgttagttgttttcaacaacaaccctgtaacttgataatattatccccattaacaaatgtggaacccaaggttcagagaggtaagtgatttttcaaggttatataatcagcaatgccaggatttgaatgatgaatctaagatttcaaaacactgagaatggaaaggtgggtatcccaggtagagtaaaaacagaaacagaaaaaaatgtgcaagtgcatctcagtgtaatgtatgtcctggggattaaaaacaaatcaacttgatataatctattataggaatgctaaggatgctgatcctagcaagtaagctgtgactagactgctgggggccttgagtgtcatgctgaggaacttgggtgctgaggagccattagaagctttggagtagagaaaatgtgatcagagctgaaactctgaaagccttattagagagtgggagataggatgaactggaaagataagaaggaagtttgcaggcaaggtaattctgttggggacaaaaaaacttttcctttatcttcttatgttaggtatttgggggcctgcaaattaaactgacaaaccacagattaacaggagaaaagtttatttatgtgcatatggaagcttacaaaagaagtaactcaataaatggttaaagttagaggcttatacagtcttgcctgggtatccatggggaattggttccaggaccctctctcgccctccatcggataccagaatccaggttcacattccttatataaaatagcaaatataacctgtacacatcctcccgtataatttaaatcatatctaggccaagtgcggtggctcacacctgtaatcccagcactttgggaggccgaggtgggcggatcacttgaggtcaggagttcaagaccagcctggccaacacagggaaagcacatctctactaaaaacacaaaaattagccaggtgtggtggcacacgcctgtaatcctagctacttgggaggctgaggcaggagaaatgcttgaacccgagaggcagaggttgcagtgagcctagattgagccactggactccagcctgggcaacagagtgaactccatctcaaaacaacaacaacaaaaatcatatctagattacttataacacctaatacaatctaagtgctacataattattacattgtattgtttaagcaataatgacaagagaaaaaagtctatacatgttcagcacagatgcaattttctttttttcaaatagttttgatccactgttaattgaacctcagatatggaggggcaaatgtataactaccttagtagggaaaaaggagtgggagaaaagacctctttggaaagaataagcaggtttctacaggaaaaacaatgagagataagaaagtttgtaataatgtttgttcatccaggtacgagtggtctctctgtcttcttcaaggctataaaactcccccagagaggatatttatgatatattgagtctccttcctaggagtaaaagccaccctgaagaaggaatttatgaaagcctcatttcccagaagtttctgctattagtcaaataagagaagctctgagacggttttttttccgcatctgttgaatcccaaatgtcttcagcttaaaataatcttcagaccaactctgggcttctgagtgggtacccgacattaccacctaggagcctagcacaactctccagctccaaaggcactgatgtctgggatggagggaaagggtggattcaagccctactgtgagagaagacaccaacagcccctaacagctgagttattgtgcgtctgaaagagaaggaactaatggtgacttaaaagcattaagccaagatgacagagagatcattgtcaccactaacacaaataaggaagccagtcaggagaaagtactagtttgaagggggaaattttaaacatgctgaataagacacagcaggaaaaatctctaggagacaattggaaacgtggaaccagaaaaccagaaagtgatcagtgcaggaaatgcaacttgggagtcatttgcctaaagccataacttgaagccatagtaaatgtgggtatatctccaaggattaaggaatagagaaagaagactagaaggtaagcaacaaatcttagttaatactcaaatttagatggtctgcatgtgacattaacaagtgaaagatacaaagaattaagattaaagtgcccagtataagtctgacactaaactgggaactttttctatgtcattttatgacgtaggcactacctctatttcattaaaaccaaggctgagagtaatgtatcttgtcaaagccatataactagtagacaacagagatgggatcaaaggcatgttgcctcactcagggaccatctgactcatgccttcatggacaggactgtgggatggagggcaatggaggaagagttttcaggagtgcataggatgaacgtagtcaaaggcaatggggaccgagaagaggccactgaattctgagtcctctgagaggactcacctctcagaaatagttgcagtataaggtctaaaatcaaggcccccatattttgtgctgctttgacatatggagaaattcaggagggcctcaaatgacctaatgacaagttcccctcctgacatggtttggctgtgcctccacccaaatcttatcttgaattgtaactcccacaattcccacatgttgtgggaggaacccagcaggaggtgattgaattatgggagcaagtctttcctgcactgttcacatgatcatgaatcagtctcacaagatctgatggtttttaaaatgggagtttccctgcacaaggtctctctttgcctgctgccctccatgtaagatgtgacttgctcctccttgcctttagccatgatcatgaggtctctccagccatgtggaacagtaagtccaataaacctctttcttttgtaaatcacccagtctccgatatatctttatcagcagtgtgaaaacagactaatacacctcccagctctgctcctgcaaataaagtcccccagccaaacaaccctccctgtcatgtgaaccaggcatggttcctgcttattcctcttattccggagtagtggatttcagtttcctgccagcctgcagaattattcagacaagccgacttcatcctcccatagaaacagggataatcccacccctcttaatactaaagccttcttcccacatcccctgattgctcactgtgttcccaagtgcaactcccacgtggacctgtgtggcactcagggtccttcctccctgggctgtgagtatatgtgactaacaaactgctgtctcactggtccagtgttgttcagtcatctttctaaccctagggtgggaccctttctcaccaaccaggtaagtcgagagtggttagaacaacagaagacaccagagtgtttactgtggaagtaacatgggtgaaatgcttcactttaataactactggctttattacaactgaagaaatctgagaaatggatgattactcttttctaattttatataggaggaaactgaggaacagagaggtgttcaatggatacttagagtgagacagcaccaaattatttttctcactttaatgttgcattgttctcaaatattttttttacaagatcctttccagatgcttctatgagaatcacatatatccagtatttacagaaagccattgcaagcaataaggaaaatccaaaaagcaaaatatgggcaaaggataggaacagataatttccaaaagaagaaataggaatgccaatgatggcataatgtccaacctcactatgaatcaaagaaattcaaacaaaaattacaacaaatatttttgtccctttttggttgagaaagctttatactacccactgttggtgagattttaaggaattggagatgctcatacacagatgggataagtagaaatcagtatctctctgaaaggcagggtagcaactttctcaaaatctttaatggtagtattttatgaaaaaaaaattcattcgtaggattatatccaaaggaaacaacttgtgaaattcataaatgtatatggatgagaatgcttattcattgtttttttataatataaaaaaaccagaaacaatctaaatgcccatcaaaaggggataggctaagtaagttgtggtacacctataaaatagaatactatgcagtcttttaagtggaagatgtagatgtatatttatcaacataggaagatgatatttggttttaaaaactaggttataaagctgcaggtggaagagtacacatattatgtaaaatgtttataaaattttgtgtttttctacgtacacgcataatgagacatttgttgggaaatttgcaaagttttagtattccatagtcttcaaatttcaggtgagtcttactctcttctttagtttatcccaaaggcacatatcagtaatcaggaaataaaaggttgttttcactgggggtgggggaacacatggagaggaatgaataggtcacctcaaaaagaaagcatacttcaggaagaacttacacaaattacacaacatactttgcttttgcacttattttttatttcccaacagataacacgtgaaattccagaaaggggagaatcaattgtgcattcgatttttcacagggagctcatgaaactaaggcttctgtgcagcagcagggccatggagtggaaactggaaggcgactggggtcagtaggtgctggccagtccctctctgattgaaaaggacatgtgaagggtgccaagtgagacctcctctccaagttctcaacaatggctacttttttgcgttttattttgtgaacaattcgaacccacaaccctggatacattccacttgtgtaggtttccccttcagacagcaaatgctgctgtttccaaatccaatcatgagtgtttgctgttggagcgcttggtgtaaggcatgtgtgtcctataaaatatgtttctcaaaacttaactttttaagaaatcagtcactggtttatctcccaattctatcacccagaagaagagaaagatgccaaaacagatcccacagagagtttcattctgaaaaacagacatttaatgtagttattctgaaaaaaatacaaactgtattatgtcactttagaaatttcaaaatagagatctctaggtatcccgttaggcatctgtcgtgctcccaattacattactttcgacagccctaagagaagcaatatttattggcctactaagtctttaagaatgcaaaacttaacccatctggaactagttgtgttgttggctccagggttccttacatcagaacaaattcagacataaactctgggacagttcttgaatattgcatgaaggtgagttgcaggcattcacacaacacagcattgtcttttaaagcatttttataaagcagatccaaaggctggcaaacctttccttcaccataaaggaaatctaggctaaaggggaaaataagaagtttatgaactattaaaaaaataaagctgtggagttagggagttatggattaggttccaatccattaattcttttattctctggcagagctggctgaagatgtgcagccctctggcgggtaacagaaacattcatgtccagaacaatcacaaaaagggagagaaatggctggcagagcagagggcggatccactcatttggatgttaatttatacagaaatctggaattcaataatctcacatcccccaggtaagggagcgatccactctccaatttcatttgggagttctattacattaagcaatattctgtttggccagacatgccattcttctcttgaaggaaattaatttcttgattcttccatctaataatctaatataatcccaagtcagtgctttaagttttctcatgacactactagacaaaataaactctgaagtacctcttgtgggaactcacaagatacagatgaaaacaaaagaagaaagtaaaattgaagagggtgaggccagggacaattaggtattgaactgcctgccctgcctctgacacatgatacatgtgatttgttaagacgattttctatccttaactcttcactaagtagggctgctttacaatttccataggaaatttatttttaagtatgtaaggcctgtgaacaggataaataaaagattacaaggaaaaaaaaaagcagtgatttctggttgtttaaaaggcaactcaacaagcctttcccagcaaaaggaaaaggtcaggatcaataaaagggcctttcctttgggaggagatctgttttcaatttaacaaaaataaatccttatggtgtagtcttctgaagaccaaggaaacatcaagctatacaagggatctggccttaccaggataagaaaacttcttcatttgatattctccaataatatcaaaacaaagtaaactgtacccactttgcactctttctcggccccctgcctgttagtgaaaggccagttaacctgaaaaatgaaaaccagctcttaaatgtaaagatgatactactcattgatgcaatgttatcctgatagtggcttttcagagatatcatcttaagcgtgatatcaacagggggaatctcacatacgagtagaggctggtttagaaaaatcctgcaggatatggagtgtctttggtgacagaagtcatactcttaaaggtatcttggtcaaactcatcatctcttactctttttatattagccgggcgtggtggcacatgcctgtaatcccagctatttgggaggctgaagcaggagaatggcttgaacacaggaggcagaggttgcggtgagctaagatcgcgccactgcactccagcctgggtgagaagagtgaaactctgtctcaaaaaaaaaaaagtactggctcaactactatgatgagaagcttttgggagatactcagtggtaatgtcagccttattttctgtggcaaatctgaatctttgctgccgtaacacagttgttttcaacatttaccctttctacactcataggcacacacacaattttaactgatgaattcatagaattcataaacctgacagtgtcccattgctggaaccttagtcatacccattcctagctcttgctaactataacttctccatttttccttcctctcaagaaagtatattagattgcaaggttgcaagagagtaagagtcttaaccttaaatatgctttcatttattagaaaaaaggaaatcatctgcatccttcagcaatttaaatattattagagaaaaacctggtgggattcagcatcaaagttattctcctttctggcatgacctcctctcagcacttcttcaagtatataaatcctaccaatacctcaaggtccatctactctgtattctgaaaatactccaatctcctctccctggaatctaccaggactctcaaactcaagtgttttccagcagtcaggaaagttagttgcatgctgcaggccaattttcaggcatgtgtgtttactggatgagtgatgaggacatgacaacagaagagaacacgtcctccctgaagggggcagcagccagtcagtcccatcccattgctgtcaggtgggaatgcaggcccatagctacccgatcttccaatgttttaagataagtcgaaaatctgcattctatggataatatctcaacttcaaatgttggctcacttaggatgacaatgactctgtgatctgcattggacccatggaaccactaatttgcaacctctggtttctacaaaacatgaagctgactgataaatgacaagcttgtgccatttatcagcaagtgtttgctatttcacatcatcagtcacatcagtatttcagagagccataaataaatgtataagttataggtaacaaaaataaagcagggctttaacttaattatctttaatttagcttatttaaagtttcaaataacatgtaaagagggcctgagatatttatatttagaaatttagagacattggttaaataagttaaggaacaatgagccagactctgaagtcccagcaaggagggactgtatctttgttttattcagtacctatcaagagtgctaagtacacaggtttgaatggaactgatttgaatcatttaaggaaaaaggttccagacaaacattgcatgcattagaaactgagtatttcccgattaaacatacaccacccttacatttccaaagtgtcagcaaagcattctgttctttggtcaaatcttgtaaaagccacttactcctaaatatttttactttgtaaccttcaccgttccaagttcatctaaaagaataaagaaaatacctggcacagagaatgcattcaaagtgtattagttaaatttcactaaaaagaagtaaacaaaagacaaaaaacttcaatgcatcttgattctctgtagagagagcaccttgtggcttgggcttcttctatcaaacacatacccacacctttttgtcagataaactcatttggtttttcttgtgtaatggggtgagtattgtacaaggtttcaatgccttttttttccaactcacattgtcccttagaagctcgaagtactaacaaagtgcttcaccacacaaaagtgctgtctacatttgtctggcaaatacgatgccaaacgaaaagcctgatgagtctgcaattcgtcatgggcatgatcaagctccaggctgcttccaccagagagcaaattcaacattataaaggaagtgtggacaggaaagccttccagcaagattctcagaatatggacatgagattcaaagactaataaaatgggttggggagacggtattgatgaagaagcagccggagaggaaaaaaggaggatttgagcagatgtctgtcactaaagaaagtgaaagacacagaggaaagagaagatctatgttatcacctgtgatcctaaaacaactctaggaattaggccgcattatccttgcttttatagaggaagaaaatgtggaacagaaaagctgaataacttgtcacagtcttacccagccaattagtggcttaactggagtttggccaggtctttttgtctgtatagcacaaaccttgtgaccacacagcactaacttccaataagtcacccaaaaagtcagctgcatgtaattagctctgctgtgaaactatggactggggaaagggcattgttcatttgttagcttaatttttgttaaaggcatacaagaccaaccacaaaaaaagaaaaacaaaaacaaaacaaacaaacaacagcaaaaaaaaatcagccagagctgtagaaaatcaactctgtcattagtaagtatattttattcaagtatgtgttattaatatatttgagatctcccaaatactaaagagatagaaatttagatacattggagataaacttcaagtaagctattttttcactattgcataaatgggaagatattttcattgaaaataatgttcctttactcaatcacccaatatttattgagaaaccacctgggccagacattgttctgaattctgaagatcagagagtgaacaagaagcaactgactttgttttgtttacagttcagattgaacaaagcaatggcaacagagaaagaaagagaagccatttatggtttgtgataaatgctgtgaaggaaatattttctgatagagaatgaatggaaaacttcctttaggcaaagaggacaggaagggcctccttaggtgattgtgtctaaatgagtcaagcatgtcgagggttgaagaaagggtgctgcaggcagagagataagagtatgctaagagccggtgaggacactgaacttagctcttcctgggaagtggcagccccttgagttggtgcagtgaccagggtggacatgtgtagtataagcttcagggaagaggtgagtagaaaccagccagcccctcatgggtctggtataccactagagtgcgtttggaattaattgtaagcacaagagaaagctgttgaatgattcagtcttcaacaagggaacaacatgaacagattggtggttttattttggctgccatgtgaagaatggatgacacgacactcgcatagaagtggaagactagtctagagtttggaagatagcacttggacgtcctgctggatgcctgccattaccctctggatctgccctccaccctttcctcgcctgttgcctgcctcagaggctggcttacatggactacggcccagggctctctagcttccagttagtttggtcaatgggaaaccccagccagagatcagaagggaggagaaagaacttaggatattagtccctcagcaccctgtcacctccaagcagagtttctcacaggttggttgtatcccaccacccagggctgctggtccttcaggtggcctctgccaaggggcctgtcacacagctctccctcaggtcccaataaccttccctctcctatgcctctttcctcccctttacccttcaggagttgagtagcatcagaaaacgctgcagctagccccaaggtactgcactctgtcttgtagtttgaaaatgctacctttgttaaactctagtcaaattacccaatgtatggatgccatctgtttcctgtggggctgactgatacaggaagagagaagcaagatactattttgacacgttcagttactgtgatccttgagtaacattctgtttagcttgagttcatataactcaaaaggttatcaaggaaatcttacacccttttacctttttaggagaagcaacaaattcaccaaagaggtaaaatgccaaaatcatgggcgtgcggattcagaaaataaaataagcattagtggtcatcagtatttgatttcaggccaattgttagagctgtcgcttaaaaatttagatgtacatttctcattccatgtttcatttattcaatcaatgtttattgagtgcctactacttgcaaggcactattttatgaactagacatagagcagagaccaaaacaaaatgcctactctcttggagcttacattctgggggagaatcagaaaataaacaactcaatgatatcttatgtgcttataagaaatggttaacaggaatagagagtgggagatcagcaagaggactgctgatttataaaagacagagtaggcctttcttaaaaggtgataatctgagcagagatctaaaggaaaagatgaagcaagctacggcgatgtccagggcaagtgtgttctgggggcggaaatcatgagatgacgaggtgtgggtggcacttttgagtaccagtagaaggccagtgccactgtagcagaggaagtaaggaggacattggcagcctatgcaatcagggagacggcagggacaagatgaatagcctcaagaactttggcttctattttgagacaataagtttttatggttttgagtagaacagtgataggaattgatttaggttcaaggggctcattctggctactgtgttgcaaataaggtggcaaggatagaaatagagaacacttacgcaaaagtctagagcaaagatggtgacttagaccagggttgtagcatttatatttgatatgccatttaaatatccaagggaacatgagtaggcatgggatgtgtaaccgaagtctagagttgaaagaagaggtctaagctagagatagagatttcgaaaacatcagtatttaaccttgacagtggatgagattttctaggaagtgaggagagcattaagagacaagtttttaaggatggagccctgagtcattacagattgacagatcagaaagaggatgatgaccagcaaggagaccaaaaaggccagtgtggttaagtgggaaaccaagagggtgtggtgtccccaaagccaactgaaaaaaaagtatgtcacgaaggaggaagtgatcaactgtatcatgtactgctgatagatcaagtaagaatagaactgagtagaaaaatggatttggcaaccaaggggccatggatgacccagacaagtgcattctgagaagcggtggggatgaaagtgggatggagagaacatgtgcaggcaactcctctgatgttctttgctgtaaatgggaagcagagaaacgtgggagctggaatgaattatgcaggcttctttctttttttcttttcccttccttccttcctgctttccttttttccttccttcctgcttgcctttctcccttcttttctttcttccttcctttatctttctttcttttctccctctcttactctctttatttcttttctttatctctttctctttctttccatttctctctttccttcctttgttctttttctctctcctttcgttctttcatctctttagtttagagacactacagcatcttcatatcctctcagaattgtctagtagggagaggaacccaaatgatgcaggagagaacagataattgcggaagccaagtgtttttgtaggcatgtgttgaggttcacggcaccatgaaggccgagggtggaagcagaacagttcagagagcacatggtctaggagcaggtaggctagtgagagcatgtggaggtttcctcctgactgagctttgctcagtaaaacaggaagtaagggcatacacatagcaggaccagcagagagaagctattggagatctgagaaaagggtgggaaatagtcatccagggcaagtgggtggagtagggtcctgcagtaggattgctgagcagtgtgttgggctttaaactgcctttcatatgaatccacaaatcctactaatattaatgaaagatattaattttcatttttcctgctcccgtcagcttaaaacgaaaagtttctctacttagcccatgaggagtcagaaaagaaaaagtaatgcccagcaaatttctccttcctaagctagaaaggaaaaaataagatattcatgtaaggaaaataaagaagacatggcaacttgaaattatgaagaaattccaaatgttgcatttggtagtgttcttaagctaccataagagatcttcattctattctgggtagggagaatgtacgtggcagttgctaggaatgatcctttgcccgtgatccttcccatgtggtaccccactgtccccaatagacctgagtggcacaaccaacaaaacaacattcaaatatatggaaatgatctttattttagactctttctcatttagcctgttgggctccgagaatgtgaaaaataaatctgaagccttacttttaatagctttcttataaattatccccagtatgtaaaagcccagctcctagatataaccagaagaagggggaggggggaaagactaatgacctttgacattaaaatttaaaatgtcctgcatgcaaatacactttcctgccactcttttgtaatgcaataaccagcaagaattagaattgcaaaaattccaaaagagctacatggaaattatacaacaaagtggtttcacagtgatattgagaaaggaatatgaaatgaatacaagataacatagagacagaatggggtgttacagatgtatgagtgaacgtgcgtatgagcacatgcatgtctcagagagagcaacagataaaaaattatttctttttttatgttgctcttcatgagcaaaattttaagacagacactgttctggtcacatttcaataatgtgacacatggtttctatttacattccaaatgagttttcactaaatgactttcgaaatatttacttgcaagtataaaggagaccctttgaatgtctgatttgaaaaaagaacaaaatcaagcaattatcaacatagatgttctaatacaaactgacactattttcttccatgtcttttttttttttttttttcattcctagacaccacaaaagaccaatgctacagatgtctctctttcggctttaaatacttcaactgtgacaatgatagtgagacagactgcttcaggccctgtagctaggacataataaataattcaaacaagttttgaaaaatcatttggcccatataatataccagctatccgaacatttaccaatgcccgccccctcccctcacacctcatccttattttcattttttgctgcttccatcagcttaaaatgaaaagtttctctacttagcccatcaggagtcagaaaagaaaaagtaatgcccagcaaatttatccttcctttgctaccggcttccattaaattgaaggtgacttcacattgatcctgggttcaattcacatatccaaagagacctcagtgattaacataaagggcagtccaatcaaggatagacacctccatgtgtgtatggtgagcaatttggtgggatgtaaaacataaatgatgtagcatcagaacacctggtgtggatgatgccaccacttgcctacccagttattctccacttcttgccctgagtttttctttctctctctctcttttttaacttagataaaaaataatcagcttcttaacctcccttgcatctaggagtcatcaaaaagatatcggttgatcaataagatcaataagaatttgataggcagggcttccaaaaaagtctgttgaaaagggaagactcagataacacagtttgttagtgtttgccttttgcccaagatccttccctctttcttctgcctgtgatgcccagggatggagtagtcagtttgtagcctatgaggacaaaagtcccatggcaaggcataaccatgcagaaagatagaaggaactgtgtcccgctggcactttgaacttcttgaggcatcttggggaaaataagcccctccttggtctagcagtatgtgacagttaatttcaggtgtcaatttggctaggccatggtatccagatacttgttcaaacatatctggatgtcactgtgaaggtaatttttagatgagattcatcattaaatcagtagactttgagtaaaacagattaccctccataatgtgagtgggcctcattcaattagttgacaattagttgacagtcttagaaaaagagtagcatcccccagggaagagggaattttgccagcagtctgcttttggacttgagtggcaatatcaactgttccttgggtatttattgtgttggcctaacctgcagattttggactgagatctcagccttcataatcatgtgagtgaacggcttaaaatcgatcatctctgtctctctctggagaaccctgactgctacaccattacaccattctaactgggtttctgttcactgaaactgaatgcaattctctctgacacatctgagatcaccacttcatacactgtgtaactgtgtaggtgtctgtgaccctcagcttccagatctacaaaatgggaatatgagtactcctgactccacaggcttgttggcttacacacgagacagaatgtgtaaaagtgctgtgctgtgttaagttacaaagcccaatcgaaatgatagggatcattatcatggtgggctcactgtcaattcacgactgtaagtctgttatgattgtattcacttaaaataataatattcttcaaatctgaccataaaaagtcattatagaacatttgaaagttcaaaaacgcatgaggaagaaaacactcaaccacctccatcattccatagctactgtcatctaccaatacctagcatttattgagttattatatagcaggcaatgtgtgaagcaattcaatgcattatctctaccctgtgaaggtaggtactattttggtgcccatttggcatatgggtgaaaacttgtcaccggacatatagctagtaagtggcaaatccaggattcaaacccaggtctgaattattctaaagcccatgtatgtatccagcaacacatggcgatgagctgtgttctttaataatgtattggctactacaaaattggagtgtgatcaggtaacccttacatcaggaaaaatggggtatgcacattgctcagcatatacacaaatcaagactcatattacaaggctgctagctctcttgtcagggataacattttaatttgaaatgaagtggaagaatgtttcatatcagctactccggttaacactgctttttacttcagataaagatatcccttctgtcaggcaccctgaagtttttctgtaaaaagttgtgttcatttgtttcaaactgcccatacatccatggtctcatttcattttccctatagcccgctgagttaagaggggcaggtattattaactccatttcacaggtgaaagaactgagccctagagaggttaactaagttgcttaaggtcacacagcaaattagtggtacgacggggattggaaagcctaacgcctgacatccagcgtggtatgttttccatcatgtagtgctccatcacctgtcactcccaccattcctgaggggcttggagttgatggggcatgctatcaatttctcagggtaaaactgtcctatctgggtaggaaaatgcacacacacacacacacacatatactagacacactgtaattgcatctgccaaaatggttttataacaatccagtcaaggatacagaaaactcccaggctgcctttcagaaacaaagcccaaaggatcaatttcatcatgaaataggatttcctcagctgtaggtggatgggtaggtggggaggtggatgaactgcattaacaatggaacagtggactgcagggtaaaagctcatttgacattcactgctattaagcagtggcaatgtaaacctggggtagcaaagagcaatacccaggaaaaaatacgaagaaaagtttcaacttaacccttctgtaactttctatttataagtctcagggtattaagtctcattctttagaaataacaaatgcatattttgactcactctgtaagatatttataagaaataaagagcaagggggtattgattaagaaaaaactaggatgagattatagatatattaatatgtgttaatatacaacatataattacatataattaatatataataaatgtacaaatatataatgttatataaatgacatgtcaatatatgaatatatatatttcaagatcatattcttaacctgaaaccaaaaaaagtacaaatagaggtaacatattgcattgtctatttagcattgaaaccaggattttcagatagaaacatttgcctttcctaagctacgcaagccatcagatatttacctcagtggcactggtctcagtgaaacatcttaatgtctcttctctcagttggttagatgaatggatgtcataaggtaaaaagaggaactgcaagatttgaagctcatagaaaaaagactggcactgggaatggcagttaccgggagattgaaacaagaaggcttctaaatatgctgtcaaaaccagcaccagtgacctctcatcaagtgaggggcagcactaaaagctataccttctagaatgatgttaccttgaaaatcatgaggaaatctcaagtgtctttctactacattagcaaaaggaagtttagggagtttagacaccaagagactggaccttctcaaaagggaatttgccacagaatcatagatgttcaaaatgtgaaccaagctttctttcaaataaaagtgaatatcagggcttaaaacagaaagacacatttcatcaaaaatgattaggggcccacgagtgttgactggggaatgagaatagtgggtaaggttagggggaaagccagaaaaaaaggtgaatcaaatatacttacactaaaaatcctggggctccatgtgatccagtcacggtaccttgtcacagagagaaatgtaatcagggatccaggaagttctttacaggtttacttggtgtgatgcttaatattaggtgtcgactagattggattgaaggatgcctagatggctggtggagtattgtttctgggtgtgtctgtgagggtgttgccagaagagactgacatttgagtcagtggactggagagaaagatccaccttcagtgtgggtgggtaccatccgatcggctgccagtgcagctagaccaaatgcaggtggaagaaggtgcgataagctggcttgctgtgtcttctggctgccttctttctcccatgctggatgcctcctcccatccctcctgcccttggacatcagattccaggttcttcagcctttggaactcaggaacttgcaacagtggctcagactttggccacagtctgaagcctgcactgtcagcttttctggtttgagcctttcagactgagccactaccagcttctctctctctcaatttgcagacagcctatcctgggactttgccttgtaatggtgtgagccaactcttcctaatatattcccttatatatatacatacatatatcctacttgttctgtccctctggagaaccctgactaatatacttggacacatgaaaaattattaagaagagatgtctattcttaatgcattaagaatactgtaaaattattctctcctcattgctgcctttctgaaaattcttcatgtggttggcagctgactcaggagcactctctttcctggcacttatccaatggctctaacacccaatctgggcagcctgtccggcttactgtctccatctctccactcttgcttatgtacttcaacacagactctttatttctttacttttatttctgttttctttactttagggaggacctgggagtttaccaggaagctcaaattcttcctgtatagaagctaggaaaatagtgaagattgtgactatccatactcgaataattttatcctataacatctcaacagattttgtctctaagaattctattgtctcaaataaacccagaagttagcactttaacatgggagccttttcaaatggtagagtctcaaggccacatctgactccagagatcatggtgttcctacaacactgagatgatgataggaactacagttgaaaacagatctttctccccacatcaccttgatcaagtcaataaatgttagtatatgccaggtactgggctaggtagtaggaacacagagataagcaagacaagatccttatccctgaagaagtcacagttcagtgtagtatttctaaaattgcattccttagaatgaaagtgacccttgtaaaaataatccatggaccaaataccttttggaatgtggcatgctcaatctccttttggacatttttcatgctcatcctaatgcgaaatgattatataaacttcagttctttactccagcatttcccacatttaactcatcgctgacccatttggcttgcaaaacttacgtcttgaattgagcctacaaatgttaacagaaattctaccattagcttaaaaaacagacaaataacaggcattttaaagataaaataagaaataatgatagcattttaatataaagtaaatagtatttcaaccaaaaggcaagtgaatctgtatgttgtcttaatggagattatatttgtttgctcactacagtttataagaacagagaggatgataaagacaccacaatgatgaccatgcacagagtgtttctatcagcaagcctatattgtgggtctttactcacaatattttatttaattcttacatcccttctatgaagtaggaacttatatttcccattttcctccataaagaaatcaaggttcagagaatttgttaatttgtctgctacgatcatgtgcctggtaagtgatggaagtgagattctaatccagactatttactctgaaaacctagtggctcccaattctagttatatatcccagagaatctactgttaactgatttaaaatgtccattagcagagaaacagattaacaaaattcggtgtcttcacatgatagatgatcagatggctatcagactatctgtggcttctgaacagaaataagaaagaggctttggcaagctctagattagaatcaaagaaaggctttccctcttgttaagcaactcttgttctattgcgccccaacaagagacagaatgtttcaagataggacaccaggtgactgtgtggcctgagctgcccaacctgaattgggtgttgttttatccactgtctattacattgggtgcactcagcagcagctgtctgtatcaaatgaaagtagattacacgggattgtactattaggcttactctggctatccctgttttaacccaaacctaagacttcatggggcattttttatgtagttacctgaagaaggaaaaaaataaagcctactttacagacaacattgcacgataagctagctccagcctgaagtggaccctgaatattataaccccactcaaggtgagtagccctaaaggacattgaagaagaaaaatcccatcagtgggcaaaacttcaaataattacctcttgtggtcaacactgcctggaaaaatagttggcctgaggtattgttccacgttaattcatgggctcatgaatgaggcattaggaagaaaaagaggggaagactgaaagggaagggaacaaatacacagtaaggcttctcaaacttttaccagagtgtgaaaatatctgtctatgtgaatgtagactagaaggtccccactgtggagaaggcactcagtagctaggtaggcaaggcctctttccctgccaactcagagcttaatcagcatattcataaaagctatttagtatctacggtggccaaatacagaggtttgcatgggctgaccaataaggacttcaccagttctggccactgccactcccaaatgtaccacttgctagaaacatcaataaggaaatctgttggagagttagttttttgattcagtgaataccaatgtgctctcccacatttcctctaccttttgtggtaaggtggggccatgtgactagtgcaggccaacgggctacgaggaaacagaaacctgtcatgcctgtgaggggccctggcaaggcataccgcctgacctgcacaccaagtgatgaggtcagagaatgccagattgctctgcattctctgtatagaggaaaattgccccgcaaactgcctgattaatataccaatcctgaatcaaagatacagaaaaataccctgactggaccctccagccacctgggggcatgctgtttgtatggaccccatctatcatagaggagatgaaaatgtatacttcttggaaaagacatatactcaataagaattatttccctgtttgccaggcttctgtgaacaacctcaaatgttttattcaccttgatggtctcccacagaaccttcttgactaagaaactcattttatatgtacatatatttatatgtacatatattaaaaagtaaagcaatttagttggtgctcatgggattccatagtctcacctagtaccccatcctcaacagtggaatggccagttaataacttggctgtggttccagttaaaagacaacaccctgaaaagctaaaggactatcctacaggctgcagaatgttctcttaactagtgattaattatagtgctattttcccataccaagaatatatatgtccaggggtcaaaggggagaggggagagcagtgcctttcaccattacacagaacaaatcactcattttgctttccttaccaggaaatttgaggtctgctgttgtagaggtcttacaactcaagtgaaaaatgcttccaacaatagatatgataaaagaaaaacttcagccgagttaaatttaaaggactttaattgagcaatgaatgattcacgaatcgggcagcccccagaatcacagcagattcacagactccaggggtgcctcatggtcagaacaaatttatagacaaaaaaggtaaagtgacgtacaggaatcagaagtcgggtatagaaacagtgagattggttacagctcagtgtttgccttgtgtgaacgcagtttgaacattcagcagtctatgtgtggttgaagtatggccgctgggattggccaacactcagctattgttacaggtgcatactattaacttaggttttcaattttgtctgttaagctaggttacagttcatccacaaagactcaaatatagaagtatggccttttcaggccatatttagtttgctttagcagatgcaagagtgtttctatgaaattggaagctgaaactgtccagtggacattttggacacctcacaccccactcaaactgagtaaaaagggagttattgtgttgggaggggtcattagtcttgattatcagttgggaaatgaagttcctgctcagcaatggaggccatgaagagaatacctaccatgcaggtaaatcctctggagtattcctgctactgccgtgtgccatggtaaagggttagactccagcaaccccaaatgagcagaagcattgagggtttcctggatagaattactgatggactgtttgttcaagggtaagttagagtatgttaagtcagagcaaggtattataacttgaaagttgaaacatggagaaaaaaaaaaaggagtattattgatatttggtaccaagaaagggatcagagcgaaatttgtctcgcgtggctgcccaatatcctctggatattcttgctcataataatgtttgctccacatcatgaattcttccttttcaaagggaatttcagaaaactcatatcctttgcagctaaggagcaggcatgcggtctgccctcctcttctcaggccacacaagacttcactgtggaagtgagcaatgaggaaaaacaggctatgtgtggacattcatttttccagtataggcagtgagaaaggtatccagatttggggatgttaggataaattgcaataaaattaaatccttcgtatcctagatgttacagtcaggaaaacattgtggtatccagtaagtagatggtgacaattgcctcataagcccagttctaagaaaatgttctgcagtcaacagcatgtcaatggctgttttctgaccagaccagttctgcaacatagttttggacattgttcccaaaagcttagcctcaagcttatttctctgggtctacaatgattcttccaaatgccccatatcctttaataaattccttctctatttaaattagagcccattctattgtttgcaactaatgctcctgaccatattttccttctcccactttcaatacccaggcaaagattgttttaatcattcacaacctaacagttctctctcaggaaagtctaatctagcaatatttttttctgtggaatctgcaacctactcctttacctttaagccataagcagtgaatgaaactgactcctatttccagaatcccacctgcattccttttccaactcaatcttctttcttagcctaaggctagcctatttattgtatgaaatattcttttctgtcagtgaacatggcaacatctttggctaagtcaaaagcctaactcttcatctagctttcaacttggaagcacatccctggacacacctatgctttgaaagtaatatttatctctctctctctctatcccactgttcaacaatcattttgtctgctttttttgagttacactttgcatatcaatactctttctgaaaactcctccaaagtgttaaatatctggcatagtcatttcaaaacaggaacggagtggtctgcatgttaaagaaggcaagaatgccagaaattgtcccatttcccatgttgatcagtgactgtgtaactcagacacgttgcagaggcctacatggcctacttcctgagaggggggtctcactgccttgtcaggattccagtttaagagcacagggcaagtgagaccactgaatacagtcatttaaaaagtgctacaggaaagtatttaaatagtcatcttatagaagggggtgaaaaagcacatttattgatgcagtaattaaaaaaagatttagatccagtgtgtcaattcccatagaatcccacttagcccccttatctatgtcaaagcaaacttagtttcacatcagcagtgcttctcatttatcttaatgctaaggatttatttcttatgcaaaattgttcattttcaccagcctggaactttaaaaaaattcacattctcttcttcaagaatttttattaagccaagatgtcatcaagctgaaaatctcagacacaattttggctctcttctgcaggaaactcagaggagtgcccaatccaggcaacagcagattagcactggcactgctgacaggttcttaaaagtgttggaaagagaagaacaaaggtggtgtacaatgattgacaaagatttctgctataaactaaagttgaaccaataaatatgtctagactctgccatgactatctgtggcctggaagctgcattcttcagaagaaaaaaaaaaagttgcagttggaatttggaatggttttgcccccatgatgtgcacacaggactttgatgagtagtctgatatgcagaagcatccagattatcactgagatagaaatgaaacatccagatgatagattaagtagattgttcacttctcatctatatatatatatatatatatatatatatatatatatatatttgacatcatagaggcataatcaaaatctgagtaggtaaagtcactaaccagaatacgaataccaagttacctgtgtggtttcatggaaaaataataggggaattgacatcatctttataaatgttgtatcaatgagaaaattatgacagtcggggagatctgatctagcccatctgcctcctgtctttagcattcaagctgccaagctagctttgggagacatttactttacagtttaaatgataataacccttccccccaactcaactgcctttgtaaagctaatgagggaccaactgagggaaggagagatgcctggatgctgctaaggtacagacatgaacaattgccagccattattccagagatcacaagatttgcaacttccctaattactcctgcaggcaacatcactattgtagattggccttttgagatactgtttcaggttttttgcatgtctggcacccatggctctacttggacccaccaactgatggttcctctggccagaagcaactcagtgtaagaggacagcttcaactccctatgattaaatctccaacccagccaatcggcagcaaacacccattgcatagccatccctacgccttcgcccaaactacctttgaaaagcccctaacctacaagccttctatgagattgatttgaataataactccatctccggcatggtgtggctagccttctgtcaactaaactctttctttactgcaattccatggtctctgtttgtgtagcaggcaggaagaacccactgggtggtcacagaatttcaaggctgcaaagagtcagactttactcaaatattctaggcaaaaaaaatagaatttaagggttacgatctgcacaatcatggtcaaaatcaaagacacatcgaaacagttaaaacgcaacagttatcccaaggtcaaaaccaagaatatttatttattagtgtaccctgtagctctgtacccaattaagcccaaacatctccctagacttcatctccataatcatatgggtatctgatacccgtcaatgcaattttcttgatcactaatgaaacattccttgttcattgcattagtctttataatcacaatattaaatcattttccctggtgttttcccctagcaacaatttatgagccattacagaatttctgttttttttctatgtcttctctcttctcataagttaaaccattccagtatcttgcaaatgaccagacaactactttaagactttggttgtaactagagcttcctaccaagctatgtaattaagccacagtatctttgctcttctagcttacaagataatcatctgattcccttttgttaaactatttgccctttggccttatagtttattcacttgggaactagattacagtttcccagactatatagctacagagaaattattgtgacttattataagtttaattcatgccaaacaataccagtctgatttctggcttaataccaccttctttcataaagctggaccatcattttgcctttaatcatcttcttgattagtatttttccaagtgtttctcaactcatttcttctatagaattaaaacattcctactggatgggctactcattttaaggatttaaaattttcagtctggatttggggttacacctttgatggatgagcttaaggaagatacgaaaatggcaaaattatcttcatgatgacatcataatggatagaacaaagtaaattttataaaatggtttcacatgccttattccatttgatacttaacagacttgagaactggacagagtagatatagtagttccctcttgtgcacagggaatatgttccaagaatcccagtggatgcctgaaatcctgtatagtcctaaaccctatacatactgttttttccctatatatacatatttatgataaaatttaattaatttattctttttgagatggagttccattcttgttgcccaggctggggtgcaatggtgtgatctcagctcactgcaacctctgcctctcgcgttcatgcaattgtcctgcctcagcctcccgagtagttgggattacaggcacctgccaccacgcctggctaatttttgtatttttagtagagatggggtttcaccatgttgaccaggctggtctcgaactcctgacctcaagtgatctgcccaccttgacctcccaaagagtgggattacaggcatgagccactgtgcttggccaaaatttaatttataaattaggcacagttagagatgaacaacaataactaataataaagtagatgccagcatcactacttttgtgctttggaatcattagtaagtaaaataagggttccttgaatataagcactgtgatactgcaacagtggatctgatcacagagctagctataatgtcactaacgggcaagcagcacagacatcacagatacatgggatgattcatacactgggaagggcagagcagggcagctcagatttcactgtgctgctcaaaatggcatgcattttaaaacttacaaattgcttatttctggaattttccatttaacatttttagatcgagttgaccacaggtaactaaaactttgaaacagcagataatggggaactactgtattactatgcccatctttataaagcagtggtttccaaactgtgttaatgcagaccaaattcatgacattgtttcaaccagtgcagctcctttcatattagttttttaaaaaaacacatctaagtaagatcaccatttgaaatgaatagagtgtatgttggcttttaaataaggaatgtttaaatgcccctgatagaggaagaaaccaaagctcagtacaaatggtaaactcacatctccacctgtaaacaccaggtaaaaattgaaggagcagggacaaccacccaagtctccagcctgtgagacagccaggtgaggaggggtccccagaagacctccaactggcctgtgcaccggggtggagcctcgggaatttcatcatgtttgcagcggggaggagcctggcccttccttttcctgtgtggaacctgggattcaagctgtgggcgggaagtgctctatcagggactcaagccttgggagactccctctttcccctttacttctttttcacccaataaaaccctgctcaccctctccatcggtctgtgaacctaaattttcgtggctgtgggacggacaagtaccctgtctttaactgaactatggaaaagtcctgcaatatttttggcgcccaacgtggggactcgagaaggggtaagtgagatgcaaaccaataattctttttccctctcccttctgagtcttctcatccccgtggccttttccttccttttttgggatggaccggcgagcagcagctgcccactgctcctcactccatgccggggctgggacacatggcctaagtgtcctgcacagcctgctggctggttccccgtcactcctggctgtcccagccttccccttccctggccaagggatgtaactctatcagacagtaattaagcttaaatttgtctccctggtggaggaaccacttgcaaagaaatatgaggttcttcctcaggcacttttaaactgtttcttttctttccccttctctaccccatcagcaagttaacttaaatttttttttcttttagaagatgttgtactaggctagcctccacccacccccaacaactgtcagtgtattctctgcaaagtttcggttgtgaaatcaagcctccatcttgttttatatcctgagggcatggctggtaattgtggcaaggatttgtttagcaaagccttgagaggatgaaccctgtaagattcaatgtctgcatgttttcctagccctttctcttaaagggccccacccagcaactgggttttcttctgcctgcctgtgtgtgtactgtacgtaatgtttgtcaagagaactctaattaatacagcctaaagaaagacaagtgcttgaatctaatattttttaaagggaagataaagtctggtacctttcagttcacatgactttaatctttaagaaatagaaacagtcttaaaaactattggtcaaatgcaggtattatcaaaatgtaaataggtaggctaaataatgcaggtcagatgcaaggtttgctaagtgttttgaggttacaaactgctttttgggttttcagaactatattgacttgccagcttcacaactggtaaggcctggggacacacggaactaaccgcacccttaactaagaaggcaaaccttggctgcagttagcacacaattaaagcaacttaacaagttttagtttacagttaaaaattgctaggagttaattgaatccactagaaatagatttacatgcaaggtgtatgagaacagtaaaatgtgtttttcagtaaaaggttataagaagtcatggaaatgtaaacttttgcctagggttaaggattgttttgagttacattaggaaaaagctgaaggttccaagaagtggtggaagaattgtggaaattaatcttgcagaagaggttctctgtgtgaacatactgactacattcaaccaagggtattatatggtttttctgtaaattgagcgttgaagtaaaagcataacgaggttttcctaaggtgctaatcttaatctgctctttggcaaaatttgtaaagggttataaaaggttttcgcttcttcaaaatttctgagtcatcattttgacaaaataaataacttttggtaatgttgacaaaaggagtcaaattctgtaaaatatttttacagacttattgtgagccacatatgagtgaccatggcccgtgacacagccctcagaaggtcctgagaacatgtgcccaaggtggtcagggtatagcttggtttgatatattttaggaaagcatgagacttcaaatatatttaagaaatgcattggtttggttcagaaaggcaggacaactcaaagcggagccttccaggctataggtaaatttaaacatttttctggatgacggttgagtttatctgaagacctgggatcaatagaaaggaaatgttcaggttaagataaaggattgtggagaccaaattttattgtgcagaggaagctctcagatagcagacttaagagagagcaggttataaaatgcttcttatcagacctaaaagggtgcctggctcttagttgattatctcctggatctggagagaaaggaatgaaaacaaagggggaaggggattctctataaaatgtggatttttcccacaagagacgttgcagggcaacttcaaggtatggcaaggaaatatattttgaggtaaaacattttgatttttttccttgttatgccacagtcagattggaaagtaagtcacgatatacagggttaaataaaacccatctgatgaaaatttatggtttgtaagccatgactccccaggctccttagataggaatttgggcaatattaaaaaaaaatcagagcttagtcctcagtaatctggaattccgtttcataacatcaagtgttttaaaccttgaacatttaacagccttcccaaagtcaaacttcagtttcaaaatcgtcttccctggtacatggcttttcaaatacttcagagggcccccgatgtgtccagaactaagagaggtaaacagaattatttgacatgtttaggtacatgggattgccaaaatgatgctcaatcttctttaggttatagctgggtgaataatgccaatatatgttccaaaattgtatgggatttctaaaattctaatgtctgagtatatgctatcaaccataattaaggtttttatgttaagttatagtaaaccacggagataactaaacttctttgtcagtcgtgtttctaattgtaactaccctggaaattttgctattcacagacaattgttgctttaattctttttcagaagatggtttataataagctataggactttgacaggtgctttcaaatacaggcttctgataactttggatattgtgacactgaaatacaggaaaatgtacaggactcaaaagctgaaatgctcatgattatcaagcaaaacaagagttagccaaatggactgaactcaggaagctgaagcaacctttttgacttttgcttggaatattgctaatccatgtttcatttttcagagtcaaggaaacttattttgaactatttacagcctttaacaattgagtaaggtatactcctatgaacaaagtttgaagcgtgtttgtttctctctgcctggttcctctagaatttggaaactatctgtgaatattgttatggcaatatagttgtttgcatcagtgccaataagaatccatttttcttttgcagcaggacacatttggagaaagtagttattttaccaaggttttgactggaatggtatgcttccctttaaggagtcaagctcaacttgcagagccaataaaagccccatggggaaactggcctcatactgttgtctatgcagtccctgtacagggttcctgacctgtggtcagtaaagaatgtcactttctagcaggtccaagagctccaagtttattgtgggaccttaagaggagaggatcacccaactcacaggtatttgaggatgcaaacccatggctaggctcagctttaaaaggtcttatctgtgattccttgtggaaaacatttccatcagtgccaatccaaaaagcctatgtagaaatagttattcttgctgcactttatgcaaataatcaggccaagtgtaagactaaagtctattttgcaaagcactcagtcctaccataatttttttaacaaaaatgaggactggagagacagaaattatgttccaaaatttgccatacatttgtcattaaatgctaaactcattagttgtttttaagttttcatctaccttttagaccaaccctgcttgctcctgtgaaccaagcagcaatctccagctgcagctcagaaagaacaggagggatgggtaatgtagaaatatggatcaatattctagctctgaacaattatcctgcaaaccctgccaggtgatggaataaatagggtgcccattaccaggaggtttcctttttgggaaagtaagaccaagtgaactaaccaaagccaagcatcacgtatccaaatcctggcaagcataactatagctaccagttatctgggtgtgtcacaagacatccttttctctctcttgttggaggagaactgggttccacagcttcactttagcatttgtcttatgataaggaggccatgcaatgccccatccgagatacatttttgtcccagactgaattccaagcttcacatcaaagccttaggaaggaaaatcggatcttagggatccagaggcaaatgacaacagaagttaaaaggcacagcacaggtgagcgtgactgattcctgctgattaagccaaccccaaacttcctgtttcatggataaaggccacgttaatatccatggcataaatgaggtctacggaactccaaggctactgacagcaggggagatagggcatacgtgggtaagagcggatgattcccacccctaggcccccctgcttcatgggtgcaagttgctttaacacccatggtggcacctaccaaggtcactggaacttggggatgcaaggatagaagatggaaagaggatgctcttccctctctacctcacatacctaaggtatctgctggaagaaaagggaaccaggtatgcctgctcccctctttctagatgggtagccattcatcttcagtctgtatccctttcaaatgcatcctgaacctctgggactcctttaaaaggcaccttctttttgcctttcttctcctctgttctctcttcactaataggtaattgtgtctccatactacaaggcactctcctcagatgcatcctccaaactagaaagagttggtttcccaaaccttaaactggttagcttaggattgggctcaggggaaggggacccagaagcccaacgtgccagcaaaagggtaaagttttttttgccagtcaggcttttggcctccctctacgtgtgcaaactggcaaaaggcctcaggatctttgagctgtccttaccctcccttcatttcgttttgatacatagtttctaataacctggtttgtctgttcttgccttcaggccattaaactctaaacaatcatgcaagcagagcctctgacaatggccctttctgctgtgaacccttagatgggcctctgccgtttccccaaaacagcgccccctctcagcaggaagcagttaaggtcagtcttcatccttatccttaatctaaacggcagctggatgtacctctttagagggaggaatgagacagctaggtgggagggggtccccgaaaaacctccagtcagcctgtgcactagagtagagcctcagaaagttcaccatgtttgcactggggaggagcctggtccctccttttcctgtgtggaacctggaattcaagctgtgggcaggaagtgctctatcagggactctagccttgcagaggctcccggttccccctttgtcttctttttcacccaataaaaccttgctcaccctctccaacagtctgcgagcctaaattttcttggccatgggacagacaaggaccctctctttagctgaactaaggaaaagtcctgcaacacctccaacaactaacaattgtttccagtgcacctccattctccaggagggagaaggccaaagcacataagtggagaatgcacacgttagcccattttcaatagtttaatactttaaaaaatagtagtgttgctgactttcaagctttagcatctacacgtgctagattcacttattgactcattaaactattcttttaccaatgagcttaccatatgccaaaaactatgctatactgggaacccaaaggcacacagaaaaactagaagactatttctgcaccagtcaagaagcacacaaatggacactcatgaagaaactatagacccaaagaaaaccattgacaatataggacaaatggcatatcaagtcctgaggaaagagattagtaaggaggttaatattttaaaaaaaatagaaaagggagaaataatgaatcactggaaatggtcccatcaacctgcagttcttcactatttttcaacttaaaattggatacatttatagtcacttgacctctctaggtcccaatctccccatgttcaaagtacatatcctattgctagctctctctactttgctaagtctattgtgaaaatatcacaatataaaatactttgaagccttttagggaagcttaaggtcttctacaaataaaataacaagaagtaccacttggctgaaaaatgaaagaggtaggacaccaatggtagtaaatcacttgtatcactttgttcagaaattatttcatttttttcattttattgaatatagacaaattatagttgtatatctttatgaagtacaaagtgatactatgatatatgtatacagtctggaatgattaaatcaagctaattaacatagccatcacctcaaatacctaccatcgattctcctaactgaatcattgtaccctttgaccaatatctccccatttcccctactcccagcctctgggaaccaccattctactctctgcttctatgagtttgattgttttagattccacttgtaagtgagaacatatggtatttgtttttctttgctagcttagctgacttagcataatgtctgcttggtccacccatgtggtcaaaaatggcaaaatttcctcatttttaaggctgaagaatatttcattgtgtgtgtgtgtgtgtgtatatatatatatatatcacattttctttatccatttcatctcacacctattaaaatggcaataataaaaagatgaaagacaagtcttggcaaggatatggagaaaggggaacccttgttcactactgatgggaatgtaaatttgtacagagctggttcaagggaaatccaagaacatggctgtgaggcaaggaccagatgagggtattaagggactatcattacagtggaaaaattaaccctatcttttttgagagaagccagttacaatgcttgatgctatccctgacacactctctctagcaacaagttccttttctttcggcccttaagtaaggctataagaagaacagaacaaaacagcaaggagatgaataccaaagcactggccacacttttcccctgtgggcctgtcttattccattcatgctgctataaaaaataccacaaactgtgtattttataaataatagaaatttaattctcacagctctggaggctgggaagtccaaggtcaaggtgccagtagattaagtgtctggtgaagtcttgctctctgcttccaagacagtacattgtttctgtatcctcacgtggacgaaggcagaagggtaaacaggcataaagggcctagctagttcccccaagcccttttaaaagggcaccaatcccattcatgacggctctgtcctcatgacctaatcacctcaaaggctccacctcctaatattatcacactgggttgttttttgttgttgttgttttgacaaggtctccccctgttgcccaggctgatgtgtagtggcacaatgtcagctcactgcagcctcaacttccccagactcaagtgattttcctgtctcagcctcctaagtagctggaactacaggagtgcgccaccagctaatttttgcatttttttttttgtagaaacagtttcgccatgttgcccaggctctcactgggtcttatgttccaacatacgaatttgtctgggggatgggtgacacatacattcaaaccatagcagggccttcaataggtcattagagagagagccaaggaacaccagtgtggctttttgcattgaacaacgataagttaatggaagtttaacatagcccacagtctgtagtcagaggtcagaggagtaaggccttacatgctacagatgcccacaaaggagataagaggaagccagaagaaatagaaatttgtttgtcagtggataaagaacaaggccaaggttttcttaaatagtgattgatgaggccctggtttactgtaacagtgtacttgtgattttttaattttgtaaaaattgtcccagtgtgtaattctctgtttatacctgagtgtggggaaatgaattttaaggaaaaagccctatatttcctgataaatcacttctataactaattggttatttaatgattcatctgtgtaaaaagggggactaatggttttaaaataaaatttcatcaacagttgtctctttcataaggtttgaaaacaaagaaaatggagatgatgatgcaggtgtggctctttaacagaacccacaggggagcacacaggctctggggagagcaaacaaggcaagggctcagaagactaggttctaatcccaatgcccctttctcccggatatttaatcatagtcaaattacttaatgaccccaaagtacagtgatttccttaatattttacaaaagaataaaagcactatggacttttcttcaaacagacatatcacccctggcctcaggagtttaatattcagtgactctttggcaggtcgtgaactgcccatcagtcccagtggttgttatgaatgtcctctgctcatccatccagatcccctccccatctttcttcatcctgactcttcctgggagggtgatcaatatagacctgccaataggctcctgcaccctctagcttctaattgcattctgtccacgggaagccctggtgagagttacatcattccaggattgggagcaacctgtaagaggccccggacagctgtgtccatcctctgaaaatgaaggctgttctcaggtgacctgctctacccagatctttttccttccaggttctttttttttttttttgagatggagtctcactctgtcacccaggctggggtgcagtggcacaatctcagctgactgcagcctctgcctcccaagctcaagtgatcccctgcctcagcctgctgagtagctgggactacaggcgtgccccaccacactcagctaatttttgtccttttagtagagatggggttttgccatgttggccaggctgatcttgaatgcctggcctcaaatgatctgtctgcttcggcctcccaaaattctgggattacaggcatgagccacagtacttggcctccttccaggctctgataaatgtttcttcccctcatctcttaaagcctaggggaggttatggactgaatgtttgtgtccctcacaaaatttatatgttgaaatctaatcccaatgtgatggcatgaggaagtagggcctttgagaggtgattaggacatgagggtggaacccttgtgaatgggattagtgcccttataaggggctgaaaagaccagaattctaccccttcaccatgtgaggacacagcaagaaggcatcctctattaaccagaaaatgggcactcattagacaccggatctggacttcacagcctccagcattgtgagacagacatttctgttgtttatgagccacctggtttaaggtgtcttgttttagcagcccaaatggacaaacacagggaggtaagagcccctaccagcccctgtccaccagaaagatggggatctgaacagaagccagaggtgtaactggaatggactcaggtgttttcctcacagagcagataactaaagctagaattcttgataagaaaaatgggataaagaaataacagttgcaaaggtaagaagcagagacagagttatagtccagaggccaaaaggataattttaagaagaaggagtaggtctgaaagtgatgactgagactagcccttggctgtggtgattaagatctttggtgacaatagaaaatgtaacaataggagtggtctgttgtggtgatagaatctgcagaccggtggaagtccatgggcccatttaccatgccacaggcaaagagtatattaaactcccacgaagagaagtgcctctggattcattttgccaacattcactgtactgatattagccatggacttgcagagggtttatttactattgcagcctggctctctgctgtgtctgaaagttgaccttggtgtcctctaagttttatcccagagaaaaagacagcaattgagctattccccaggcacagggggcaaaatttgaaattgacataaaaccaagattccctgtctgacttgggcctctgggattgtattgctgcatcctgtggtggcaaaaagagtatcctgggcagtaagtgatttcaattccacttaaagcaacaagtatttgctgaaaaccaaccatattcttagtaagaagatgggtgctgtaggagacagagaattaaatgaaatcattccttccctccaggagcaaacagcttcatgctagaaataaagctaactcaaatgcaacaaacagaagacacacacacacacacacacacacacacacacacacacagagagagtacttttcaagattagtaacaaagagattatctacagagataaagacagaagaatccaatgtctgcatgttttgttattcatgtgtataagttttctaactttcctacattcagtgtgaattagtattgaaatcagaataaaaaagcaatatttttttaaaagcctaatttttagaaattgatagtaaaaaatgagacagccctgggctgaagtcccaggcgtccttcttcctaacaacttgaacttagccaagttgcttaactacttggtgcctaaatgttctcatttataaaactgggaagatggcatggagaggcaatgggcattttctggcaagaaactaagaaaaaaggccataaccaataagtaacttatggaaatgaaaaaatcttttaagttttataatcttgctttagttgatatcttaaaacaaaattttgaaagttattaagtcactcataaggatttcaggaagcactgcagtgtaatatgcttaagaatggagatggttcaaatgctagctcggctacttagcaatacctgtcctcaaataagttatttcaccctacctgagtctgttacttcatctctaaaatggagataatcctaaaacgtacctcacaggaaccttgtgaagataatgcatgtaaaatgctatcacagtccttggcatggaataagtgtctaattaacttttatatataattataattatcatctaaaaagtttagtggtgtttcagacaaatctaagagaagataagcatgaataggtatatgtctttttcatctttgtatttcaccagtgctttgcacagggcctgtcacaaagtagggatctgagaaatacttgtgaatgaagaatgaatgaatgaatgggctgattttcctatttgatcaaaagccacatccatatatgactaaatctgagtatataaaagaagataaaacttgtgtttcaattcaatctagtgagttaaattaaaagaagaaagggaggaaggcaaattaaaagaagaaagggaggaaaagaagcaggaaagagggaaataagacaaaaagaaaaaaaaaaaaacaaaacagaagttggccaggagaaagggtgtctccatccttaaatattttactccttattgtgtgatatattattttgtcagcttcttctagctacaattcccaaggaagggatagagagcagcagcttccaagtaatgacccatgtgggtataaagagaaatttttatcatattagaaaaaatatatttatatacatgctaccaactttacctagaagagaagagcaagggattggaaaacaaattagcataaaatccctgctccagctttttacacatacagatgttttcctgcatatttatccatccttctgagcactgctcaaatgttacatcctcagagaagctctcctggacccctcatcctgggctggatactctgtcacatgctctaatagtgtctgatacccttccactagaacagggatcactgttgtaattaggtaattatttgggtaattaattgtttaacatctgtgtccagtgtcagtatgcaagcaagctccatgaaggcagtgttcctgtctgcctgttcaccccaaaatcaccaacacttgcatatgccttgcatgaaacaggtaagtgaacataaatgtgtataaggttggcatccattctttgtgcattctgtgtttgtgaatttgcccactcaataaaatgcatttgtaacctcaacatcgatacttgccacatttctgtggtcatttttgggcatcacagagaagtgaaaaatttgtcacccaacatgtacattccccaagtgaagcagaacaaagcaaagctccaccttcttgctccatctctcatactgtaaacaagggtctttttctgatctattaaatgccaggttgttggggtgggttttcttttgcatttttgtacataatggccccaaaagaacagtgctgaagtgctgtctcttgttcctgagtacaagaagaatatgatgtgccttacagaggaaacatgagtgatagaagcttcattcaggctcaggttaaacagctcaggctgtgtcccatgacttcagtgttaatgaattagctatatgttaaataaggcatctttaaataaaagtaaacatttaaaaagtttacatattaatcaattaacaaaaatgttgtgaagaaacagccagtagcacgtgcctgtagttctggtttctcgggaagctaaggtgggaggattacttgagcccaggagttcgaactgcagtgcactatgattgcaccactgcactccagcctgggcaacagagtgagaccctatctcttaaaaacaaaaaaaatattgtaatcagaggctctcaggaactcaaccctggatttcccctaggggcaatggttcattatttgctaattcagcgtttgtggagactttatacaacaatttcctatgaaaaatcaggatcaactatatatatacatagaatgtatatgtgtatatatattttacatatttgtgtgtatacatgcacatgtgtatatatgtatgtttagtagtttttaaccattttggtgttatacacctgttgtaaaaatttaaggaagacgtggatactaggggctgagggttgccacaaagggaggtatgtacatatatacagccctgtgctatgcatctccagggcaggagacagggtgttgacattcacagtatagcctaagtgaatattcctactccatagaattgttcagtgtggtgacacttcatgcaaataaatacatgtatacacatacacatttgcataagattctgggcatttgtggcctcctatcgtgtacctcaggtaaaaatcctgacagagaaataatagatacacaaatataaatatatattatatatggcacattcaattttacttcaaatgttttacataggctaaaattgaaactaaaatgctttgcatttcagccaccaccaacagggactagacaattccaaaatatatgtatccccagaagaaagataatttgttgtgaaacactggctaaagacattccctaaggtaaactaaacacaggcagaaaactgagagttgaaaaaaaatatatacatatatagagagagagatgagagttgaatatctatatgtatatatagatatgtatatatagagagagatgtgtgtgtgtgtgtatatatatatatatatatagagagagagagagagagagagagacagaggagagagagagcacaacaagaatacgaaggttggccaggtgctgtggctcaagcctgaatcccagcattttgggaggccaaggcgggtagatcacgaggtcaagagatcgataccatcctgggcaacatgatgaaaccctatctctactgaaaatacaaaaaattagctgcgcatggtggtgcacacctgtactcccagctactcaggaggctgaggcaggaggatcacttgaacccaggagacagaggttgcagtgagccaagattgtgccactgcactccagcctggcgacagagtgagactccatctcaaacaaacaaacaaacaaaataccaaggttaacctgccccgtttgctttcctaagagtctaagattctctggattctcaggtctgtatggtgggcagcaatgtaaatttaagcttctctgacatctaagttctttggagacagtaactattaaacacctgactctgtcccttgaataacagacatttcttagtaaagcttttaattagatctgttggttgaggatgaaaatagaaagacaccagaaggaaaaaaaaaattcatccctgtaaatggtcctgtggaaatagtaactaaaacaattatactgttaataattcaatgttggtttaaaactatacaattgtgagttatttatacagaccagagttggcatgtgttgtaccacaggtggatgtgaggtcaccaagaaaccacttcacagttttcccagaagtgtagcgtcaaaaaggtcacttgtggtaaaagatcttttggattagtcttttaaatcaatgcatgaattaaagacaatttacatataaataggctaatactctggctttgaaattaaatggatttttaaaagatttaagtaactgcagaaaaggtcagttaggcagtaagtgtacataatgtgattcttgaaaactgctgtcttgttggtttattaatattttgtattcattgtcagtgttgttctaaaattgtgtgcataattagcaatgcaccaaagtcaacggcaggtcccaaaagtaaggaaagcggaatttacaaatcagtgaaggaaggacaagtctagatttggacatgaaaatagtcaaaattaacctttgcctatatattaatacacattagattcaaatatgtcacaacatattctaaataagcatggcatcactcgctccagttaaatttaccttggcatttagcctcactgataaattttcaactcttccaaaatacaaaagctgcagtagtctcctgagttatcacaacaggatcatgattgtaatttgaaatcctgattccccttttagggaacagaaacctgcagtttttccaactgtaatgaaaggatagagcgaaacttccataggatcaaaccacattccattaccaccactcctctgaacattaatgtaccttaaaacatattgaaccataggatgaatatatggagcaggggcatttttaggagagtgaaactattctgtatgatactacgagagatacatgatgttacatacttgtccaaacacacaggactatgacaaaagattgagtcctaatgtaaacgagggatgacttcagttaacaatagtgtagcaatattggttaatcaattataacaaatgtgtcaatccaatgcaagatgttaaccataatgaatactgtgggcaaagggaggggatttgtgggaaacctctgtactgtactttctgctcagtttttcagtaaaactaaatttgctgtagaaaatcgtctgttttttaaaatagtgaaccaaatgtaataatgcactcaaagactctttttagacaaatggtttataaactatattcagaggagccctagtggtcctttgctggccatttggtttaggagtgtttgggaaaatagagtaggagagaagagggaacaatgaagaaaagactgctcaagctggccccttatctttcacccctgtttcaaacaaagcaacaaccttttcacctgtacatattgtttctccacattggagcccagtaaagaagggtttctcagctaaagagaaaaaaaaaacatgaaaatcaccaatgtatgctcaataaagtatcttgctacataaatcagcaactcaaagaagaaaaagttaaattataaaaaccttgctaataatgtacactaattccctcagctacttaataaacatttaactaaaactttctgcctgaccattattacttcctatgattgggctaagcataagctaaatgactaccttggaagaactccaactaagaagtatttatttcacatcaacaatgaaccagtactctgttagaacatgcaacatgctttggaaagacaggtgaaatacaaagcatcattccagctgtccagaagcttatcatcttacaggacagagaacatgaacacaacaaaatgcagaaacaatataatacacctgaggcacccagcacccaacttgatgagctaaaaaatagatttcaggtcttctgtcaggtgttaacaaattgtcaactctgaataatgtgagggccagtatgaatgagaacagtccaatccccagttaagccccacttttctaaatcttcttctctctttaaaaaagcaaagtgaatgctaacgtagtctatcagtaatggacagtgtcctcataaaaagacatatgtaaaaaggaggggaagtggaaggtaagcagtgcttactattttatcatattcaattgtatacacacctcctctcaaaattggtgtccccctatcagtagttactaacaagttagttcccaggatcttgcagatggtgggctggtttcagacaaaggcacagtggtccagaggatctggcaacctctttcaggggctgttgggagatgccctgacggcagcagaagcagcctccaatgaggatggcttcctgctcaagacctcctcacactcctcttgcataaataaatgatttagacaccgttttctcctctaatagccagcactacaccaaagagaaaacactccgctattgatgacaggagagggctttttttgtaagtgtgtatgtgtgttatgctataaattaccctgttggtgggtgtaaaaataaatatccatgtatatagttgtgtatacacacacacacacacttacacagagagaatatgttacagttaaaatcatgctgtcgacagccactcaaatctagagcaatttatggctctcaatgcagtcacacattcaggataaagacaggatgataataaatactttgaatattaccagcataaataaactgcctgaggagcttaaacatttgcaacatagccttgctggctcacactgacaaccagcagacctgttgccagtgagcgactgaaagatcaaacatgattaaaaatgcaaagatgctgcacccaaatgacatgctttatttgacaatgaactctggactcagaggcaccactgcaatctatgagcaaagtgctttttggtaattcatttgcccactgaggccagctactgaggaatcacaatacaagtcccttttaaagtaggcacagttctttacagccattagtaattccatcttgagactgcccttcgagaaaacaatttctttttttttttttttactgagaattgatggtttgtgttttgtcaaaatgagccccagaagttgttaagaacttgtgtaatacattagctatgagtagccgaataatggtcttcaagtaagtacaggaaaatgaatggctgtgatgaagatggtgggcaggtatccttttactgaaactactaaagcaggggctgaagtcaggttttaaaaaagattcttgtgaccataagacacaggaatgtccagtggaagaaagccagttctagcttggagttttaggaacaagccagtttccttggtgtctcagtatcatttgattctatagtatgttatttcttttatttacatacatatgacattcatgatttctttttaaatatccataaattcaaagtggaatacaatgtcacaatgtcttaagtctcagaataagatgctgagaagaccatgaacaagtgatttctttttctttttctttttttttttgagacagagtgttgctctgtcgcccaggctggagtgcagtgggcaagatctcagctcactacaatctccaacccctgggttcaagcaattctcctacctcagccaccctagtggttgggattacaggtgcctgctaccacgcccagctaatttttctatttttagtacagacagcattttgccatgctggccaggctggtctagaactcctgacctcaggtgatctgcctgcctcagcctcccaaagtgctgggattataggcatgagccatagcgcccagacaaacaagcgggggtttcttaaggaagggcttccaagaaaaactgcttacagcgtggcaagaagtagaacagggaaaggcaagaagccaagcgagggtgtgattcagggtagaatcctctgagggacgttttcccaccagaggcaaggaaactgggctttcactctcactcaccaatcactctgcagctaagagccatcctgggggttcctaaactccaagcacttccagctctcagcagacctagtgaagccagcagctccaattggtcctgcaaagaccattgccgaagcagccattggaaggtaaatacacagaagctggggcagggctcacagatatgttgaaaggtaccagggcagtgctccgacaccttctgctacagcaaagaagcaaatggtccaaaaatcaaaatgagggtagaataaggttggagaattcaaaaagtgcagaaaaaaaataaaagtcccccttctctcacccccaccttccactcacccttcacctagtccttctttccaaaggtaacctttgtttacagttttctataaatccttctaaggaaaaatatacacatatactatgtatctatttaaacattctttttaaaaatatgcagattggacaactgttccactgttctactccttgctttttctcactaaagaatatatcttgtattctagatattatattagatctatatacatattctaaatagagagatgatagattagacagataaatgcaaagaggaaggaagggaaggaaaaatggatggatggatggatggatggatggatggatggatggatggatactacacttcattgatttaaagataaaacagttttccacattttaacatttctgaaataggctgtcttatacttgacagcattttagatttgctaaaatgcagtagatagatatatagctatttatggatggattgacagttcacacatagctctgccacttgagaagtagtgcaggatagtagttaagagtatattaacacattgcttattaatgagatactttcgtacttgaggaataaggacctcttttgatggggctaatattttaataatctgataaattgtttattaactttaaattttcataatgagtccgtaaatgagtttgatttatagttttctattctgtgctgtctctctcagactttggaatccatattacattggcttcataaaaacacactggcagtttttttctttatttgtgctatgggcaattttgtttacttttataattctttgactatgtaatacatgtactgtgtatcaaattcaaaaagtacaaaagggcatgagtaaaaaagtatctctacctgtcttccagctgcctagtcccttcccccagatgcaatcattgtaatccgttgcttttgcgttcctttagttatgtatgacacatacacatatgcacaaggacacacacttttactcaaatgtcggtataatagacacaatgctctgcatcttgcttttttttcacttcatgtgttttgtagattgttccataactatacacagaacctccacatcctatctgatgacttcacagtattccattatgcagatataaaattaattttaccagttttcatttttaaatagaattaacattatcagttccttgaaatgcaaaattatttgcttctgaaagcataaagacctgtggctttttaagatctttgataactgcttcagatttttccgatgttattaaagttctctttcctgttgaatatgtttgggtaacttatttacctgtttaaaaaatacattccttgaagattttcagttacttttgcaaaagttctcctttgaatattttaatttctttagccatggttctttttcctttttcctttgttttttgtttttttttttttaagacagggtcttactctgtcctctgtctgtcacccaggctggagtgcagtggcacgatcagggctcactgcagcctaaacttcctgggctcaagtgatcctcccaccttagcctcttgagtagttgggactactggcatgcgccactacccctgtctaatttttgtattttttgtagagatggggtttcaccatgttacccagcctggtcttgaactcctgggctcaagccatccagctgcctcggcctcccaaagtgttaagattataggcttgagccactgggactgtctgctttccattttttgtttttgtactccctaactttttgagtaagtgaatttcattgcttggcattgttttcaaggtgtgttagtctgttttcatgctgctgatgaagacatacccaagactgggaagaaaaagaggtttaattagacttacagttccacatgacaggggaggcctcagaatcatggcgggaggtgaaaggcacttcttacatggtggcagcaagagaaaatgagtaggaagcaaaagcagaaacccctgataaacccatcagatcacgtaagacttattcactatcatgagaatagcatgggaaagaccagcccccatgattcaattacctccccctaggtacctcccacaacacgtgggaattcggggagatacaactcaagctgagattttaatggggacacagcgaaaccatatcacaaggagacagtatttgagcttatttatgattcttatggatttatttttaaattagaaaacctaatttcttatttttatctttattatttagttctttctgcattttttccagttttttggctgtccctttcttaagtcagatgcataattcctttatttttattcttttttaaatattcaggtgttaaaggctgtatacattttcttctaagcgaggctttagctgtagcccatagctcagatgtgttatattttcattatcaatggtgtctagatatttttcaagttgggtttaaaatgtttctttgaattaagagttgtttatcaaagagggttgttgtttgtttgtttgttttgagatggagtcttggtctgtcccccaggctggagtgcagtggcacaatcttggctcactgcaacctctgcttcctgggtcaagcaattcccctgcctcagcctccttcatagctgagattacaggtgtgtgccaccacactcaactaatgtttgtatttttagtagaaacaacgtttcaccatgttggccaggctggtctcgaactcctgacctctggtgatctgctcacctcggcctcccagagtatcaaagagttttaaaatatccagattgtaaggttttgataaaactgatttctaatttattgcattgtaatcaggtaatggggactttatttgtacttcagcttcttgaaatttcctgcaatttcttcataacttataaaggccatgtgtttgtattacattgttttattatttgatatattttgaaccacatattttagaggggctttcctatcacaaacatatttcaaagttgtttgcaaaatattttgcattttctaatcaccataagtgaagtgattagaaaacacatcagggcttctgtggctcaggatttggtgcttgcctcacatagacacaaccagtaactcttactcttgtgccaaatgatgtaattgccctaggaaaatgtttctacacctctcttgcccactttcattgaagaaatggtgactgaatctgaatgtcaggaagggttgtgggttgtggatatggcaactgcaaaactgcagacaatagagatgtacactgcttttgtggtagggacaggatttgagcagtggaaaggcataaataagaaaaagagaaattaattcatgattaagacagattctggcataaagaaattgcagtagtagtagtagtagtagtagtagtagttagtgctgaataccgtatctattttctttcatcagaatctgctggttccatttcatagttcagaggtctcacaaattcaggcaatattcacagctgtggacatagtaacttaggcatattttgcattattaaacgattgatgctatctttaaatttaggttgcaacataacatacatgaaatctgataccaagtcttcacattggcaactagatgggcattgaacacaaaactagaaattgttttatttttataaaatatttaataagatttaattaaagtgtcataaaaatccagctacattgaaatgtttgatttaaatgttttttattagctaacccattcttcattttgctttttaaattctaatgtataattttgaatattgtgcaagaaatatgactttcttaaaaacattaaaaattaattttaattttttcaatgtataattaatttatatgcttgaggaaaatatattcaaattgtatacattttaaatacaaatgcagtttaatttctaattctttagatcagggatcagcaaactttttctgtaaagaaccagacagtaaacattttgggctgttacaacgactcttctctgtcactgccctagcacaaaaggaatcacagacaatgcataagtgaatgggagtggctagagttggccctggggccttagtttgcagatccctgtattagatcataactgccaatagacaaaaagtatcttaaaaaaaaaccccttgattataacaacatgacaattttactgaaatgaagatgagaaaaaataacttaattggaataaatatataataatttaagaaatatttcagtcttttaaaaaactcactaaaatgtcatcagcccaataacagaacatgtacaataataatcaagagctgttgtctttgatatttggtcaattttcaatcacgtaaaaactagggcttcacctatacatttagattttgtccttaaaaaagttatctcatggcagaggataaaaaacacttctttaatggcttactagctggatttgttaatttttaaatatttagacagatggtatatggcctcctttttgccctgggccccataaaccttagatgtaggcctgaatacaacagtgatcaagagacaaaggccctactgtcttgaattacagtctagtaaattctagtgcacatccattgactctaatttagaccagtcaatcatctattctcacatgcactactgcaatagctttttttttttttttttttgagactgagtcttgttctgttgcccaggctggagtgcagtggcatgttcttggctcactgcaacctcctcctcccaggttcaagtgattcttgtgcatcagcctctcaagtagctgggatcacaggtgtgcaccaccacgccctgctagtttttgtatttttagtatagatgggatttcacccggcctcccaaaatgttgggattacaggtgtactgtacccactgtacccagcctgcaataggttttttattgctctctctatatctattcttgccctcaccaacctattttccacataacaaattaatatgttaaaaacataaactatcacctctttcctaaaagctcttcaattgttttccattacattccagattaaatccaaagtcttttatgattagtattattatttttgagacagagtttcgctcttgttgcccaggctagagtgcaatggcgcaatctcggctcactgcaacctctacctcccaggttcaagcgattctcctgcctcagcctcccacgtagctgggatcacaggcatgtgccaccgtgcccagctaattttgtatttttagtagagacagggtttctccatgttggtcaggctggtctccaactctcgccctcaggtgatccacctgcctcagcctcccaaagtgctgggattacaggcatgagccactgcgcctggcccaaagtctttttttataacatatgaaatcttgttcttccctatcttccaactttatcttgtgcacttccttccttgcccagtattatctggccttttattgtacttctaacatattgaggcatttcttgcctcgggacctttgcacatgcaatcatctggctacagtgtttctcctttccctactcctttttcggggctacttttttcatttttacatctctgcttaaacattttcacctccaagaagacttgtaagtccattcagtctaacatatatgattcttgctatattctgtcactgcatcctgttcaatttccttcacagccataggaagaaaacctgtaattctatatatttatctgtttacttgtatatttcctattctgtaaactctttgagagccaggataatttttattttgtttatcacttccagtgcccacaatgcctggaaatcatacatactcaaaagatagttgttaaaaaagtaaatgaatatcaattcatttgttgaacaaataaatatgaaatggataggcacattctggacctatcgaaccattctagcatgaagcctttattcccagagtgatagcaatatcagggtccccccaactaatgattttcaagcccactcagatcctttattcatgctgtatttccaagctgaatttccttcccccacttctctctgccttctcaaatatttatttctttcactaattcaaacacacttctctcaacaagtctttggtacccttttcagccccaaataataggtcttgatttctacatttattatctgaatcattcactttagtatcatcttacggtgcctaattctttctaaatctaagttccttccatagtgtatgtagtagagaccatgtgcacttaatccagccagcagcatggagtggaaccccaaaacatattgatatcattggcagccttagcctgtgttccccatctgactcttacatcccactcaggaaagcagaccctaaacaaaggcttacaactaggtagtttattttgggaaaagaaccctagataatcaaattgaggaacgagggagagtaaaacaggggaaaagggtatcttaaatcagattccctagaagtacactctgaaatgggtacgcttgtacaagaaattgattgaaatagtgccctcaggagaaacctatggggaaatgagggagtaggatgggccagggaagaagccacggaaagatatggcttcagctggagtccagccatggcccaaacccagagtatggacaagagtatggagtatgaacagcaccacagagttattccccttgacagcttctgttagtccttggctgtggactgcccttgaccaggcataggggatcctctaaggtatttctggggaagttcatttccctcaatagagggttaattctcctgagatgagttcagctgtgagaccttagtatccaacactctaagcagctggggcatgggtgtgttgacccactaatggtggtcttggtaggggaccaacagcatcctctacagagggaaatacaatataagtatacattctcaagtcgataacaactacaggcacctagggctcaacctgctggaatcttccgagaaaacttacatgcttcagatgtatatgtataatgtgcttcagacatgtctaaacaaggcatggaagagattatttatccaccaactcccagtccccaccagtcaggggttattccgtgggttaataactctcttatacttccaggttgccagtctcactcccaaggtggtagaaaatagggatgaaaatagggatgcccaatgccacttaggcaagaggcttcaggtcacacttgccctaacctggtttccacagcgacagccctaatacagaaagggagacaagaggatgtgagatgtgtcacaggaagtgtccaatccactaactacttgccctagatctttggagaattaaataacctgtcctactgctatgcatgacagaagccctaccagtgggggctagttggccttcacattggctcctggccttctcattggctcatcttaggtgtcttgggctatctgcctgatacacattttcagttaggcacgtcatgtgaccttacagaccaaggttatgcaaaagagaaatgaaaattaacttattaatcttatgacagtattgggctctctgtatttttctcagggtccctgacactgatggtattatctcattctttggtgatgattatgtgtggaatgtttcatttaaaaattccagtgttgtctctcatgaaagcctgatacggtaggctctatatacatactggtgatgatcgtaatatgtgtgtagcacaaagtagtccctgaacaacatttttaatggcaaacagtgattccttcccccaacaaattaagtaaaaatgataaattcctacattgaaagaaatcggcaaaacagaacatttccttcaattcacataatcattaagaagtatcattcataaggggttagaaacatataatatccaaccttcctgtttaacagagcccagcaaggactcaaatgcacagttcattactgtcattatgagagaatttctgccaacaagttacagtcaggttactatcattcaatcatgttgctaataggactaatttcatggtaattggcatattctagaccagagaagaactcaaatggttgtggaatcattaatgatttatgctttcatggtaaaaatgacaatctattagtttaccagatgctggatcaagccatgggccattaacaggagggtgttctcagaacgttttcagaacaaataccagctactttattttcagcttgcagacataatcacatgcatcccctatcagatccaccactatactgtcagatacatcataaattaaaggctccatgggctcattattggctcttattcgtaaaagcaacacgttgccctggcaagacccaaaatattaaatgggcatttaaagaaactgcaaaatgtgtagttttggaaaaatgaaatcttccttaaaactatttacagtactcaagttttcaaaatgtccttcatcctcgattttgcctcaatatttgtttttttgttttttgttttttaataaaagcaaagaaaaaagaaacaaattcctgccctgtcaggaaagcttttaggccgagtctcttaggaactgggtgtcatttattagtaaacctaatatgctgccttcagaagaacagaggtgccagcatcaaataaacaggcttaaaaaaaaaaattccaggaaacttaatgtacactacgttagtaaccaggacaactcttgtttcccagcaatctatggcatagatacgttggtatgagataaagcctccatctttcctgaatcttcaaaacaaatgtaaagctgattaaaattcctcttctgtcttgcctatgtacaaggctgctctcccaataccaagcaatcctatttggagacaatgggatgtttgccaaaccaaaccgaaataaataaataaataaataaataggagagtttctgttttcaactgttgatggcatcacccttgccatttgtggtgatcagattatccacctagaaagtgtaagaaaacaagtcttccggttagcacttactgggcaaagggctgagtttcaagaatcacaactgaaatcggtggggttgctctttgttaatgggaaaaagcaccatgttaaagtgaccagggcctggtgtgtgcaccgcatgatctgtgagcatgagttgtgtgtgcaacatgcttcctcgtgattaccgcctatacggacagtcactgtgcattagtgcattggtagccagccgccgccaaaaacaggatggcattcttccatcgtgattagaggttttgtgagcattttgggatgggggacactttctcagtaaagactcttccgccccattcacgttcattcagctctttctaggggaaattaaaagctgcagtgataatcccttaaggacaacttggaagagtataaaaggtgcagtgtataagcaattggatgagaaagccttttatgtggaaagttactgaatgggtggctgagggtggtgtgagtggggagaaagaggggcagcttttcttttctaaggtggggagcagcggggatatcatggcacttcagttccctttaatcatccagattcctacgctgtccctgcccctggtgtcaccttgttttgcagtgccagctagctcctccctgccattttcccctcaaagagggagaggggagcaatgcgatttttggtaaggacccagtttctcgctgaatgccaactcagccagctggcaccgaacaggccaagccttcttcagaagaggttagcaaaatccaaattagcatggtccattttaaaaacttgcttttatttaaagactgattcatgacaaacagtggctcccgtactgaggtctggcaccccaggggctggcatccaaccaaacacatgcaactaattgccaccctcggatgacacgcaactaacaagctccattttgaggcagtagattcactaagaatgtaaccccggaaggcagcggaggcagaaaagctcctttcataaccctgtcctaggctaaccatggcagcagagagcctgaaaaacacttttgtttcattgcaccaacaatttagctccacggagggctacaaacacggctaacttgctgaaaagtgatcaagggcactgcgatccccctcatggttataggaggcaggggctctgcttttctctttgctcaaggaaacacacaaaattgcctactatcttgaaactccgcatcttgcaccatttgcaaatctatcgacccccagtacttccccttatactttagttcagatgctctcaggcttcctttgtacaagcaagggctctggagccaggatgcctaggttcaaatcccagctccaccattcattagtaattggcaagtattttaacccatctatgcctcagtttcttcatctataaagtggagagaatattagcacctacattactacgagtaggaacgagtcaatgtaataatgtacataggacaatgcctgacatatcatcactctgttatgaaagctctttgagtctgagatagctcggccttatgaagaaaaaatttccctttgcataagctgcattttagtcaaagttcttgcttccctgtaaacttctagagattcaacctctaagcctttgtttaccattctttctcctctcaactgtccttcctccattgcacagccctgtatgactaaatctcatcatcctccaaaaccattcttcaatgccacctcctccgaggagacttctctgccatcccagctgccatgaatccctgcactcttggcatggccatggcaatttctgcaaacaaatgactgtgttttacttgcctgttatatttccttttctagactgacagatccttttgagcataatccacgagtaactagcacatagtagatactcaatgaatatttggtaaagaagtagatggtcagatgaaagaattgctctgcataaatgagtagctttatactatggttatgctgggcattactcaataggcaggatgggggaatcgtttcttaaggactttcatagttgctttggcccaaattaagagttgtatttaacttgtcatcaactgaggctcataaataaaatctatcaaagaaatatgtcaattaccaccttagtcagcttgggctgccataacaaaacaccaaggattgtgtggcttaaacaacagaaatttatttctcacagttctagaggctgaaagtccaagatcatggtgtcagcagattctgtttctcctgaggcctctctccctggcttgcgtatggctgccttttcgttcaccatgtcacatggtctttcctctgtgtgcttcctcccctagtatctcctcttcttcttcttataagggcaccagttgcattggattaggtcccacccttatgacctcatttaacattaattacctttatttttatttttattttatttatttatttatttttgagatggagtctcgctctgtcacccaggctggagtgcagtggcgcaatctcggctcactgcaagctccgcctcctgggttcgtgccattctcctgccttagcctcccgaggagctgggactacaggcacccaccaccacacctggctaattttgtttttgtatttttggtagagatggggtttcaccgtgttagccaggatggtctcaatctcctcacctcgtgatctgcccacctcggcctcccaaagtgctgggattacaggtgtgagccaccgtgccctgcctacctttaaaggggtaattaaggttacctttaaaagttgtctccaaatacagtcacattagggattcaggcttcagtgtatcaattcaggggaatacaattcaggccatcacaatgacatatacatatagaagcatgaatattctgtatattacttaagtgcataggaggaacttaaccataggaagtccacaagcctttgctccttaagtcctggcatccagatcttcattatgttagcaaaagttcagacaatggaaacaaatgtggcactcaaatacacaactattttatctagatgaaaaattaagctttctttggaatttgtgggattcagttggggggctcagttgcttctctcttagaggcaggaaaacatcagcaccccaggcagcagccacaaccctgtctcctgttaaagccattgcctctcccaagaacaaatgcaaattcccagctaaactcctgtgcactttctaggaggaggctcactttggtccttctaggatcaatttatctgaatcttttcttttgaaggcggacctgcagctttatgtagccctgaaactctgaaccagcttctcatgccagcaccccttctttagtcacttcataattcaaattgctgttatcagcatacactatttgtactgatttgactttttcacattgttttaaatcactaatttcctattaggcagattcctcacatcaataccataagctaatggctcccatggtatttgttcatatctttctcttaagatacttaacactttttacctggtaggaggatgatttatagtcatatgtgtctttcttgccagaccttttaactacttaaggttagaattgcatcaaacccattgttttatcccaaccagtgcttaacatgatatggcacacgtagcagagtcacagtaaaagtttgctgtaattcacatagactttgccaggagtgcatagaaggattaagcatcagaagcaatgcaatcgcaaaggtatctcgtaccatcaaggggtgaggccaacatcttagaaaattaagatcaaatatcatccttcatttttaatttaaagcttctagccagttgacccagaaacatcccacacctccaccatgacttaccaatttgtctgaaataataaagaggaaaatgagaggctattagcgccacttccattctccagtcaatcattgttctaaattattaatcagttgaagtattgccaagaaattttcaggcctctctccaaaagtgtaaagtagtcattttcaagtgaacaattaactattttattcatctagaagttgtagaatttatagacaagctgatttctgtggattttcttccccccttttggatgctggtggaggtaagagaggtctacatgaactacaaatagtttcctttccatcactcacttattaataactagaatcctgtttaaaaggaatgtactaaaatattttctaggctgaagcaggaggattgcttgaacccaggagtttgagactagcctgggcaacatagggacaccctgtctctacaaaaaaaaagaaaaaaaaaaagaaattaaattagctgggtatggtggcatgtgcctgtggccttaactacttatgaagctgaggtgggaggacgccagagcccgggaggtagaggctacagtgagccatgattgtgccactgcaccccagcctgggcagcaaagagatactctgtctcaaaaataaagtaaaataaaatatttcctgaccagttcagcatttataatattgttcctaatagcatgccactcctgactgatcattgctggcaaaagcaaagtgatcgattgtcaccaccctgtttgtccccaggattaacttggtaaagaagtacagccatggtttctgctttcgtggagcttacattctagaggagacagtgaaaaagaaaggtaaatagacaaatgaaacaactacagcaaattttactaaaaaaaaaataaaataaaaaaaggaaaaaagaggctaagataaagaaaggggaggtgtaccttaaataagatgtcgataaagacctcactagcaggaatcatcctccgtggatcaggagaatcctgaaactggggacctcataggcagtccaatccaaagtgtgaataggccatgaacatttttaaaactatatattcagttctggtcatctattgacctcagagacactagatttccagtggcatccactactatgactgcaattgctgaggggtaattttctgagccagagttgtagcatgcaatttgccttgtcattctcatctgatgctcattaatagtcccaacttttatgtaaggtatgtgctttcaaaggtagtgtgatatgtggctaaaaatattgatttttttcttttacacttttgtttcttttaaaaggaggaaaagtgagcactaatttttttatttcaactgtatcttttgaaggttcattatgcatatattttgataatcttgtctatgagaatgaaccctaggacaattaaatatcctttaattttgagatgtgtagtctggaaatacctacatggccgtcctaggctttaggttcattttctttgagaggctcaaccccatattatatcagatatatttacaggtcaaaaggcaagattgaaacaaatttagtttaaagatcttaactggcttttatttgtgattctagaatcagacaaaacctcactgtataaaaaagaatgagtgttccaatgagctgagcagaggaggtttcctttacagctggaaaagggatgaagaaagcagaaacaaagaaccaaaagcaaattggttgtttccaagttactttccttgtaaaggttaaagcagagggacatccttatcatattggctacaactggtctagttgaggatttggctactagttctcccccctgatttcttagaaggtcagatgaaaaacttggttttggcttggtggccaaaacttcagcatgagtaattctattttggtttggactgttgagcttggttcagtagttcagtccaaaccaatggacttctataaattttattcaacatacacgaaacagtttttgtatgtgagatctgtgaaaaatatttttatacttttgcatttaaaattatttgcttatgtataatttggttaatttaattttttaaattgcctaaaatttcccagtaatcaacatgcagtttcaggaattcttaagaactgagaaaagctaactcataaaatgtctctaagagtagacattttaataactattacatttagtaattaatcacaatagcataaaatttcatttattgacatatcattaaatatgacattgttcagattgtgcaatttctgcatacactgaaatcaaagtagtttttctctctctgttagttctgaatattttcataggcccttgaaaaatacattggccctagtcattagttcctggtacctaaagattaaagaggcaatagaatatgtgtgtattcccaggtcttacatggcactagatagtgggggtcttttccccctaaataaagtggatgctattataaccatgcatgactccagttagacccagatgaatgtaccaaaatcactaccatttaaaaagcataaaaaaccttgccctcaatttactgtgatttgcaaactctcctctgaagtttcactgaaccccacttataaatatcatcttgcttctttagcaaattctcaaaccttagtacataagaatcacccagagctcttattaaaaacagattcctgggccctgaccccaaagaatcttatttaatagatctaagtggagcccagaaatcagagtttttaaccttctgaaaccttaaaggttgtataagcctttagaaaacattagttgatgtgagcagggttgatgataacagctggtaagattagtcttgacttgagctactgaacaactcaagtccatttaggctagtctctctcaaccctggctcatactagaatcccctggggcttttaaagcactttacccccaaggattctgatttcttctgtatgggcattggtattttttaaagctaccatataaacaaattgagaaaccctaccagcctaagggcatttctgtcagaaaggattaacccacacactgcggtgatgataaggcctaacactcctacaaaatgcaaacactgaagcagagatttcgcaagactaaaatccatctggagctcttgattcccagtttgtgtcagcctcaacacacccaagttggccttaacagttatggcacaagaaaatgagcccttccctttagttttcatcagctggcagaatgatttagtagctctattataaaagcaactccattataattacagtgtttgaattataaacaaaacaagaaaaatacagaaggaatagtcctttagtcaaaactgtaaaacagaacaatttctggctgcagttaaaagcaaactgaaatattaagagtaagctctccagccctttgattcttgcctctttcccataggagcgacactacacattttttcaattaagcagtttgacaacctgaagaaacccacagtgcatgatttaatgagcatatactgtgtgcatggtaatcggcaagctgacagtttgctcatttcaaactgacaagagagcactacacattagtagaaaggtttcttgggtctcttttcattaaataagctttacagttgaggaacattccaactgtattggcaaagctgtcactaatggtccccaggcaaccttaactctctgtcactctccaagtcctcaagtcttgatgaagaaattgcttcttaaaaaacaaagcacaaaaacaaaatatagatatttaaagttctctggatgttgtcaggggcaaggtggagctttctgagccatgaatccactggtgatttcacagtacatgaattctaacccagtatgtgctggttcttcatgcagatcactttataaactggaattgtttttagaaataatgcccaaactgttaaattattcaatagtttagaaatgattcagtgtactggaaaaaacataggccttggtgacagagagataggggttcgaattctgactaaaatacttctctgtggccttggtcaaattacatcatttctcaggggctcagtttcctaatttatgaaacatggacaataacatctgctttgtatgaacaagatcgtaaaagtctttcgcacagttactgacaacacaggcatacttaaatagagactagtttacccacagaaattcagagtatggggttttaacaaagctaactatagtctgactgtcctgagatttctaccatgagcctttattggagttctataagaagaaaaacagtaagctaacattcactcacaaatgggattttatttaatcctactaagattctgaattttgggtgttattacacctgtttttataaaatctcgaaataagaagggttcttagaggtcatatgaggaatttctgacattttaacttttctgattacaagaatatgaaactactgtttccctctttgctctgcttgtcagaaaactcgagtgaattctcatgctaaatgtatgtttgcaactctgttagcagtagcggttagcagatttgtttcctgattttctatacatatgttagtaaccttacttaaaatagtttataagctaccctgaaggaagttgagatttcttagctaactagtaagatccataacaagaatccatgtcacctgactccaggctaggacacctcacatataacatggaaatgacatagaaaaccccagaagcaagtacagtgaagccatagcttattgcttgggtcctatgccatgaagatgatcaaacatattagccttctagttacgaggaaaaaatatggaagcttcagggtccttatttctaaaatagggataatatatatttctaagatcattgtaaagatttagagagaatattttcaaaatcagccagtgtggcattcgatacatagtaacattttaaaagtctgaaatgttgactctaagaaataattgtagttctactaattacaagtaaaacacaaatgcatagacccttaaacatgatttagaaatcatttatccctccaaacttcacgcactgatgtaaaattctgccccaggctaggtgaagatccatacttgctgtctttctctcatgtcacagagtacatggagatctggaaaagttgtccataaattccaaattcttaatataaacatgtctattggaaatacagactcttttttttttttttttgagacagagtctggctgttgttgctcagtggagtcatcttggctcactgcaacctctgcttcctggagtccagtgattcttttgcctcagcctcccaagcagctcagattcccaagcagcatcatgcctggctaatttttgtatttttagtagagatggagtttcatcgtgttgcccaagctggtctcgaactcctggcctcaagaaatccacccactttggcctcccaaagtgggattacaggcatgagccactgtgcccaaccagaagtacagaactttatcaagaatacacacatgtgacattttcaggtttaataatttatacttcagggtactcacaaaactgggccaaaatcatggtctacctctatgtgaaataccaagtttccctatgtctcacagccatgactccactggtgacttcacagtacacgaattctaacccataaattgactatatccagaatgtagccagacataccataaagatgttcatttatcttcaagggagtccacaaaaatagcactgtagttcctcatatgcataccctaacaaaaatgagtcagtggtgtttccccagagaaaaacgatgctgtgcagtggaagcagctttggaaacagacagattcagatttgaaggctggctctgctatccattagttgtatgacattggacaacatagtatgaacctcttagagccatagattcttccactggcaaatggaggaaacactttgaacttatataactattgtaagcaggggttatgttatgatttaaatgtcccctccaaaaattatgttaaaatttaactgccattgtcatggtatggagaagagggaccatcaagaggtgggaccactgagagatgattaggtcttgagagctctaccttcataaatggattaacatcattatgaagaaagtaggtttgttatcatgagtgagttattataaaaatgagtttggccctctcattggctcattttcattttctcctgcccttctgcttgcctccatgggatgacaagcacaaaggccctcaccagatgccagcaccttgctgttgtacttcccaacttccagaaccatgaaccaaataaatttattttcttttaataaattgcccaatctcgggtattctgttatagcagaaacaaaatggactaagacaaatgatatttaaaatatttaaccattagtatggtaaaggcaccaaccagcataggcttaatgcctgttctggtgcatactaattaaatatgaactccatttgaagaattttgaaggcatccaacttgatcctagatcatgggaggtgcttaaacatatacaacgcattaaatgaagcaaacacgtgttgtaaaacattacaataaaaaacttagcagcagttatactgagatctctatactctccaattacattttttcacctgtgttgtttttattccatgattttattaaatgattgttagcttaaagtgatgagccacttgcgtcttttgactcatgattgagacagtcgtcaaaaaattctagatttgaaaagacataaagtgatctcacttggaattttatcaagtctatattcatgtataatccttatgtcttcttaatttaatgactcctttattatgacacactcttcttctttatctctgataatattttttgtcttaaagttgagtttgtctgatattattatagccactctagacttcctatgctgtttccatggtgtatttatttccatcaatttattttaaacctatctgtgtttttttatttaaaggctatctcttaacagaacatagctgttcttgcttttttatacattctaatcatctcagcatttttttgaatatttatttatttttgtttgtttggtttctttgcccacaaaacttattcattttgtcaatcatttgaaagtagcttgcattcataaagcccttgggcttaggtctttttaaaaaaaattcattcatctgtttttatgtgtttattttttcaagtttcattttagattcagggggtatatttgcatgtttcttacctgggtatattgcatcatgctgaggtttgggatatgaatggtagcattacccaggtactgagcatagtactcaccatttggtttttcaaccttttcccctctcccttcttccctgctctagtagtccccagtgtctattgttaccatcttcacgtccacacgtacccaaagtttagttcctacttacaagtgagaacatgtggcatttagttttctgttcctgcattaaattgctaggataatggtgtctggctgcatccacgtggctgcaaaggacatgattcgattcttttttattactgcataatatcccatgatatacatgtaccaaattttctttatctgatccaccattgatgggcacctaggttgagtccatatctttgctattgtgaatagtgctgtgacaatgaacatgcaagtacatgtgtctttggtagaatgatttgttttcttttggatctatacacagtaatggaatcgctggatcgaatggtagttctgttttaagttctttgggaaatcaccaaactgctttccacagtggccgaactaatttacattcccaccaacagtgtataagcattcctgtttctcagcagcctcaccaacatgtggtttttttttgtttgtttagttttgttttgtttttgttgttttttttttttttactttagccattctgactggtgtgagatggtatctcatggtggttttgatttgtatttctctgatgattagggacaatgagcattttttcatgtttgttggccacttgtatgtctgtctccctttgagaagtttctgttcatgtcttttgcccactttttaatggggttggtttttgcttgttcaatcatttaagttccttatagactccagatattagacctttagtggttgtgtaatttgtgaatattttctgtcatcctgtaggttgtttactctgttgacagtttcttttgctgtgcagaagctctctggtttgattagtctcacttgtcaatttttggttttgttgcaattgcttttgaggacttagtcataaattctttcccaaggctgatgtccagaatggtgtttcctaggttttcctctaggattctcatactttgagttcttacatttaaatctttactccatatggagttagctttgtatatggtgaaatgtaggggtccagtttcattcttctgtatatggctagccagttatcccagcgccatttattaaataaggaaacctttctccattgcttttgttaactttgttgaagatcagatggttgtaagtgtgcagctttatttctgggttctctagtctgttccattggtttctgtgtctgtcttgtaccagtactatactggtttggttactgtagccttgtagtatagcttggagttggaaaatgtgtgcctccagctttgttctttttgtttaagtttgctttggctattcagtctcttttttgattccacatgtactttataatagttttttccagttctgtgaaatatggtagagtagttttataaactacctgtataaaacctgtagattattttgggcagtatggccacattaatgaaattgattcttccaatccatgagcatggaatgtttttccatctgtttgtgtcttctatgatttcttttagcagtgttttgtggttccccttgtagatatatttcatctccttggttagatgtattcctaagtattttatatacttctattttttcaggctattgtaaatgagatttccttcttgatttggctcgcaagttgaacattattggtgtacagaaatgctactgatttctatacattgatttaatgacctgaaactttactgaagttgtttctgagttctaggaggcttttggtggcgtctttgagttttttaggaatagaatcatattgtctgcaaagagagatagtttgatttcttcttttcctattaagatgcattttatttctttctcttgcctgattgctgtggctagcacttccagtactatgttgaataggagtagtaagagtgggcatctttgtcttgttccagttcgcaagggtaatgctttcagtttttgcccattcagtatgatattggctgtggttttatcatagatggctcttattatttagaggtatgttcttcagtgcctactttcttgaagttttttatcatgaagggatgttggattatagcaaaagctttttctacatctagtgagatgattctaaggctttttaaaaatcctatttatgtggtgaatcacatttgtatttgctcatgttggaccaaatttgcatgccagaatgaagcctacttgatcatagtaaattaaccttttgatgtgctgttgaatttggtttgctggtattatgttcaggatttttgcctctatgttcatcagggatattggcctgttgatttctttttttttattgtgtgtttgtcaggtttggtatcagggtgatgcacagaatgagtttgggaggagttgctcctcttcaattttttggaatagttcagtagaattgtaccagctcttctttgtacatcaggtagaattttgctatgacactgctacattttaattagtgattagtccactgacatttagtctgattactgatatgattgcatttagagctgcaagtttattatatgttttctgtttgctcctccacttcttgtttttctttttcttccctctgcaacttttggatcatttttttcttaatttaggattctattttatctttggattttcggtggtttttctaggaattaaaacgtatattcttgatctttcacagtctacttagatttaattttatactatctcatataaaattggaaaaccttgcaactgtataaatccatttgccactgcctccattctttatgctataaagtcatatggattacatctgtacatattacattataaacaccacaagacaatgttataatttttgctttaacaggtcctgtgtagttaaagatcttatcatgaaaaactagtcttttatatttacaatttccaaaattttttcattccttcttgaagacttaagattccatctggtgttatctcactttatagcctgaacaatctttcctttagcatttctgtggggcaggtctgctgataataaatgctcttagtttccttttatctgaaaatgtactaatttgcctttactcacaaaggatatttttgctacacatagaattccggattaacagtgttttgcttttttttttacccctcgtttgtactttaaaaacatcatttcactttttctggcctttataaattctgatgagaagtcatcgttcatttaaagcattgttccaccaaagataccgtgccatttttctctggctactatcaagattctctctttattgctggtcctcaccagttggaatatgatgtacctatgcacagttttcttcaaatgtatcccatttggggttcactgcatttcttgatctatgcatttatgtatttcaccaaatttgaaaatttgggcccattatttcttcaaatattttgttctgtttcattctctttctcttctccttctgagactccaattacatgtaagctagacattttaatttctgttacacaggtccctgagtctctgtttattttttttattcagtcattttaagtctttttttctgtctgttcttccaaaagaaaatttctatggatctatctttaagttcactaacactttcctttgtttcctccagttgctgtaagtatactcaatgagtttttatttcaaatactgtatttttcagtttcaggatttctatttggttctttttgcagtttctgtttactaccttcttattcattatgagtttattttcctattatttgtggagcatggttaaaatagccactttaaaatctttgttaattcccacatttggctcatcttggaattggtctcagataattgctttttgtcttcagaatgagtcacattttattgggtttccatatagcgtgtaatttggggttgtatgatatgcaagtattgatgttattgtatgaagagcttcaatcctgttatagttttctgaagggtattgatttatttgttttagcaggcaattagttatactcaaatttaaaactatcccctgggtagcagctcgaatctcagttcagttcttttatctttgtgataatttgtgtctgctccatcaagaatatacacatgacatatacctcagaattacatgacgtgatctcacttggaattttatcaagtgcatattcatctacaattcttacttcttcttaatataatgatttactatcatgaaatgttctccttcatctctggtaactctttttgtctgaaagtttagtttgtctcatattaataaattcaagggtcaaccagaaatttgggtagtgtttatatacagatttgggagcttcccctctctgcctctcttctttccaagattctgaattcattttcctgtggctatgattgccctgaaccctgttctttgggtcttcaaaccaaaaacactgtgagttttctattggaggatggccacccgaagtgacattaattttagcctgttctcactctaaaagttgtaaaatgggaaactcactctggaccgacctgtgcttccaagttttgaatttcagctcccctccagaatctgtctgcttaattttattctctaatgcttccaggtaatttcttttttcttttcttttttttttttttgtttttggtcttttggtactttatagttgatatctgtgagaatttcggatccagtagaacttacttagccatattggaaatggaaacaagtaaaaacatttaggaaacattcctttgcatttcctaacacctctcctcaaaatacttaacctccgtccattccctcatttagtgacatttgagtttggttttaagtagaaatagaagccaggctcagggcttccttgatcatcttgccaagtacatgagaagacttggaatgaaaacacagcataaagttaaatgatagaatgatagaacatcaatcaattctagctcttagactggtggcatttaatctcaaagcaatgaggcttatacagaatcatgactaccagtgattatctacatggtactttgccacgttattttaccttatttctttggtctcagatatctctaaatcctgcctcattgaaaactgcaatagataatatgccacgagaaacagaatactgaaaatcctaaaatgccaacccagagttggtaattgcacaattccttctaatcataatcattatggcttccacttcttgaaagcttctgtataccagccaccttgctaaccactttacattaattgtcagttaatccttcacaactattctttgagcagttcccataactagcttcattttacggaggaagtaaccagagttccgagaggttgagttcactaagagcacacagcaaacagtagaactctgagtcagtctttgtaaagagaagaaatagcaaaggggttttggagacatcaggcacatactctttactattaggagagaagatagaagtctttctaggagtaagtagggtttctaaaacttaaatagtctacagtcctttttgtcagtaattattgatattaaaatgccacccttccagaaacaatatattttatattgacagcttttatgtttaaaaagaaccttctagccgggagtgatggctcacacctgtaatccctgcactttgggtggctgaggtgggtggatcacttgaggtcaggggttcaagaccagcctggccaacacggtaaaaccccatctctactaaaaatacaaaaattaggtgggcctggtggcgggcacttgtaatcccagctacttgggaggctgaggcacaaaaattgcttaaacccaggaggtagaggttgcggttagctgagatcacaccattgtactccagcctgggcgacagcgagactccatttcaaaaaagaaagccctccttcagggcttaaaacactaacccaaacaataacaaaaggatcaaataattatatgtaaaggctcatatgaaaaggcacataacaccagtgctccattttacctcatttcatttactgcctttaaactttgttttccaggtaaaccatctaaacaggcaggtgacctgccagagaaaaatctggcacattaggaagtaaagatgcctgcctcatcccacaacaagatgcagcaatgtctcacagttctacaactctaggggcaatcctgcccaactttgcaaattttgcataaaccatgggtttcaagtgactttggaatgagagggaaagggaaggcagcacgaaggataagctggctgacattgtaaagtggatacaggaaactgggacttaaccggaagcaggaaaaggaatatagtatctttgtgttctggtacataggattattcaatatacatatttattatacatgttaaattgtctgagacccggaaatgagagatactgttaaaggagtaaagatgagatgaggtaacagaaaaggagaggagtaaatatgagtcctaaggaggggttacatgagcacagtcccctgacgacatgctagagattaccagattagtgcattgctcctactttcttgctattattattattattattatgggttttttttggcagggtctcactctgtcgcctaggctggagtgcaatggcatgatcttagctcactgcaacctccacctcccgggttcaagtgattctcctgcctcagcctcctgagtagctgggattacagacacctgctaccacatccggctaatttttgtatttttggtagagatgaggtttcaccatgttggccaggctggtctcaaactcctgacctcaagtgatccacctacctcggcctcccaaagtactgggattacaggccctttcctgctgtttttaaaaatacatattcaacatatccggtgaaatcattcaaagatgcatacagataagtgattattttactctaacgtaaagcctctttgtaagacctacccttcactgtctgtcccagcatatgccctaggacttcctctgaccatgaacagtaccatgccactgaaggagatctgtttcaacagagcctcctcctgctgctcctaactttatttccattccactagcttctcaaagtcatgcaaaacataacaacctgactttgtaactgtttaaccttactttttacacgtaaaaattattaaatatgtgtaactgctggggggaggataatataatggcatgtcagtcaggtaacaggtaagctacatttcatggaaaagaaggggaatgctttcttcagaaagtgaagtcatcattcttttatttaactgacataatatttataccccaatttttaaaatggcagctacaaatagaagtcgaaagagggtaaattctccaagggaatctagccctgaaattttaccattttaaaagttctattttacaagtacataggaacattactactattataaggatactcacagcaggtcaattatttcaaactctttgaaaaaaaaatcaaaattaagtaaacctacctttcagaagactgctacctcttcggagtcctcagtggcaggatgcacagagcttttatagagggtctaagcaggcaggtattcctaggatacctacaccaaggacaagaaattcagatgattatttcagcagtgatccagatggctctaggtacaatttcattaggaacgttcaccatgaatactgagcattgccacacaggtactgttaaaagcgcagaatgaaggtacatatgtgatttttgcaggcattgtcattaatctgtacattggagactgtggctcaaaagggtgtaagtggttcatacatgatcacacaagaaaaggggcagaaccatgccttaattattcatttctgattcctagtccagggttgtttcagccacatcatctgatcctcctcaagaactggaaagtcctggcactggggctttccattttgcaaaaagatgaggctgacccgtgagtctggtgggaagagtctttctctggttttctggtggtctatgccaagtcacctgtctgaagtgtcctgtgtggccagtttactcactttcccttgaaactctggtgtccacagaatctgaaggaatctgacaagcaaagaaacatgggtttttttggtcccactggcctgagtttgaatcctagtaatgtgtttactacttctgtgtcctatgtagctgctcaacatcactgaggctcactttctatctctatcaaacgggtataataatatttgaagggtacatttatgaagaggattttttttttctaaatgagaataaagtatcaagtacagtttctggcacatgttagatgctagggcaaagtgaaagccccatgacccaccttacttgcagggataaccccaaagtggacaagtgacagggaggctattgagaccttgctgctcataaatcactcaatgacaatgcactaatcccctaactggctggttcctcactgctctgacctctacctctgggtttccttcatgtacacttctttgaaataaaaatatcataaacaccaattcattccctaggatctcatttagaggtaatcgtttccttttttaatctaataatcttggtctacatcatgttacatggtcagctcaatgtagtaattgaaagcagatgatcattcatttaacaagtatttattgagactctactaaggtgtcaggcactattctctatagcagtggacataatagtccaagatcaggccatcatgctgcctaccttctggtagaggagacaaacaaacaaaatacatatgtaaaatacatgagtggttaaatagttctaaggactctggagaaacacaaagtaggaagggagatggtgagtactatgggttgaattctgttcccccaacccctccccatcaggaaaaaagatatgttgaagtcctaaccctcagtacttagaatgtgaccttatttggtaataggattgatacagatataattatttaagttaagatgaagtcatactggagatcggtgggcaggcctctcatccaatatgattggatataagaggatgaccacgtgaagacacagagacacaggggagaaggaacgccatgtgagaataaaggcagagattggagttacatagctgcaagccaaggattgccagcaaatcactagaagttaggaaaaggcaaagaaagattcccctgcagatttcagagggagcatggccctggtgacactttgatttcagacttgtagcctccagaactatgagacaataaatttcggttgttttaagccactcagtatatggtacttagttactgccaccctaggaaatcaatacagtgtgtttggggagattgttgcatttttgagcaaggagatcaggaaagatctcactgaaaaggtaatgtctcagggaagatttgaggtgcaggggacaaccatgatgatggctctggatgaagaaattctaggcagagggaacagaaagtacaaacctcccaggcaggtgcatgtttgtatgttagaacagcagggaggccagtatggctggaatagccaggggagagtggcaggaaaccaggtcagagtgatgacaaggagctggagggtgctagaccttatgggccactctaagaacttaggcttttacttggagcaaggtgggaagccattgcctacttctgagcagaggtgaaccaagatctgacttacattttaataagctctctctggctattcggtaagaataaactgaagaacaaggccacttaggaggctcctgcagttatcctggtgaataaaggtgctagccaggtagcacacaggagagtgaaaactggtcagtcctatgcgaaatattttgaaagcagatccaaaaggatttgcaatagattgcaggtagagatacgcctgacttcttgatagtacatagaattaaattagaaaccgtaacaacttaactgtactgatcatctgaataaattatcttctcaaatgccagaccagccaaagatattagcaacaggtttaacagacagggaataagtaaccagaatatataaggaactcctaaaatcaacaaaaagaaaaaggtaaacaaataaatattttttaaaatcatgattcaaagaaggaacaatggaccatggacataagaaaagcagctcaacctcactgatatggtttggctgtgtccccacccaagtctcaccttgaattgtaactcccacaattcccatgtgtcatgggaggaacctggtgggaggtaattgaatcatgggggtgggtctctcccatgctgttctcatgagagtgaataagtctcgagagatctgatggtttaaaacatgggagtctctctgcacaagctctctatttgtctgctgccatccctgtaagatgtgacttgctcctccttgccttccaccatgattgtgaggccaccccagctacacggaactgtaagtccattaaacttctttctgttgtaaattgcccaatctccagtatgtctttatcagcagcatgaaaactgactaatactctcactaaacatgaggaaaatgcaaatgaaaataatgggattctactttatttctatcagactagttaacatgaaaaagactgacacaattcagtgttgtccaagatatgagaaaaaatagcatattattctagtttacttccagcggaatcatgaattggtatattattctattgagcaattttactgtattatcaaaagtgacagtacacatatgccacggcatagtaactcttcttggggggtataccagggctaagaaacatacacataaggggacatatattaaatcagtataacaaaacttggaaatgacctaaaagtcacccttaaaggcaaatcagtaaataaaatatgctatatttatatgattaaaggacatatggctgttaaaaagaatagattggttttataggcatcagtgtggatgtttcataaatgtcatgggcagaaaagcaacacaaaggaaaatgttaacatacaaacacaatagtatgtattcattgtaggtcggggtccccaaccgccaggcggcagaccagtaccagtctgtggcctgttagggaccaggccacacagcaggaggtgagtggtgggcaagcgagcattaccgcctgagctccacctcctgtcagatcagcggggacattaggttctcataggagcaggaaccctagtgtgaactgtgcatgcgagggatctaggctgcctgctccttatgatgagaccctaacgcctgatgatctgaggtggaacagtttcatcccaaaaccataccccccacctccccatccatggaaaaattatcttccacaaaaccagtccctggtgccaaaaagttggggactgctgctgtggatacacatatatgtatgtaaaagtataaacaacggactagtcaaatacatcccaaatttatggtagggaattttaggcaggggtacaggcagcaaagaaagtggagggtggagggaaggacaggacattattggtgaaaatgatttggttttatcaataacttctttaaaaaggaaaaaaacaacactggaagcaaatctgaccaaacaaaaacagatactcgttttgggatagtgagagtacagatgatcattacactagtttttgtgctcatctgtgcttttttgttttctgcgagtaaagaaaggaggaaagggagggagggatgaatggatggaaggaaggaaggaaggaaggaaggaaggaaggaaggaaggaaggaaggaaagaaggaaggaagggagttaccagttctggactgcacttaagctaatcgctaatcatagatggggatagatgaggttagtttttttgttttgttttgttttgttttgttttgttttgagatggactttcacacttgttgcccaggctgaagtgcaatggcacaatctcggctcactgcaatctctgcctcccaggttcaagcgattctcctgcctcagcctcccaagtagctgggattataggcacgcgccactacgcctggctaattttgtatttttagtagagacggggtttctccatgttggtcaggctggtcgaggttagttttttaaggatgaaactcaaaactatgttttaataatcagcgtgaccattggtgattcctagcagactgtctcagcgtggagggctgaatttcagttcagcccgcagagggaaccatctgtcatttggaatgacaaggagctctctgccaggggaacaccagaacaccggaagcagccatggtcttcactgcatccccactggccctggaaccaccaacactacaggacacaggaacacacaaagtaaaccaagggtacaccatggacatcttttcaacctttttaaaagcacattgcaattttctagaatcaagggaacaatatgcttgattagttcttcagcagatttggcaattttgcttgtcatatttctctctttaaagcaagttggtcattaaccttccatgttctaggacttgagattaggttttccccccacaaaatgaaaactttgcttaaaaaaaaaagagtttgctttaggataattcatttttgctgctaataactgcaagatcctctttgagccaaggaggtcattcttgaaaggggctagaattgtgaagaatgttccttctcttcctggagagagagtctgtgaaggcaaaaaagtttgcaggaaagttcagtaatcatgaagtgaaagcccaaagtgacctgaatacttcctcctgggtcaatattgtatgtttaaaaagaaacaaccaaaccttcaaagaaaaatctggccatccccaaatcccaatacatgaaactagaaggcaggaggcaccagtagaatgctggctttgctctcattgcttggcctccatcacagttacaatagttgcatatcatccttttgtacgtgtcatcctaaaaatgggatttggattggtttctaacaataaaacgagcaaggtagaaaaggaatattatgaataagttaccaatgtaaatatgctattttgcgcctttgaatttgagtgttgataaacatgattccacacatggaaattagacttttcagagctactacactgaatcatttaatttgtctgagtaagtacttataataatgtggctgctctgcactgcaataaacatcgggttttcaaatgaacaaatgaagtatgtgatactccttataaatggaactgcagcaaagggcgttcagctagggagctgtgcactaaaatgggatgggtgataagaacatctctctccagctccactgatagtgaaaggaaagaatcatatggcctctgctgctacattttctgttcctggacagaagcaaggctgaagcctcactgtgaaatgatgggggactgttgctattttgggttgtcacagggtaacttgtcacactactcaggacacatgaggacagataattctgttcctccagattgtggacttgagaatgctttagtaaaatagcacagggatatattttggatagtggttaaggacatgggtttgaatcctgggctctaccaaccaaataggtgcatgattgtacccaagtaatcatcagtcttctccatgctcattttcctatttggtaaaataaggataataactttggcttcctcattaagttattagggggattcagtgagataatttatgtaaagaacctggcacatgattagaattcaccttttttaacattatcattttaacattatcatcacatttttaacattatcattcaccttttttaacattaacataaccattttaacattatcattatatatgtcatcattattattatatttaaccttactttcattttaatccattattcaattttccttcaacgctcattaaaagcacaactcactacattgtttagtaattaattacttttgttcatttaacaaagtatttatactttgttatatgtgccaggcacatatgctaggggctagggtacataggtgatctaatcctcctggaagctattagaggagatgggcatgagtcaaaggctcccataggaagtgaaacctttgaaactcagggaacaggtctaaaagaaaggagcaggctaggcatggtggctcatgcctgtaatcccagcacgttgggaggtgaggtgagttgatcacctgaggtcaggagtttgagaccagcctgaccaacatggcaaaaacccatctctactaaaaatacaaaaattagccaggcatggtggcgggtgcctgtaatcccagccacttgggagactgaggcaggagattcagttcaacccgggaggcagaggttgcagtgagccgagatggtgccactgaactccagcctgggcaacaaaagtgaaatgctgtctcaaaacaaacaaataaacaaacaaaaacaaaggagcagatcactctaagagatactaaaacaaaggaacttaaattaaacctgagacctgaaggatgagaaggagaacaagggatggaatgatggctttcttgagagaaacacaacaatattcaaaggcatggagtatacagcactttatcattgttatcaaaagtcattgcaaaatgatctactgaatagctcaattaaatctaacaactatgtgacaagcacctactatgagccaagcgcagtgccaaactctagaaacaccatagtaaagacagatatgatccatgcctgcatccttacctcccaacacctactactatgtttgaaaaccacaccaaagtcaatatttactttgtaaccaataaattacccctctgggtttgatcacagagagatttcacctgcatggaaaaactggaatgctttctctggtcagacaaggaatgttacatatgccaaataattccctttcttcttagttgctggatatctacaaccaaatttagtttattccatgggcctaccaacttatactactaaagatggccatgtttctctttcatgattaattgttctattatttgtagactacctttaatttagtaaacagcctcagcctcaaattatttggaaagttattagaagaggagaaaaaagtaaaagaaaacaaggaaaagagatctcaagtttcttgagatctgggaattgtccaatgtgctttctgtagtattcgtggtacctaacatggtgctggatggaaagcatttaataacttctgattgtcagatggatgaagaatataaagctttcctggttcaacttgggctccattagaaggagggaagaactgaaactcggtagatcagaatatgcctccccacaacatccttctttagcataaggattattttgagctgattattttgagagactgcagctacaggagaagatctgaaaacagaagagaagttacctttttgtaaaaggattttacatctataaaggaaatttctactcataagggtgtctccctttctataccaggaagagaaggatgaccaaatcactagagactcttaccaatggagaagacaccaacttaaatctgcataacaaaccttactcatgtttaccatacttttcctgggcatccctccacaactgactatcccccatacccttcttttttttctttcagtggacaatggtatttgagcctgatctcaaagccacctctttgagatttattcatatctctgggtatcttccacgtgtacatgagatacacatatttttaacttctgtttgtttttctcttgtttctgggtctatcccaacctaaggaccataaagggtaaagagaaaattatttttccttccctacacttacttttctctagtctccaggttcagaggaaagaactcaaaaaagtggctgaaaagtttagcatgattttcattgtaaagcagcccaataaccaaacagaagcaccacataaaccaaaagaagagagtggtaagtgaaatataaggtaccattagagatttctctcagggaataagattcttgtaacaaaatatttacctttcttattctggtgctagtaaaaataagagaaatgtcacaattttaattaatgtctaagcaacagggaaaaatattaagctactttatgacaaaatggaaatatatttgtaattctatatcctaatgttctctcagttattttggaaaaactattagtcctttggtctcttctacattaggagagcaaaaagctataatatggcctatctggctaactatcgggaatcggagaaatcaatttaaaagaaatttggaagacacctacattatcgatattagagcaaagtagagatctgccttgttcacagcaaagcaatccaattcacacacacacacacaaaacaaatgttgcatttatggaagtattaaaacatctcatccttgtccttagcttaacatattaatgagaatttctgaattaatctccaatcgtgaactgtgtctaggtgtgatataagggcagtaaatactgtgcagcttgcttcaggcatgttttatgacagattctctgacagatagaaaatctttaagattaaattatttctgtattttcctaagaaactcatcagtactaacaagcataccacttccccaactagttgataaacagaaaagaaaatattattaagtgatggcacttgaggaaatagttaaaaggagaaactcagaacataagattgtgattatatataatgaggagattctcaaaatggcacagaaaggaaaggaacgagttgaagctgaaaaacgtatgtttttaggaggtaagttattccataaagcaattactaaaatgtgagagttcttctcatggttctcaaccttatactctgaaagagaacttcttataatgcaagactaagagagccaattacttcagcaccaaggtacatcctaaatctctggacttggcagttcaaaaaaactcttggaaaatgttcttctaaaatcttcactaacagccctgactttagaaatgtagactctaaaaggatgaataaaaactaaccaattagatagcaaaatggagaagagagagcactgaataaaaagacctgccagagttcgggttgtacctctgccaccagcctcagacttagttcatatttacaataaaaccataatcataaaaattaataattatggaacacttagtatgccaagaacttttcatatattatctaatttaatcatcctaacaacctatgagggagacaccacataagagaaaagcagttgaagagtttgtccaagaccacccagctgctctgagtgatgggttaggattcaaacacgatttttttggaccccagagcccaacccttaaccactcactctgcagaatagttcagaaacctcctaggatgatctaaaaggcttctttcaacaatagggcgctaagatttatgagacatgattgtataatggaaaaaaatctcaggtttttgaagtgactttgtagcccagttgagcagcttcttctctaagcctcagaatcttagataacaacactacttaccttacaagctggcctaaggatcagagataatactagagcccttagccccaagtaataataataataataggcagcatttatataatgctcattatgtgctgggcaccatctaaacatttttttccccacattaaagtatgcaatcttcacaatgaccttaaaagtactattattttgtactttttatctaattgtataagaatacaattagataaaaagaaaaaaaaagagttctattgttttgattcctgttttaccaatgaggaaacagaggcaaagagagttaaattacttgacctaaatcacagttactaagttgcagatcttggattctgatccagacagaatgactcactggacaacccaaaacatattggaggcactcctactgatacataaagaacctccttgccatgcccaatgtctgtgtcactctcacccaaagtaacaaatttaacataaacttgggaggatgaaatacatagggatgcccagataacctgcctactgtcattccgcagattgtgcctttaaaaaaaccaatttcaatagaaaccagcaagaaagagatacatcaggtatgtcagacatacgtggtcacaactattttttctccttcctggctaatcactccctttgtgttgataatgtgctgctttaaatcaattcataaaaaaaaaaaaaagcacagaggcaccataaaagtcgtttttcctgttttcaatctggaagaaattcagtctcttattcattttaaaaactattttaataatagcttttacttaacccaatatatcaaaaatattatttcaacatgttaataaaagttaataagagattttacgctaagcattcaaaattcagagtttactttacatttaaggcccatctcaaatcagactaacctgattagtctgaatgctcagtagccatatatgttgctagtggctaccatattagacaacacagttctagaaagattggcttagaaaagccctggttgttgatatttataggtctctttccttgggctggtcaaattccccagaaagatatctttcaatctcctgccttaggggtataagcctgggtgccattgttctgagatttaagtatgggaaagagcagaagccccatcatattgtctttcacttaagccccgattttcatcattatacccatcctcagctatgcatggtgactccaatcacgagccctgtagttggtccaacccctccagtcttcctcctggggaagtagggagggaggcagttgggagaggcagttcccaggctatgcgggttgggcaagaactctggggactggttagcagttatttgtcattctttcaatgttcttttaatattccttcattcccactttcatacatttacagtgccatgaattcctgacacgttctagaatctcagtttagattttaccgtttctctccccttttaaatcagtccctggccttttaaggcagcttctacaattgtattctgtgaccttctcctctatgatttttgttcatattcccctccccttttttaactaacattttttatttgaaataattgtagactcacatgaaggttgtaagaaaaaatacagagaaggtccatatgccctttatccaattcccttcaatggtaacatcttggaaagctattacacagtaacacaaccaagatattgacaatgacacattcaaaacacagaatgtgtccatcccagggatcctcttgttgctctttaatagccacacccacttccctcccactccaccccttcttaacttttaaccacaaatctgtactccatttatataattttttcatttgaaaaatgttatacaagtggagtcgtacagtgtgtaatcttttggttttgtgtttttttcccctttaatctattccctgaagattcagtcaagtagtttcatgtattaataattcattgctgagtagtattcgatggtatggatggaccacagtttgcttaaccattcacccaataaaggacatctgagttgtgtccagtttggggctattacagataaagctctatgaaaattcatgtatgggctttggtgtgaacataagcttttgtttacttgggataaatgcccaggagtatgataagtgcatgtttaattttgtaagaaactgccaaaccattttctagagtggctataacattttacattctcaccagtaacacaatttctctgcatcctcaccagaatttgttgttatcattatcttttattttagttatttcaatatgttcatagtgataactcattgtggttttgatttgcatttccctgatggttaataatgttgaacatcttttcatgtgcttatttgccatctgcataacctcttcagtaaaatgtctggccatgtattttctaattgagttgcttggatttttttactgttgagtttgaaaattctttatatattctaaatactagtcctttgtcagatatgtagtttgcaaatattttcttccagcctgtagttattcttttcattctcttaaaagggtcttaggccgggcgtggtggctcacacctgtaataccagcatttgggaggccgaggagggtggatcttttgaggtcaggagtttgagacctggccaacacggcaaaagccagtctcaactaaaaagaaaaaaaaaatacaaaacttagccagccacagtggcatgcacctgtagtcccagctattccagagcctcaggcaggagaattgcttgaacctgggaggcagaagttgcagtgagccgagatcgtgccactgccctccagcttggggaactgagtgagacactgtctcaaaaaagaaaagaaaagaaaaaaaaaaaaaaaaaaactctttcacggtgcaaaagcaaaagttttaattctgatatagtccaatatatcaccaatatatcatttgtttcctgttatggattgtgtttatgtgaaatctaagaactctttccctagccagagattccaaagatttttctctaatgccttctccttctaaaagaagggttctttattctgttccgttgatctatgtttctgtcactccatggatagccacatagtaactatgcaatacttcttgaaactgggtagactgattgctcccactttattatttctttttcaaaattgttttagctactctagttcctttgtttctgtataaattttagaataatgtcatctatatatgaaaaaaatcatactgagatttttgataggaactgctttaaacctgtatatcaatttgggaagtatcggtatctttactacgctgtgactttcaaatcatgaacacaacatttttctccatttatttacatttttaaaatttatttcatcaacattatatagttttcaacaaacaagttttataaatgttttattggattcacataagtatttcatatttttgagctaaggcaaattgtactatatttttaaaatttgtgtccacagattcattgctagtataaagaaatacaattgataatttaaatgtctatctcatatcctgccaccttaatgaactcaattattagtttttcatttgtttgcttgagatagggtctcactctgccacccaggttggagtgcagtggcacacaggtattggcacaaacacaaccttctatagcctcaacctcctgagctccagccatcctcctgcctcagcctcctaagtagctgggatgacaggcatacaccaccaggcctggttcatttgttgttgttgaggagagatgaggtctctccatatttcccaggctggtcttgaactaggctccagcaatccacctgcctcggcctcccatcgtgttgggatgacagtcatcagtcactacacccagccacttactagttttaagagttggttttgtgttttttcgtctttgtagatcacttagtgttttctgtgtagaaaatcatgacatcagcaaatattaacagttttctttctttccatctgtatgcctttcatttccctttcttgccttattgcactgattagaacttcctgcactatgttgaataggagtggtggaaccagccttgcactgctggactagactccatttcgtcgtggtatattattcttttagcctgaatcctgtttgttaatattttgttcaggattgttgtgtctctatttatgacagttattggtatatatttctcttttttgcactgttttttctgtttttcatatctgagtaataccagcttcctaaaatgaattgcgaagtgttctctcctattttctggaagagactgtataaaactcctattaattattctttaaatgtttggtaaaattctccagtgaggccatctgggcctaaatatttattttcagggagtttttaaatgattaattcaatttttaatagttatgggcttttaaatattatctatttcatgataggtgaatggtaggaatttgtgtttttgaggaagtggcccatttcatctaagttatcaaatttatgtgtgtagagttgttcatggcatttctttattatccttttgatgtctacagggtcaatagtgatatctcctctttcattcctgatattgtaaccaaatgcaggtccagatgcccactgtttacagagtccagttaacaagagtgaggtctagtagaaagaaagtcattttactaaaaccagtaaaggggaaatggtcagattcccgcccaaagcaatcactttgattttgggggaaggcaggggtttaaaaagggaaaacttgataaggaaggcatgcaagaattgtactaagtataatatctgtgtgtcttgttctggtagctatcttgggtctcagtctacctggatggtgagtcaagacatctgggaatatctttacttcccctttattcctgaggatattttcacgggctgtaggacactgctttgattgttgattattatttcattcaggactttgaatgctttaagttcctgagcagccatggccaggtttttaactagccactttgaagtaatctctggaattttgcagctgggtctccaagcttattccgcctgtctcaagattagcccctggaacttctaagaaggcacagtaattagatactagtatatacttagacaaatgtgaagggagtatatatggtgaaaaagggagggacgtggagcctatttctaggctgaggaaaaggcttctgcagtttttcaaggttgtatcttgaaaaccaagagaagagaaaaaaatgttttaaaatgcatttggaagttaagttgcctagttacaatattggtaattggtgtcttttctcttttctttgtcagtcttgctagactgtcagttttattaaccttttcaaagaaccagctactcttgttttcctttgattaaagtttgcatgatacatcttttcccattattttactttcgtctattgttatattgaaagtgagcttctcatagacagaatatagttgggtcatattttttaaacaattctgctaatctcttccctgtattataagtggtatatttagaccatttaactttaatgtaattattgatattttagaatttacactgccattttattttttgtttattttctgtttgttctctttgtggttttctgttttctttgcccagacttcttataagctatttgaacactttttggaattctgttttgatttatctaaagtgtctttcagtgcatttctgtatataattttttaaaggtttctctaggtattactttatatatttataactaaacagtttactggtgtcatcattttaccagtttgagtaacatatagaaaccctatctccgcactttgcatccctttatcttccccatttataatataattattttaaatacttcctttacatgcatttacatccacatcagaatattgcaatttttgcttcaaacttcaaacacaattagagctctcaagagtacaaatgtttttgctatgtttttttcttcctttctgatgttgaagagatccatttttaattgtcttctttccaattagataactcttttcttttctttcgaggcagagtctcaccgtgtcatccaggctggagagtgcagtgatgcaattatgcaaattcttttagttttccggctgggcgtggtggctcacgcctgtaatcccagcactttgggaagccgaggcaggcggattgcctgagctcaggagttcgcgacgaacctgggcaacacggtgaaacccgtctctactaaaatacaaaaaattagccgggcgtggtggtgggcgcctgtagtcccagcgactcaggaggctgaggcaggagaatcgcttgaacccgggaggcagagcttgcagtgagtcgagatcgcgccaccgcactccagcctgggcgacagagcaagactccgtctcaaaaacaaaaacaaaaacaaacaaacaaacaaacaaaaaacacaaattctcttagttttccttcatctgataatatttttacttcccctttattcctgaggatattttcacaggcaataggatactggcttgactgttgattgttatctgcattcaggactttgaaagctttaagttcctgagtctcagcagaaactcaaaaataatacatgtaggaagagctaaaaaaatatacaataaaccggatcctatcgaatttaaatgtcaccaggctacaagaaactgattctggcagaaaaaataaacatgtgaaaaataattacaataatgtgtgataagtgcaaaaatgcaggtatgtacttgtcacgatgctgacacacagagagaatcagcactgcttgagagaatcagtgaaaacttctcagagatgtgtgaaccaggttctgaaagttaggtagtaaaaggacttcctgggtgaaggggaacccagcacgaaagccctgagaaaagcggaaaagatggtacatttgagaatctgtgagactgaatgcctggctgaggtatagaacacccattggaacaagcaagagatgcagtagaaaagacagctaagggaaggatgctgggctagagggcctcatcctctactaaggagtaaactttatcctgtgtaccacgaggagctaccgaacagacgaaaatggtgagtgtaatatttaaagcaatgattgctactataacactctttttaaagtagcttttccatgaattattaacattatctttagtctaatacgtatcaaaatttagtttatggactggtaggatgtgttaatggccaataaaagtaaaagactcagccgattccctgccttctacactccattttacacacactccatcctgcctgccgaatgacttcagtgtctctgtgaccagtgagtgaagcagcatgcaatgagatcatggctagatggcagcacattcagtgaagtgcttcagctttcctgttgcttctgattccctggcatttgtcagtgtctgtcaaaacattaacatttcttaatgtatattttgcattatttactaaatgaaaattttccaatgacagtggctgagaaaaaaaaatcagatttacatacagtatgtcaagttcacattcgatgccccagaaatgcccagtccccaaagacctctagggactgcagctcatttgttgtccctctccctctcccgtttattatgctgaccctctgcccagccacatagctcaccccacccccttagaagcatctagagttggctctagacatgaaatggaatagatttctgcatttacataactgctatcgcacttctggtgaaaagtagtttcagaaaaacacagaaaaaaataaacagaagaataaaaagtgtctatgtgataacataagggcttatttaactacgtctttatttcctttacagtccaactattttttttttaaaactgcatgccaccttcatgctgcctctcggaggggacttgatcttatttagacccggtggcgagggtccttcagctccgtgaggagctctctagcactcagtcctctttagaggaaagatatcttcagagcctaaaggccttgaaagaaatgacacatttttaaaaacagaaaaacaagcatgaaagtggcccatcagaaatgaaggtgtgaactagaatacaatagacagcgaggaaggagccaaaaatcctcacccaggcaggccaggatatatgcagatagggaggaaattgggaggcattcctttgctaataaagatgatttttcttctaattttcacatctttcatgatgtatcttttgttttttgttttctctctatgactgctgttctaaaataagtgggctttaagaatatgaactacagtccgcatgtttgccagccccatattctgcgatgaacttgacatgtgaatgaatcaattctgcagaggtgaaaagttattcctacaaagtccccagttttccttgtgagaaagatccctacttacctgtaaacttgttaattaaatgtcaaaggtttttatatcaaggacaataacacaagccaacctgggaatctgcttgtctgaaataggtaaagagtgtctgtgtttatttagaattgattgtacactttccttcattctctacatagattttattttctccccacattcttctttttctgtattgccttgagggctttctcttataattatgtgacaaattatatctgaattatgttcaaataagcaaggagactgaggttttctgttaaaaacatatggcctatcagtaatgaatgaagttttgcccatatcatgacatgactttattgaaggcaccatctcatatatgcagttttcaatgtggtgtctaacagatttgtgtaaaatgtctaaaattaagcaaatgcaattatatgagttagtatcatcttatcatgtacattttgcttgataatagaaaagcaaatgaaaagtttattagcttattacaacagtctgtttttgatttttactttagactctattcctctttattttctcctcttctgtttcgggtcattattttatctggagaacccaaaatccaattcttcatctgtatttaccacatagatctttagattctcttaccaatccaacagatttctgaatatttaactaccctattgtaagttgtcttgtttagaagaaatggaatctaagattgtggcagtaaaggacaagctgtcaatgtgttaaataaattcctgttgaaaagtaacggcatgcactgtgtgttaacataatttattagaacaattagaacccatccttgttgtcttttaattagattattccctgttctggtaattacactagacaagggagaataatagtcttgggattctaaaatcatctgtagactatgtggaaagagaataaataatcaataatgctaatgtaccggaaaacttaaattcccagaaagagatcttttatcatgagcaatcctttgtataaacagcattatttctcaatgtctatgcttatcttgcccaaagttgaaaagtgaagacactggacaaataacagatatttattttactgtcagaaacctggttgggctgggccacctctggcctctagtggctcagacattgcttcagtcccttgcaaaatgccaacaagaaaccgcaaatgaaggatttaaaattccatgcagagcagcatatctagcagtctgaatgcctaagggaaaggatgcagggcttttaagttctggtcctaggtgaggaatcataaagttcctcaatttaaaaaaatatatacaaatggacaaaaatgtcttagaactgagaaggctactaaatattaaaaaaaaatttctgatatttccatacatgaagatgttatttgcagaaattaataggcaggctgtatgtcaggaaagtttctggctctcagggatgggctgaggcctttagatgtgaatcgaactacatctctggttttatgtttggaagaccacagggaattccagtgctccaaggacgctccgagggcctacacaactgtcatcaagcatgttaggacatcctagagagtagttcccaaaacttctaggcttcagaatcttgacaaagtcatgggtgggcatatcctgccctcacggataaccctacagttgagtagaaggatgctggaatgcacagaattgacaccagtgaatctggagttctctgtagtaatgagcaacacaaatatctcaccaacagtcccactgttatccgagtctgccttagtcaatgtaaactcctaatgagaccatgtctagacagtattgatctcccaccagaaaaaaaaaaagaactcagagtgtgacttcttttctagcttagcccaaatgacaccctaaaacatgctctttcattcactcattgctaacacttttcataacctgagatattttatcaactaggcagccaaggacccataggcttcttcgcaaggtatatgtgatattttttatatttaaaacatctttgatattcaaatagcagataagaaagttacttaagcttattaaagaacctagagaaattaaatgagtgtatatatatatatatatatatatatatatatatattttttttttttttttttttttttttttcccttgctaggcaaaggagacaggcctttaaaaaatgaaagtccacataagattaaggtgtgatcattcaagttaatgtgggcaagatatctaaaggagaaatcattagcttaagctatccaaaggattttacacacagtcctgtggtttaggagcagaggatcacccgtactactgtgctatccatcccagctgggaagacatggttctttatagaagtaccccttaaaattgtcaggggtgctattaagtacttagggttccccactattcttatctccagactggtcaaatctaccaggcatctttctgatatatcagatagatacaatctatcatagatataccaaagatttatttgcatctgagtgtcctgtggtgaggcattccacagcaggctgtgcatcaggtctgtctgcagaaagtaagaaagaaaggaatacagtttaaaattcacgtaggaatggagtttaaaaactccccaggcaatgtgaaggtgagttaggactgggaaccacaagctaaaaaggagaaccacagagaattctttctgactttggggctgaaatgaagctgaccgaggcattcaggtggttccagaggctggaaagtctcatacgacaggtttttttctcacaaaagagaagtgaaataagtaccttattatgttccaacaatatcaagatacaaatctatcttttagaaaaatgctaaataaaaacacagtcagagagagacttccaccactataaatagtttcttataaatgccacctagagacaaaattatcatttctatgatcctaaccaaaagagccttgcatgtcttggaaatactttgccctctaaagcaaccagaagaacattccttcagtctatgtgttcttgtgctggattttgaaacttttgagcatttgctcccaaagtgaaatttaaaaggctaacagcagggacacctggataactagaaaacttacctattgatatcacaggctgcttctccaaatggactgtatataatttcttgcaagcatagtaaaaatcctatacttgcttgaaatgaaatgaaggaaagcctatcatgaatttctttttctctgtgttaatgaaagacacgagcacaccatgataagcaggagagaatgacctagtgttcatccttctcttcttgtccaacgcaggtaactataggtgggctctgggtagagtatatgattgctgcatatttctaagaaataaagttaatttacaggctacctcaatcctgacactctaggggtaaggcaagcatgcatgtatgtatttctggtaatcaagagggagaaatagcagtgaaaaatagagcttggatatatatcttaaagacatgccactgatttcaaaatagggcaagagcacttatgatttaatataattttgttggaaaaagttaactctctccaaggaaatacagagcttagcaaataccttataaataatacaaaggcatactatagtgtttagtagaatcttattcacccattctgatttggacaaatgttaaatgagacaaacaggagaaaagtttattgattaggtaaccgattaaaattttggtgaaaagcagaagtagtaagttccagaaacaagaaataaatcatgtatatcaacaagaggaatgaaggcattttgtgcaatcctggggaatagattttcttaggtatttcataaaatcattgactctagggcaggaaaaaaccctacacacataaacccacagcattctttttcctgcctccacagttgtaaaggcccgatgataaaacctgtttcctaagacttccccagaatgtgattcaacacattttctatttttttaaaaaaaaatttctgccacttaatttcatgtgataattttccccaatgactaaccaaatatgcttcactattatataaatcaattctttcttaatgccacaagtgaaagtgcaaaggtagctaatggttttcttctcataaaaatcacactttggctttttcctttcatatgtaattaatcatatttgtgacaatcttccaaacttacttgaaatttttctgaatccctttcaaatcaggacaagaactagaaatgtctatacaggtttaatatgaagtaaagaaaatgtttttcattttcttgatttatttctgaattcagcttgctcttcattagcgctacatagctgmcttattattcgtggtcccctatgaccccctgatcattttccctgagggtgcatatttattcactaactatgttacaatcatgtgatctgctggattttttctgatagtctactctagatttgttctaaattaataaatcccattatttttggcttctactacttctatttattaaattcattctgaatatgaagtttattttcaaaggaattcataattctttactccrrgcttggttctaacaatgaatttaataagaattgtatttaatcaatgtttaaatatattaagggcaaattttgtaaaaatgttagtgttccaagctttccatttccccacaaattaatttttttagcctttccccttaatccactttcttaaaaaataaaattttttttgtgatgcagaattatgtgaacaataagaaaaaaataattagaaaggtaggagtaaactaaaaacaaacaaacaaacaaaaaaaaaaaccaaaaaactaaggctgcagacttaatagaactaccatagctacttaagggtaaatgattaagagagagacaacgtctggcttctgagcagagcacagagagaaagatcaccaggaagaaaaaagataacagggaattttaaggacagttgccatgtgtaatgcataaaatagttttcaaaattcttggagaggtaaaaataaaatttagatttattttttaattatttcacttgcgatgctatcttaagattgaaccacatggggccccagaatttatttaggttatacaaatatcctccaattctgatgctgattatttcatatgcagacttcagttacctttacatgtcataaacacacataccccagaaataaacttgatcatcccataaattttcaagagctctcagcctgctgtaaatgaaatttcaccattaactcacaggtcgatgtctgggacaacctcaaagactgcttgagtaattaataaatttatatgaaaacattggagtgaaaatgtctgtcagtgtcaaatacataagaggtaatggctgatacatagtaatgcagttttaaaccattggcaacatatctaaacaaaggtatcagagaaaaataaaagaaaaccttgtaacttgtatgataagcctcttgcataagattattaagaaagtcataagcacttacggctttattccttttctatatagatagattgcccagaaaaacgtggactgaacctcagctggaatctgagggctctgcttgtctttaacagcttagctacattgttagagagcaacactacataatacagcatgccctattcttaaggcaatacataaaattttaaaacctgaagctaaattaaaaggttatcacccttctgcctaatgtattatatatttgtaaatgatatctgtctctaaaaaagatgtaccacaaagcaagagcatatgtgaaacaataagagagaatgtaggagttagaaacacatttaggtatgtaggaaacacaaacttcaagacattcccaaggatctaaataacctatacacaaatatagcaaagtcatatcctaagggagaggatttgagttctaaagccggagcctaaggtaaatgttgcatatagtcaaacttaccattgaagatcactttaatcacctgtagggtgcaagttacattgctttgtgtattcaagactgacagtgaatatttgagaaaatcagttgagttagaataaagaaggaagcaaagaaaagtccacctacagatattagggtattcaaacaacctcttctttaagaaactagcaaatctccacctctgagtttttatcaggtaggtgatgaagtgcaaagctgtaaaccctccaacagggcttattccactgttttaatattcacatttcataacttggacatatgcattaatggatgtatttgtcattgttaagattaagtaacataatctttctttttttttttctttgagatggagtcttgctctgtcgcccagcctggagtgcagtggcatgatctcagctcactgcaacctccgcctcccaggttcaagcaattctcctgcctcaggctcccgagtagctgggattacaggtatgcaccacaaagcccagctaatttttgtatttttagtagaaacaaggtttcaccatattggccaggctggtcttgaactcctgacctcaggtgatccacccaccttggcctcccaaagtgccaggattaaaggcatgagccaatgagcctggctgataaccttatttcataagcaaaagcatcatccacagggtctggtccagagcagatactcaatagggtgctacattttaatctaactcttgtttcatcagacccacaaacacattgctctttaaaatcctgtagagaagaatatgacaacctgcaccttttctttccaagatggcatttccagttagggtacctctgaacagctgttgcttgcacattttaggcatggtgaagatctacacctgatgctgggttcctaagtgggcatatggtgaatccactgcacacagaagcacttctttatgcttggatcacattgcagaagattggacccctgactggggctacctttcccaagccttaacagcacatcaggctcaaatcacagggctatcaaatgaggagatccccttttccaaaaaaagcatccctatcaactctcccaggaaagcacatgaactcatgttatccattcattcttatcttggaaaatacacccacaagccccttttactgccacttacagtaggatgccacaaaaattcagaaactggaatccttttccgtcccttctcctttccttcctccctttcttcttttcttcttccttaccttgaaatttctgcctgtggtaaaaccacaggaagaaggaaagtcaaatgaattttcctattagtcgacatttctgtgatacactcattttttttggtccccgtatgaactccctccagggtatttctttatgggaataaagtatgccaaatgaaataaagaacttgaagcacaattttatccttgacatatgtagagagaatatgttactcctgaatttatggtgcaatgcaactcagtcacttccttttcctctttcccctagtttgcacttcctacttattgctgcataccatcacaaatttatggagtgccaatggctgtggcctctaggcagctcccaaatgactgaatccagacatcattgtcttcagttcccctttggcattagtctattttccatccctcttcctttattgaaatctgcttccaattatttttcataagatggtttagctttcttttatttcctttaagttgaaactcttttatttctacctttcatttctatgccctcctgggccttaagcacagttcttctacatttacaggggttttcatttagaaactattgagaactttactatcaaattgtactttttaagataatttttttgcaattttaactaaaaggagatttttagacttttggaaagtcatggctccaggtctcagatctcagctgtaggttttatcactttgcaagatgatgactagagttacagcacattctttcaacccatgcccaaaacttcaaagatggccacccttcaacccctgaagatttcaactcagtgttttcagaaaattggaggtccaggctttggagtcagacagatatgggttcaaatccagcctctggcacttaatttgaatacaacctagagtaagtcatttaactttcctgagctttgatttccttatctgaaaaataagaatatagatacttacctcaccatattgttataaagatgaaatgaggtaatctttgtaaaatatacacaatgtctagcaggtggtaagcattcaaactggtagctattttttattgttatgagttaaaattttgtatataatggattttttttccaagaaagctcatcaagctgaccttaagtagatgttactcccaaataccacccaattccatgtctacatacttgagaagttactaaacactttaaaattgaaattgaaaactagggacaaacatagatttgaaaccaaaggaataggtaatcagttataaatttggatataacattatgagcctctatttcagaaaatacattccttttaaagtatatttactatagttatccatgcagactgaatatttttatcaatagttgcaaaaccatttcctgaaagggaaaaccatgtaattataactagattttcacatgttaaccttttatataagggaagaacaagaagtagatatttgctaagagactgggaagaaagggaagagaagggagagagggagagacagagagaatgagaatgaaagcaaagaaatttgacaaggaatactatttggcttttggcccttccgtgtaccaacgtagatgtgtgattataccatttaggattgttgtcaattctttccataggaacagactgaacaatgagacatctacctctcaacccaaagagaataaaattgtcatttccctacaggacttttgttaatacaaaaatgaaatatatatatatatatatatataaaattattatgatttcaaaaataaagccaaatatctaaatgaaaccatgaaaataattagctccgatccaacagagtaagtgaggtttttactttggaagataagtaaattctttcagagcatgagaatgaaaaattgattgattccgatctgatctctaaaaagagcagtctgatttactttggtatcaaacagacctgcttctaaatgccatttctgccatttacctgttgggcaaatttcttacctatgcacttggagtcttcacccttaaaataggtatgaaaataggtagaaaataggcttgccatgctttctctctctctccctatatcccatgtctctccaaggagcaattcctaatgtaattgatcaaattcaagcatatggagtcttatttactaagtggcatggtcactatacaataaacgtgacttcccccacttctacttcttctcttctaagttgaaaaaactctaatctctcaggtcaggctaactatttccttccctctttcctgccttctttctaatttgaggcaatagcatccatgagcccaggcgatgtcagggattcttgtttttatctcaacactttcattcttccccatcccctcacaggcccccattcagaattcttaagcatgctatttgcttgagggggcatttaggaagtcccatttaagacctctgccagctctaatcttatctcttcagagaggccttcgctgactatccaatctaaagtacctacctttatcagtgttctacactggaaggtattgggcacaggtgcaactaataataaagtgggtggtactttgttgccatttccatgttagggcctttgtgtctgcacttctctctctctctctctctctctctctctctctctctctctctcatgctctgcatctttaaatcactaaggtctcagctctaatgttatctcttcagagaggccttccctgactatccagtctaaagcagactcctcattcccaccaactcactccattacattaatcttttattttgttaatagctctcattgcatcccattactttcttctttatttgcttgttgcccatccctacctccttcccaaacacacttattaaaacaccatgaagacaaaaaggtattgtgctcaccacttgtttatccagagccaggtgcctgtccaaagtagatgcacacctgccatgtcctatggccaaccaggtccaatgaattcctttataaagctcctctcctcagctgacccagaacaccagctgctatactgaaggctttcacactttcagatgaggtgtctttatcttataaatttcttttctctaagcagaatttatataacctactcattactttgaatagcatcttattcagtataccttattggtatttttcagtaaaccctggtataaggcacacagctaagtgaatgtccccacatacctataagagagtggctagatgcctttcttacccacagggatggtttcaaagaaaccttttacactcactcccatatacacacatacacaaaggaaagctcacatttgcattccagatcatctccaggaggagggaggagaaatactcttttaaaagagcaaacctaaaattataatgctcttgaaaacattagtagttaacatttactgttaagaaagccacaatcccagaccaaagatagctgagtggcatcttaaattgaagatagtttttaagtcagagcttagaaagtctcttggaaatctctttaattcccccacagaataaaatatggtacagattctcaggaggtccaatagaggctttcctctagcattagaacagatccttctttgatcaaggatcagatgaagtcattggtgtgaatttactaggcatatattttttcatatataacagaaaatgtcaacactggaatctcactcagcactaagatgctcacactaagaggttcaggaaaatgagaatgactcccagaacccatctcacattttctaagaggcatatattcattgaggggaacgtctaacagaatgacctatattatttacatcagtacttcctactctcacttttttggccaattctgtgtgattaaattggcaaaagttcaatgcacacaaggtgcaactcaattatatttaagatcactcatttatgtcataaagtctttctcaaaaaacaaaagatgccagccccacagaactttatcatgtcacatagaccccattaatgcagtctatcaacaatatagacagattattatattcagggaagttccctcaagaattgccttacaagttcaatttaaaaaatcaaaataaaacaagccagtactgagtctttctatggtatagttaaacttgtaatattttatacatattttttgaaagtagccttgatataaatcctgaaaaaagaaaaaaagcaaagtccacatttctataagtgtcacgatgataaattttatgtatcaacttgactgggccatgaggtgcccagatatttggtcgaactttattccgagtatggctgtgagggtgctttggacacacttttaatatttaaatcaacagatgcagtaaagcaattgccctccctaatgtgtgtggacttcatccaatcagctgaaggcttgattaggacaaaaaaaagctgaccctcatgcaagaaagaggaaactcctcttacctgatagtcttcagctgggacactgattgtgtcctgcctttggactctaactgaaacactggctcttcctgggtctcaagcctgttgatcattggacagaaactacaccattgggtctcctgggtccctagcttgccaatgccagatctggggacttgccagcctccatagtcacaagagccaacttctcataataaatctctttctatacatatggatacacacatcctactgattctgtttctctggagaaccctgactaatacaaatattaaacccaaataaaaacccaaatgcaagtattaaacccaaacccaaatccaaagatgaacaactttcttcatcagtctggcacctaactgcatgtctctttatgaagtatgtaatattttttcatgagctgccatatgtcattccatcactcgctctagaactcttttaggcacttaaaactttgtatattatattaaaatttaatgtatcaagaaaggatatagtgagaataaactgaaaagagtagttactaatgccaaatataaggcagtcttgaaaaaaagaaatattcctctgtaatctcagtactttgggaggccaaagtgggaaggctgcttgaaaccaggagtttgagacaagcctaagcagcatagtgagaccctatcccctaaaaatcaagattttttcaaaaaaagaaatattccattttttcagtaaaaatattaaacaaatttcaaaaggcagaatggacagcttatacatataaacatatagggatatgaaacacatagttaaatatctacctatactttttatttcattaatttaattggatacttaaaaacatgtactttactcaaattcttatgtgagcatctcaacacatggtttattcaaattctgatgtgagcatctccaccatataagagcctcctttttagccctccaactgagttttccagagttttccacaaaactccaactgagttttcttcccttggttcaaaacaggacactccttgaatcatgtatgatggtgtttctgaaagttgtctctgaaggcacaagtacctatttatataatattagcagctttttcttctaaataaaaatatttctttgaacaggtatatattttgatgtctatgatgtatttgtctcttgtattgctttttaaatagacttttcaaaatcgctgtttggaacaacatccaacagttggaattgtgaagtcatagcccctggaatcatgactaactgtgttcaatttccctgctcctcttttatggatcctagcagatgaccttcacgagcacccaaaacaaaccttgggtgaagccacttcagcccactgtgacttcctaaagcagtatttgaaaggacccaaatataaagcaaggtcgtctcttctgagggataataaattcagggggaagcaaacctcacctttgtatttgaggatatctggtgtattttagtgcaattctgcctttaagataaagtgccagctgacttaatggcagttgtgatctctgcttcatttcatcttttatctaatgatccgctagttagtaaacctgcaaatcctgaaagaaacataagtactctttttctttgcagtgtaatcaccaacaataaagctttatttttttgcattaacattcaactgcaatgtatttaaatgttccacatacacaaaaacacctgatttttcccaagatttgttaaacatagtccctttggtgtccttagtaacactgcaaagatgtcttcatgtaaaacttaatttgagtcctgattaccttactgtgaaaaaccgtaaacaccaaacaaaagtaagcataatatccaaatgcctaaaacataatacccaggttgaaggaagtgtaaatgttcagattcaccagtgggactagaatgtaaacttcttgggttgtggttcctccaaatcatctggccacctgggtatcatatcccacaagcatatggtaacactgatagagtaagctcaaagtgttccaacaccaggacatttcatggccacatcagaccaattgtatttttcacttcctctctttccctaacttttctcatacaaagcttcctacatttcctttggcacttagtaatacttaaatgcatcttcactgtcttattcagtgtttttagctttggaaggtgtatcacttgggattgctttcagatgcattaattgcaatctagctaaccaacagcccaacagtgatttaaacacagaaagctttcttttccggatatgcatgtgtgcatattttgttttgtttttcatgcaacaagatgtctgaaggtataatctgacactgagctggtatctcatggtgtcatgaatgccccagcctacttctattttttttttttttttcctctgctgtccttcagtgaggctttcactttcattgtcatagacggctgctggatctccaagtttgacacattctccctaggcaagaagagggggaaaggcaaaggggaaagaggatgccagccaagtcagtctctttctaaaagctttccagaaagttccatccagtgacttccacatacatctgcccagccacaaatgggtcatacagtctttcctaactgtaagagagtgtgggaagctggatatgagctgagcattgctgctccaaacaaaatcagatttctgttaggaaagaatggatgtaaagtggatcttaggaagggaacaaccaatgcctaccatacacaagtatttgtggtgagcagacatggctaagtgcctcttcctatctagggaggttcagggaattactcaagatctcttttgtgccagggaactagggagtcagtcatctcatttgctttcatttcctcatctctgaaatttcctactatggtattcctcttagaacaccatttagaagtgttatggttttctgttcttaatccaaatgtgacaaaatgtattctccttcttctctgataacaaaacccaaattctgacgggcagcatgtgcttagccttagataatgaataatgactggtctaacccaatcatggcgatactatgttcttttgccattgattggtattcagtagtaggcatgtgacctagatctaaccaatgagtggacatacactggggggactcatgaaagatttttcacctttggtaaaaagtcatagttgcaagaggagaaagccttttcttcatatgcctcttctttcctgttttagatgctgtcatgttaacgctttgtgcttagagctgtagaagccgtcttgtgaccatgaggcaatagccaaaagaggaaagagcctgagtatgaaagacactgggtcctttatgatattactgagttgccaaactaaccctgggatcctctacctcctgttttctcatagtaataaatatccctgtgatttcagcactatcactttaattttctgttacaggcagctgaaagcattcagaactcacatactatcttaacatcatcttccatgtgttatgggccaagagtatattcaagagtgactacaaaactacattcattgtcgtatccctgtgggactcccttaaagttctagtgttctgtagtgtactttccacagcctagaaggatatatgtttccctctctccagccctaaggaactcttaatttaagactgacaagatgaatgagttacaatgagggtgaatccaattcaaaagacgtaacaacaagcaagaaaagcaaagaaccttgtaaacacccatgttatggagtgtgagagtgtaagcttaaggaggcttttattttggggagaagatgcatcacctctgtttgaatgagagaaattaagttgtaattatgatggtgtttcagttaaattatttgatgtggaagacaaggagaccattcccaacatgttatttagcaaagaatatggaggagaggcagaagactgtgatggaaaacgttcagaggccatcaaccaaaatggtaatgcattcgaggcagataaagttgcttcttgctagacagaggtggggtgagccctgacatacgtcttcaaaattgcaaaaggcacagatctgggggggaaagggggttgattcaccaaatctcagaatagcagaatggcaataaccctactccaaggcttccagttttcctcagtttaactccttttgcatactgcagccaaagagattttttttaaaatgaagatcactcagactgtgtcctcttcctcttaatctccccaaaggaagaaaaaaacaatgatcaatggcaaatggcagttgcaatgaagcaacaccaagaacgagcttcgtgctcgggagagaacattgcatatcttcctgtggtttccagtgctctacacacttggggaaactcctttaagtaatgaaccacagaaatgacccctggaaatataatcttcaaagtgatcttttaaagatccaaatatttcctgttcccactctgcccagagatcttcagtggctcactactgcttccatgataagatcctaaaaccttgtcacaatccacaaggccttcattgtccatccctgcctgcctcactgtctttatctcccaccacactctgccttctctatgctcccacctgacaacttcttcagtgcgtggaccctattgtactctctcaggcctcaaaaccatgtaacatcctggacttcctcttcactggtctaatgcctactcatacttggcttctgagattgtacttcactccacatggagattatccacaaccatgccccactccaaaaccaggttaccttcccaatgtgatatacttgccatagcactcagcttccttttttataatactcatcacacttgtgattgattgactctcttctcctttacattgtaagatccataaaggcaaggatcatgtctgtctctttctgatgtgtaacaagcctgaacatacatacaataaatggccaggtgtaatttaccattgtgtggatgccatcttgggaggggggattctaatagttcaagggcatgtatgaaaaacagactcatggtaaaataataagaatagaaaaaagttactcagagtggtttaatggctggggtataccttttactattttacttagacatcaaaggaaaatcagtgtcctccctatcatgttccatgattttgtacaactgagtttagagcacaagctaaggtatcagacagcatttgacagcccagcttcactacttatcagctgtgtgaggtgatataatccctctaatccctataaaccttagtttcctcatctttaaaatggggataatgacaaaagcttttcaataagggtttgtgaggattaaattagataatacatggaaagctttcatcccagtgcttgccacagagttagcatgcaataaatgttataaagagttctttattgttctgcccatcaacatctgagacagaatataaacacaactgctcctgggcctggtggctcatgcctgtaatcccaactttgggatgccaaagtgggaggatcacttcaggccaggagttcaagaccagcctgggcaacaaagcaagactccatctctacaaaaaatgaaaaaataggtggatatggtgatgtatgcctgtagttctagttacttgggaggctgaggcaggaggatcaactgagcccaggagttcaaggctgcagtgagccataatcatgcctctacactccagcctgggctttttaagattccatctcttaaaaggaaaaataaatcaactggatcactagcctataagagcttaacaattgttaggtagtattactatgggtgttattgttttgttatttgtggcaaaaagtactagtgctcacctgagcacatgacttccttatgatcaggtaggtccatgtttgtcttggtcactactccagcccagtgcctagcacagtgcttgacacatggtgtgtatgcaatgaacacttaatgagtacttaaagatctaaccagtatgatagtgcagattctcttgtaagcaaatgaatagagaaaggcagtattccacagagaaggagacaggaaaaaagaacaggcttgattttactaaaaagaaaaacacacttttaagcagtaaaattagaagttcccatttcaatggcacaaaatagagaactcactgagaattgtgtgctataacatggtcaaagcagaggccgataatgaagggagcagcattcagaaccatcacatgtatggtcagctttcagaccctgaaaactcgattaaaacattccaggaaaccgctgcactttcattctaaaggaagattgtgaactctgttcacatattacaccccttcatattgctttgtctaccagtgtggccttttatgaagtgagggcttctttcttctaccttgctccatgacaatcaaacccaaaatgccttccacccttaaaaggaagttttggtaagtgccttattataactatcacatatgacacaaggctcaccactaatcggagacagatgagaatgaattacttaaataggacagaaatagccattcacttcaagaaggtcccagtttcttgaaagtctgtggcattgagaccatttacagtttgctgtcaagattcctagcagtgctcattaccttggctagcaatccctctggactacagaaaacttatctgaaatatatataatcacaggctgcaatgcctaagtgcaacaggatgatttaaaaagcaccatgatagtgttcccccaggacattcatctctccctgtctattcatctttgatccagacaaaaacttggaatgcaatctgtatattgatattccctaaaaaggatttcaccagctctttaggaagaattgttttagcggctctggaagtctagaacattctgcatttgtggtatttacagcttttgtttctatttcataaaaataaagccccactaagagcagtattcaattcctatcccaataggagtatcgaatagtggttaagcacatgttttttggaacgaagcagacctgtgttcatctctgggctcctcatagacctcttcataaacttaggcaaggtattcaacctttttgagtctcagctatatcaggtaaattactatgcgtgcacagaagagcttaataaatgttagatgttaatggtattaatattgttttgctgctgttttcagtttttctagcagagattattagtattcacccatgtgcacaggtagaccgcatttccacccatgcacacaggtagaccgcatttccaagcttcagtggagttacgtgggtccaaatgactgagttccgatcaatggaatgtggcagaagtgatgtacaccctttcctggatgggcctacagaaatcctctagactctactcctcactctccttttcccttctcaggcaccctgaaggctacttgttaaagaatttagagctacaggatggaaagaacctggatcctacctaagaacctcctaggagagccacccttcagaaacatttgcagtggattctgaatacgatttttttttttttttttttttttttttttttttttttttgccgagcacggtggctcatgcctgtaatcccagccctttgggaagctgaggtgggtggatcacttgaggtcaggagctcaagaccagcctggccaacatggtgaaaccctgtctctactaaaactacaaaaattagccaggtgtggtggcacgtgcctgtaatcccagctactggggagactgaggtaggagaattgcttgaacctgggaggcggaggttccagtgagccgagattgtgccattgcactccagcctggtgaagaagtgggactacatctcaaaaaaacaaaaagatacatatatatgatatatctgatatatgatatatatatgatatatctgatatatgatatataaatgatatatctgatatatatacatatggtatatatgatatacatcatatgtatatatggtatacatgagatacatcatatgtatatatggtatacatgagatacatcatatgtatatatggtatacatgagatacatcatatgtatacatgagatacatcatatgtatacatgagatacatcatatgtatacatgagatacatcatatgtatacatgagatacatcatatgtatacatgacatacatcatatgtatacatgacatacatcatatgtatatatgacatacatcatatgtatatatgatacatatatatcatgtatatatgatacatatgtacatatatatgtatatatgatacatatgtatcatatatatcaggtatatatgatacatatgtatcatatatatcaggtatatatgatacatatgtatcatatatcaggtatatatgatacatatgtatcatatatcaggtatatatgatacatatgtacatatatatcaggtatatatgatacatatgtacatatatcaggtatatatgtacatatgtacatatatatcaggtatatatgtacatatgtacatatatatcaggtatatatgtacatatgttcatatatatcaggtatatatgatacatatgtatcatatatcaggtatatatgatacatatgtacatatatatcaggtatatatgatacatatgtacatatatcaggtatatatgaacatatgtacatatatatcatgtatatatgaacatatatacgtatatatcatgtatatatgatacatatatacgtatatatcatgtatatatgatacatatatacgtatatatcatgtatatatgatacatatatacgtatatatccatatatatgatacatatatacgtatatcatgtatatatgacgtacgtcatatatatcatgtgtatatatgatgtacgtcatatatatcagatatcatatatacacatatatcctatatgtgtatatatgatatatgtatatatgatctatatacatatatatcatatgttctatgatatatatgatatatatcatatatgatatatatgatatatatgatatatatgatatatcatatcatatatgatacatatgatatatcatatcatatatctttcttttttttttcagttaagctactgggttttgacgaagctcattacagcagttagcctacttcagggtttctcagcctgggcactactgatattttggactacagaattctttgttatggagggctgtcctatgcattgtagggtgttgagcagcatccctggcctctatcctgctagatgccagtagtaacctctccagtagccatgacaaccaaaaatgtctcctgacattgccaaatgtcacctgcaaaatcgcctccgattgagaaccagcagcccacactggccaaaacatcaccatcattgctatcatcatcatcataggatattgatagtctagtctctcatgttccccttgaaatcactgcaaaaggactcaaagttccaaaagaggtccagcccagtttttttaggagaaaaaagtgaaatgacactaaaatttaagaaaaggtaagggatcaagcagtaaactcaaagttataggagaccaaaaaacaaagtaagaaccaaaataaatataatccttttttaaaaaagctagtttgtgtagtcccagctactagggaggctgaggcaggagaatggcgtgaacccgtgaggtggagcttgcagtgagctgagatcgcgccactgcactgggcaacagaccaagactcggtctcaaaaaaaaaaaaaaaaaggccggtttgatcactttggtaacctagaataaaatgattaaaacaaaaacaaacccaaatatctgggtctaggaatttcaatgtgtctaacaaatgcttatagaatatctaccatgagataagcattgggctgaatataacttggtaaataaaacagatataatccctgccctcatagagatgaaaggtaaataaaaatatggagttttttgtttttgtttttgtttttgttttttaagacagtgtcttgttctattgcccaggctggagtgcggcagtgagatcatagttcactgcagccttgaactcctgggctcaagtgatcatccgtactagctaggactataggtttgcaccaccatgcccagctaatttttgtattttttttatagagacgcggtctcactttgttgcccaggctggtctcaaactcctggcctcaaggaattctcttgcctaggcctcccaaagtgcttgggattacagtcatgggccattgcacccagccaaaatatgatggatttttcaaacagcttaaacacagtcatgaattgaccactgcaataggcagacttctaaagatgtccctgcaggattcccatccctgggccgggcatggtggctcacgcctgtaataccagcactttgggaggctgaggcaggtgggtcacttgaggtcagaagttgaagaccagcctggccaatatggtgaaaccccctgtctctactaaaaatacaaaacttagccaggcatggtggtgagtgcctgtaatcccagctacttgggaggctaaggcagcagaattgcttgaacccgggaggcagaggttgcagtgagccaagactgcaccattgcactccagcttgggcgacagagtgaaactccctctcaaaaaaaaaaaaaaaaagattcctgtccctggttatccaattaaacactagattaggtgctgccatgaagagacttagcagatgtatcaaggttactagtcaaccgactttaacataggaaggttatcttgaattatctgggtatgcctaccctagtcacatgaggttgtaaaaacataagtggaaggtggaagaatcagtcagagtgagaaagcagaagaggatgcaggagctatgctgcagagggaaagtcagattccaaacacaagaaagaaaaagataagatgaatcattgatggttctaaaatgtaggaggctctgtgtgaggaccagaaagaggcctgagggagctaagggtggagccctgcctaacagacataaagaaaatagggacttcagtcctacaaccacaaagaaccaaattctgtcaataacctgaacgagtttggaagttggtttttctgcagtctccagtaagaaacacagcgctgctgatacctcgattttagcccagtgagacatgtattgggcttctgactgccagataataaatgtgtgttgttttaagtcactaaattcatcatagtttgttatgacagtaatagaagactaataaaccattatgcattaaatatcacagaaaagaaagggtttaagaaaataggtattaaagtatgccttatcaccttatcattcatcaatctgaggtttactaaacacttgatgggtgctcattagtggaataaattaatgcactcatattttcattcatttgttaaaaatatgcatacagtgcctcctctttgatggtccctgggtgaggtattgaggttacagtagtgaaataggtattatcctctgtttataacagctcataatggaagtggaggacagaaacatgtacattcaacaataatgcaaagaacataataaagatattaacatcatcattataaaactatcagtaaaagtgtgaataagggagtacagaataataattacagctgacatctattgagtacttgtctcatttcccttcacaacaagcctatgagactgtattagtccattttcatactgctatgaagaaatacccgagatgggataatttataaagaaaaagaagtttaatggactcacagttccacatggctgagaagacctcataatcatggcagaaggtgaaggaggagcaaaggtacatctcatatggtggcaggcaagagagcatgtgaagaagaattgccctttataaaaccatcagatctcatgagacttaatcacgagaacagcatgggaaaaacctgcccccatgattcaattacctcctacccactgggtccctcccatgacatgtggggattatggtaggtacaattcaagatgagatttgggtggggacacagccaaaccatagcagagacagacccatgattcataccatcttgcagattaagaagctgaggtacaggcaggtgaagaaaccagcctaaagttactatcggtaagtggtggagctggaattttaacacaggaggtccaactttagagcccatggttttaaacacttcattgtgctgtctctcattgcagaagggtgaggaggcctcacagaagggctgagatttgggatgaataccttcatcaagaaaaggaggagccagtagaagaaactgcattggtaaagccagagattcaggaagaaggtggatggtgtggcatattctggaacagggctctgtattggcaaggaggggtggcagatgaggttggagcctaagttgtcctgacttgaaagacttgaacctctcagcagtttgaatttcgttctaaagctatcaaaagaacctattcaagagcatgatacggtaaatcatcttcagcaactcacatatcatttttaacattgtttcaggggatattagtggacactcttaggaacgcagtgtatagcccacaagtataatgacacttattaatacaacttagaaaacaccctttgaaaatgcatcaaaaccctaaaagattcgattaactctatggaaatgaggataaagggtagatgcatgtaagaatccagctgtcttctatctacaaagctcttcatatccacaaccacagagacactgctcagcttctgaatcgccttagttcacaataaaatagaaataaatcataataaaataaaatagggaataaatctatctgttggctttgagaaaatttctcagtagcaacaaaccaactgctcaaatcagaatcccccaaaataaataaataaggtacctaagagggaatgcatgtgttgaccaaaaaactaaaaaattctcccatttctgtctgacgttgaaaaaaatcataggtatttggcattttagcctatgctgttgaatgtggtagccactaattatatgtggctatttaaatttaaataaggtaaaattaaataaaatttattttctcagtcccattagccccatttcaagtcctcaacagccatatgaggccactggccactgtactggtcagcacatgtatcagacatgtccattgttgcaggaatatctgttgggaaaaaaatgaactacttatttagataaaagtagtgatttgttagacatgcctaataaaattcagtttattttaagattatgtaattaaattcagacttacttataagagtctgaattttcattttaatcgtttgtatgtatttcattcctcttagtatgaagagagtctatatcaagagactctctatggagacaggagccagtttgtattaggccccagctctgtcttgggctctgtgctaggcatttcatatctgttatgctacttaaggctcatgactccctgtgagataggcatgcttattctcatttttccctaaatggggggctgtgacaaggctgaagcaaagagagggcacaacatcttttcagggttaacacttgagaaacatctatttcttcttaagtagctctactgctgcttagagaagtagagtatgtagacaagacagttaaattttccacagatggggtttacttagagggagataagatttcttttgcacacaattgtagatttttttttaaatggtcaaaatcctcctgttctagcagtagctaagaagtgactcggggaagcattcaacaagtaggaaagaagtctgctcagatggaggccctgaatcagagatgcctgtcatctgttcccaaaggctccaaactcctgccacaaatacactgagggttcctctctctataacttcttctctttattttctctggaaggaatgtacttgatacttatttttaatctgagtctccttccacaaaaagtgtagaggatgtgctacccagcccctaaagttttgcctcttggtattcacacttgtgaagtcattttccatgtggaagagggctgacctgtgtaagcaataagatgctgcagaaatgtatgacttctgtggctaggttagaagagccatgagtccttaaagctttcccccttttctctctcttgagtggctgtctctggaggaagccagtcaccattctatgaagttactcaagcagccagtggagaggcccacatggggaggaactgaggcctcccaccaatactctccatcaagctgccaggcatgtggtaccttagaagtggatcttacagccccagtcaagccttcagatgactatagagccagaaccactctactaagcctgtcccaaattcctaactcaccaaaataacatgagatagtaaatgtttactgcagttttaagcagttgagttttggcataatttgttatgcagcaataggtacctaacccagagggtttttccagctttgcctatgggcaagtctacagatgaaacaagctgcttttcatatttagtgctctctctcacaattatcaggagatataattatcttaccatccaggctgtgattcttgcacacaagcaccaagtcatccattattgcagtctcccttcccatgcttgatgaataactgggttcctgtgatttttcctcttttctttccccattgactgttgaaattgtttgcctcaactattgagtcccttctcttcagtttgcctccttttcttttcctcctacatgagcagaagccaggaaattgaatgtattcgatcacaaagtatgcatgaccctcagcaacatgagcctacaatagtctttttaatgaccagaggaaggttgtgaggactcttagttaatttgttatgaacacccactcccataaggaagctgctatgtatttgtggaataaattaaataaaatcagcaaatttgcttattatctatttcctgccctttgaacacaggtttacccataaactacatttgttacacactaactgaatatggaaagcactatgggtaatgcaaaaaatatagcttgtctgttttcagtgtactcataagcaaatataggagacatcacaaagatgcaaatatgtattcatattcacatacatgcttaagtagacatttacatatcaaagacagtgaaggctaagggccaaatgaatggtacacacaagtgttaacagatcttcaaaagaagatgttatggctgtgagctgaattgatcagggcagcctttatgcaggaacaaagtcttcagaaggtttaactatggcagatactattacagatactacttgtttcatccagttctcctttagccccaagcatagagactcctgcacatctcagcctcttatgagtgggcaggatcatgtgactagctctacttagtggggcacgagaaaaagtaacatgtttcatttcttaagtcaaagaaaaaactatgtttaattctccaatctttctcccccaaaagttcacatgctctggggtaactagaggatgttagtggctccctcagcctgggtctatctgaatgactacaataagcagagccccctgacaactttttttgggcatgtaccattagcaagaactaaacctttctttgtgataggccactgtgatctggggactcatttgttactgcagcataacttagtctctcctaactaaaacagagattcccaaagatggagaaaagcagagcacagtagaggtagcttataagtcatgtcttatatgacctttctcaatgacaaacctgtgtgctcaccaagacatagcttgttatgacatatctgaatagaattgaaggtttttaaataaaaacataagaaggttggaaaggcagcagaatgagctactgcctgtgggtgatctttacacatctcagaataacaggattattgatgccttggccagaagcattcctttccctctgttttctttttctttgagattgcaagccatatatttccatttggaaaacagtatttcataacctctaaacctaacatgagtcctgtgaaaccctagtctacagttgaatggccaaaaataaagacttgaaattccttcaaagctatcccattttacaaggcaatgctttctctctctaccaagaaagtgttcctgcttgatagattcccctctcttgctgtatattacacttactgctctcctgtcactccctattctcttcctagttgtttgtgccttattaaattccacattttgaaacaaccaataagaatcagaaagcctgaagaagccctttctcatacaatcagagctccctttttatctaggaataaattatattttccaatcaattcatgagtgggattcattgacaatatactctctttgtaacatatttctgaatgagtagtaaatggtcttcaataaggatatggcgatacattttagctaaactgtttcataccgacattaactcccctgttaacttacttaggagtctaaagacacaatcaaatagctgtttctgactattattctcaaagcgaagctccaggccgtaatctcaggacatgcatgaaaatatcaagtaacaactcaaaggcccatttcagcttcaaatacctttgaaaattcgtgagtttgaggagcagagtgggatagcaggcgagtggaagaggaggcttctgagaaacttaattatctacattttagaatgtttcagtctttggccttttaatactgtagtatagcctggcttctgtcattctgaagggatttcccagcttaacaaaatcccaaggaaccaacctcagattggtctcttacctaaggaaagattctggcaacacaacaggaaggatttggaaaatttaatgaagattttgaaatacccctaacacacttaaattaaagataatacctatttcacccaaatctcctaaccccctgtggaagatcaattctaatttttgaggacaattattcatgtgttattggcttgaagtacagaatgtattagtaagtctcttcagttctaagtaacagaaaccaaatcaggctaggttaaaattgaaggggcatcattagaaggacccaagagtgtctcaaggactcagaggcaaagatgcagccagttccccccagtgccgggaaccagaaggtgggcaggaactcagggaatacagcccccttctatctctgcttctcaattctcatagggaaatatggttgtccacagatctcaggtttacctgtcatagttctagccacatgcaaggaatgactgcatatctctgaattccaaatttcagaaagtgagaccttggggtgggagatggggcacgcttggattcggtgtctaactctaattcaaacaacttttgccacggagccatgtagtagccaaatatgtttctaaggcccaagggaccactcttacaaagatggaagatagttcactaaaaagaagacatgctttctagactccacagccaccccagaagtgccaagataaataatagggagccagagtttaagcaagggccaccatcactgcaagttgtctcatccaacttctccctttataggaattgacatgacttcaaatattcatgtctgacaccaacgaagaggaatgtctgttcttgagctctttttctcggttcccaaggggccctcagtaccctgctttaccatttagtgtggattctgacaaaagaacaaattaagtactttgatttgattcttaatttttccttataaagacttgcaataaatattgtgggtacctagaaataatccaccatagtgcacaacacaatctgttgacttaccttagcttccattttccttcttggtctgacatataaattcaccttgctgctcaattctgtcacctactattttcagcatgtatgagcaacagtaaagtgcatgcccacagaactcagaaatgagaaaactaatattgctctgttatatgcataatggatcaatacagaggtatttaaacacacaaagaaaaaaaaaaacaggtcagcaagacttgactttcaactgatagagaatattaacatgtttatgggtagaaaaagtggtcagttgtagaaaaatatacaaagaaaagctacaaagagatgttggcagtggccatttaagctctgtctagggaaaggaagcctttagttaatggccttcaagtattctaatgtagggacacggcacccctactgtggaaagagatgcaggaggtggaaggtagctaaggccttggagtttcagttccacaggcaaggctatccttatcatgagaactgagcagcatgaagctatctgtagtctgacagtcatattgtatgttgtgtcaaatgaaaacatagcatcactcaattccttttgttctcttctcttgctaaacacacaactatctgatgctctggcttcccatggacctcaggcctgcttagaggatggaatgcaatagtcccactagtctgtgcagtgggccaactgctggttgtaaaatcacaaaggggccttctaggttaccgcgtctcacaaacttgggtaatgtaattccgtcttgaagagagagtcccccatgggtaagaccatggaccatggtaaatgagtgtaccccaggagaactgcttgggaaatagtcacttagcctattctcctggtgatgccccagacattgtcaacatggaccccttggagcatttcctcgttgatgtctacatttgttaccttactcttaattaaattttctaaaaagatggcacaataggagcactgagaacatgatttttaggaagaaaaggaatcccatgtaaacccgtttccatctgtggttcttgcctttctgtccttatccatagggcagctcattcttgcatatctgcagctcttgcatgcctgccattttgtatcttcctttttctcgttatatcagaagcattataataagttacattagaacccgttttgcatattttaacattgccttcacagtgaaactatagagagctttatggtggcactctagtgaatattctgttctgcttctgttacatgactaccttaggaaaagtctccgagaactcctgtctcccatgattatctctcctaatcaggctttctactatcaaactactcagcaaaaggaactcaccaacctatagtgctaccagaagtctaataacataacactgtcaccacaactttttcagcactaaacatgatcatttttaaaaatagtaagtttattaggtatataatgatactttccaagttccagcctgtttataaaggactctgtataaataaggaaggggcccaggaatggtgacatatttaacgtgtaagtcaggatgctaaatgtctgactgtatttgtttatttttttctgaaatggagtcttgctctgtcacttaagctagagtgcaatggcacaatcatggctcaatgtagccttgacctcccatgctcaagtgatcctcccacctcagcctcctgagtagctagaactataggcacacaccaccatacccagattttttattttttgaatgtatttatttatttatttatttattttttgtagagacgaggtcttgctttgttgcccaggttggtcttgaacttctggactcaaatgatcctcctgcctcagtctcccaaaggattgaaattacaagtgtgagccactgtgcccagctcctattatatttttaaaaggaatatactgaggaaaatacaaatggagttcaactgataaaaagaaacctctgtaatatgagcaggtgaatacaatttacaagatcatacttcagtatgaattcagtaggaattgcatgttttgcctgctgtgtgtccctaagggtgacacactcctgaatgggactttagtttgccataagcctgctttgttttgtttgtggtagaaattccatgctatgaggaaatgctttcatttcttttgatatctcatgagcgcttgttgcaaaaaacatttgtaggcaaacagcttcacacatattaaaaacttgtagcagaaagttaattccctaacataagttgtccagctcagggctctataatcctgtaattcattttggttccaataaatacgtactttctgtgagaccctttggggaaagggtaattagatatttcacatcagtgggatatctttccttcttttgctccccctccttctttccttctccttttcttctctttaattcttctacccagaaaaattctcaaggagcaaaaatacattactctctgcatttttataagctggccagttttgcttcctggcttttgaacagaaaattatgcctcaaaaataatcccacattattctctaaattcattttcctcagtcattagcccataacggcaattttccttttgaaaataaagaataatgatcatttattgagacaaatcctcaatcagaatgattcaaagagaatacaaatttaatgatcaccctgagaacccaagtaatacatctcaggaaataataataaaatttatgatggccttaaaattgcttaactcctttcaggaaaccctgaattatagggtagtaacataaccaaggactggcaacaactcacaaaagtctagaagagttttgcctttgagttcatagacaaagatgcttaaattgttccccgttcaaaaaataaagattatttattatttactttcctgtgcaccggacactcctgcaacatgactataactcttgcgttcttagatttgatcttcaaggtctctgaatgatgaaaaaacttgtagggtagcatgccaaccaacttgggttttttgtctgtttttgtttttggaggaggggaacaaggcagggagagagggagagggagagagagagagagagagagagtgagagatcacactaccaggagcttcataaagaaacctgcaatgcagaaccaaagtggatgaaagcaaaaggatacaacttttccctccagatgattttactgggaggaagaaagatttgaaactattgagtgctttttctgataaccacctatggctctctccaaagacacacatgtaaagttgggcaagttgttttctgtcatgtcaggaaaatatttagtagcagtcttacaaaagtaagcactcagcgccgtcccagggagctgtggatttgctgtgcagccttgtttccttcaacaggttcctttgttgctttgtgtgttctcccgacaaagggcctgcccttcttctacagatgggtttaccattctctctgaatgaagactattcagaagtacacaaaccaacaaaccatccaagctgcctctatctgatggtcctggtatatccagagtactaaatagtggcctacaggatgggaaattcacactgactgactccacaggagactgagaaagcttaactggctgatagctgtaaagtcctttgaaggaacaagcactgtttaaaattctaagtagtaatcttataatttgctaatggaaagaaatataacccagctaatgtgtgcctcccatttcagagagtatgtttcaacagcaaagccctttacaatatttagataaacttcgatgtatagaaagtgcaacagcaaggtaaacagcagggcttcccgctatggcattttaaaatgtggtgggtgaaatttgtcactcctaagcaagtgcctatagtaaaaataaaatatcactatttatatggtatgtgttaaaaattgtccactctccccaactacaccagatcaaaacctcttgttttttaaattatgaaattattgaactgtattgagcacacccctacttatgagttgtgtaacctggggcatgatattgaacccctctgagtcatttcctcatctatctagacaaggctaatggtaatacctacattgtagggctgtcgttagaattttaaaataatttaataaaataaaggctagtatttattaaactctaaatacatgtttgctgctatcagcagcagcagcatcggtcggcaatcacgccaacactcctcaaagaaaacagttctgaaaaggctgtgtgcatcctaggtctgaagattttcttggtctaaagagtctcttgggctagtgaccaaatccttcattaatttcaagagctctgggaactctctgaaactgaatgtggaatggtataactactggtctgtgcacatttttctagaaaacctcacatctttcatcacattaagaggttaagaatcattgccatatgtagtcattagcttacctttatctactttctacttctaacggagaactagagtcctgtttagaacaagtaaccaggacagggacagaagaaggagactatgcatctgtcactcttgctgattagtctccaccctctcccagcttctgcgggcctcctctcccaagagttgcgatcctagacccacctcccatctgcagtctcaacctatcctcttctaaggactaatcatggcatatggcaggagagatttaagactagctaggtcaatgctctaagctcaacatcaagtcacctctgaggcagggtgttgtcatggaatgatcatgacctctgaaataggaaggtctgtgtttgatttggcttgaccacttactggacgtgtgaccttggaaacgtttacttaatcatgtcttttgtcacctataaaataaatacaataagatttacattgtgagtctatgagagagaaatgagataatatagagaatatttttaaaatgggagcatatgtcaggcaacagtagatgctcagcaatgttcttttcttacctgggcttcaacctggcacccttggtcaccttcccaggacccaaatccctctaggaataaactctggcccttgctggcttctttattcttcctcccacctacatacttgaacccatccaaagaaataggtctgactaccttggaaaccttttctgatgcttactacttgtccaacattcatttttctgtaccatgtgtgtagatactggattccccatcctagaattctacccacctcttgggctaccctgttacaatgtgtgactgactatcctactcccactttccaagttaaccacttaattgaatggctgcccatcaacatactccttaaatgccaagttagttctgtcaaacccaatccacagacaagccttatcctcaaaccttttctgccctctgccacagtgctaactggttcattgtgcttgttcagcatgcagggacctttaatttaatgggcctctcccatttttcacatatcatgaaagttatcaaatttaggttaattaagtttaagacatccatagttattcgagtgaaaacttgaaggcagcataatggataataatggtaaaatgataatttttgagctcttagtagatgccaggcatagtcctaagcagtttaaatatatttttttcatatgattttcataacaatcctacatagtagattatgatcattatctctactttataggtgaggaaactgagacttagagaagttaagcaaatggccaaaagttatgcaggtagtaagtagcagacatagaattgagaagacagcccccattctaaataagtatgaaaaatttcagggtgtcaatttttagctaaggaaaacttattcatgtgtgtgtgtgtgtgtgtgtgtgtgtgtgtgtgtgtgtgtaaatgaatagatattcatttacttatatatctatttcccaggcctcaatgcaatcagagatctctgaagaagtgaccatattatgaacataaatttttgacttcataactttacagtgataaataacctcaggttatcaggatcctaaccttaaaccacctgagattttatcactgttcctttagtaagcaagggatttttcaaccctgagacagataaaaaatagattgtatggtcaatgaaatccattatattcatactttttggttgagtttaggtaatggaacaatctgagaattttgtatcaagtatttgtgatgtttaagaggatttatcatatttaagaatctgacagattgcccctgcaattagaagtacaattgattactgacttctaattttaggttaaaaagtttaacagaatttgatgtttttaagtagtactgagatgtttaaataactgaatttattctttatgagtctagtatatttgattcaaaacatggcttcaaagcttagaaaggttttgcttgttaaggttgtgagcttgtactgccaagtattcgaagtgtttacaaagaaagtaaaattgttaaatgtgtaaagttattttaaaatattgatgaatacatttaacaagtaaatacaaaagtgtatttaagtagacattattcttttatggcattcataaattcataaattgcacaagataacctgagttgctctaaatgcttttcaaacttaagtttaggggagcaacatcagcaagatggctcactagaaactccagcactcatcccttccacagtgacagccaaaacaatgaataaacaactacactttaatgtacataactgaaggagagtgctagaatacatcaaaggagtaacagaaaccctggtgagcacagaaactcaggacagccacaaagagaatggaaggaaacatcacaactccaccaccctatccccagctgagatgagccagaaacccagaggaaactttccctataggaaaaaggcaagcaagaggattccagtagcctccaccaacaccttggacacccacagtcctcactactggagtccttgtagtcttcactggcactaagtccagctgagggagctgcctacaggccacacagccacactcacctcagagaaggaactaatactgtgctctattccctgtagcccacatggcaactgtgctatatcatcttagaactggaactactgctgaagtgtgattttctctgagggtgagcaggcttgacacccctgcctccataaggctaagctgcctccaaaccaccccaaaccagtggccacagccaagctgccagcagctgttaatgcctttccccatggagccaaacagtgaaaactgctctacctgccctccctcaccttcacctgccctctcccttcacctgccctcttgtgctagagatgaagcaatacattccctcctggggaaacagtgctttggcagaacagctccatctgcttctctccgctgcaactgtacactgcttctaggggtctgagccaaaatggcacagtatctcccaaggaaatagtgctttggtaggaccctgtatcccaggtaaatggtgcctgggccacacagaacagtcatgcctgagttaaagtgtcacattgccccttggggaatcattgccttggtcaagttaaacaactgtgcatcccagggctgagctgatgtagtatcttgtgtcccaaggaaacagagtagaacatgacctaagacagtctaccctactggacaatctagtaccctgctttcctgaagctggactagcccactagagtctgaactgctaagacctgctgtttcctggggagtggactcatcactgtgctactccctgccctccaggacccaaacaatacccatgctcagtcattctagggtacttgctgccactgcgcctggccacatggagtctgggatacagatatgccccaccattccaaggtctaaatttaccactacatagttcttcattctcagggacctaagctgccactgaaccctattggcttaggctcctaaattatagctgtaccatgcatgctgtgctcaaacccctaaaactctgcttctttcccagagctgagccagggctgtatcctattccccaggggtagaatcacagctacaacctgacccactgaatcaaagctggtaggggctgcctaacagtcatagattctggctctgtgggaaacctatatttgacccagctacagagagtgaacctgtaccccaggacccaagagccacaataggcttgtgaaactctgatattagcaccctgactccatagccacttcaagtaccaatccctggaactcaaagcaatggaactgcttgtaggccatgtaagagggatcctcttgtttaattatccccattgtgaggaaaatcagaataggaggaccccaaaagccctgccactgaggacattaacaacctatgttgtcactgccactaccatacccctttttttttaattatactttaagttttagggtacatgtgcacaatgtgcaggtttattacatatgtatacatgtgccatgttactgtgcggcacccattaactcgtcatttacattaggtatatctcctaatgctatccctccccctgcccccaccccacaacaggccccggtgtgtgatgttccccttcctgtgtccatgtgttctcattgttcaattcccacctatgagtgagaacacgcggtgtttggttttttgtccttgcaataatttgctgagaatgatggtttccagcttcatccatgcccctacaaaggacatgaactcatccttttttatggctgcatagtattccatggtgtatatgtgtcacattttcttaatccagtctatcattgttggatatatgggttggttccaagtctttgatattgtgaatagtgccgcaataaacatacatgtgcatgtgtctttatagcagcatgatttataatcctttgagtatatacccagtaatgggatggctgggtcaaatggtatttctaactctagatccctgaggaattgccacactgacttccacaatggttgaactagtttacattcccaccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcaccaccatacacttttacagcctaagtcattcaggcatccacagttactgttgacactgaatgcagctgaagaaactgcatagatactataccactgaacctacctggaaacaaagtcaccacacttttcctaattagcacactaagatccaactacaggtgaaagtctttctctgcaaaagccactctagaaagtctggaagaggcaatttttccaccaaatgcatagacattgatgtagaaacacaagaaatatgaaaaagcaaagaaatatgtcaatgccaaaggaacaaaataactccctagtaacaaaccctaatgacaagaaaatcaatgaattgccagaaaaggaatacaaactagtactcttaagaaactcaacaagatacaagaaaatacagatagacaattcaacaaaatcagaaaaagaatttattatataaattagaaattcaacagagatagatattataaaaaataattcaattaataaaataaaaaatacaataggcagcttcaagaacagacttaagtatagaaaacaatctctgaacctaaaaataggttatttaaaattacttagctagagagaaaaaaaaataagaaagaaaaagagtttttaaaaaagactacaagacttataggacaccattaagtgaacaaattttcatattatggcagttccagaaggaaaagatgtattaaaaaaaaaacctaatttaattatctaatagctgaaaatttcacaagtctggatagagatgtgtatatacagatccaggaaactcaaaggttcccgaatagattcaagccctgatgcacattatagttcaattgtcaaagtcaaagacaaagcaagaattctaaaaacaacaagagaaatgtgtcacagtacatttaagggaatccccattagactaacagaagactttcagcagaaccttatagaccaggaaagaacagaaagctacattcaaagtactgaaggaaaaaaactgtcagtcaaggatactatatccagcaaatatatcctttagaaatgaggaagaaataaaacgtttctcagagaagtaaaaacagggaattcatcaccactagaacagttttacaagaaattctaaagggactcctgcatctggaagcaaaaaatgattatcactactaagaaaacacacaaaagtataaaactcactggtagaggctgagcatggtggcttacgcctataatcccagaattttgggagtccaaggtgggcagatcacctgaggttgggagttcaagaccagcctgactaacatggagaaatcctgtctctactcaacacacaaaattagctgggtgtggtggcacatgcctgtaatcccagctacttgggaggctgaggcaggagaatcacttgtacccaggaggtggaggttgcagtgagctgagatcgtgccattgcattccagcctgggcaacaagagtgaaactcatctcaaaaacaaacaacaacaacaacaacaacaacaaactcactagtagagcagatacacagaaaaaaagagaaaagaagcaaaacttatcactacagaaaatcactaaaccacaatgataaataataagagaagaaagaacaaaggatatgcaaaataaccagaaaatagttaacaaaacgacagaagcaagtcatgacttatcaataataaccttgaatgttaacagaataaattccccacttaaagacatagactgacttaattgatttaaaacaaaagaaaacaaaaacatgatccaactatatgctttctataagaaattcacttcactactaaggatacatacagattaagagcaaaggaatagaaaaagatactccatgcaaataaaaataaaaagcgagcaggagtagctttacttgtatcagataaaacagactttaagtgaaaaaactgtaaaaagagacaaagaggatcatcatataatgataaaggaatcaattcagcaagaagctacaacagttatatatgcatccaacactggaacacattgatatataaattaaatagtattcaatccaaagggagagatagaccccaatgccataatagttggggaccccactctcatcactggataggccatctagaaagaaaatcaacaacgaaacattgagtttatactgcattttagctcaaatggacctagcagacatttacagaacatttcaactgacagtggcagaatacatattattttcatcagcacatggaacatcctcaaggacagatcacaaaggccacaaaataagtctcgacaaatttaaaagaagtgaaatcatatcaagtatcttttctgaacacaatggaataaaactagaaatcaataacaagagggacttttggaagctctatgaatacaacatgctcctgtataaccaaagactcaatacagaaattaagaagaaaatttaaaaatttatgaaaatggaagcacaacatatcaaaacttatgagatacagcaaaaacagtgctaagagaaaagtttataacaataaacacatcaaaagagtagaaagactttaaataaataatctaacagtgcaagaacaaaaatgaaaacaagaacaaaccaaacccaaaattagtacaaggaaagaaataacaaagatcagaggagaaataaatgaaattgagactaaaacttacaaaagatcaatttttaaaactttttttgaaaagataacaaaattaacaaaccacgagctaaactaaccaagaaaaatgtcccaaataaataaaattagaaacaaaaagagagaccttacaactgataacccacatatacaaaagatcattagagactagtacaaacaactgtacacccacaaattggaaaaccaaacagaaacaaattcctagacaacctaacaagattgaacctagaagaaatagaaaacctaaacacaccaattacaagcaacaagttgaatcaataattttaaaaatgttctatcaaagaaaagcccaggacctgatagcttcactactgaattctaccaaacatttaaagaagaactaatgcccatccttctcaaactcttctagaaaataaaagagaagggaattctttcaagctgattctacaagaccattattaccctgataccaagccagataaggacacaacaaaaaaaggccaaaatccctgatgaacatcgatgcaaacatcctcaacaaaatactagcaagttgaatccagcatcacattaaaaagaacattcaccatgatcaagtgggatttatcccagcgatgcaaggacggttcaacatatgctaatcaataaatgtgatacttcacattaacaaaatgaaagacaaacaccatatgatcatctcaatagatgcagaaaaagaaaagaaaattcaacatcccttcctgataaaaaccctgaacaaactaagtatagaataagtgcacctcaacatagtgaaggccatatatgacaaatccatacctaacattatactgaacagggaatagctaaaagcttttcttctaagaactagaacaagaccatgatgcccactcccaccactgttattcaacataacattggaagtcctagccagagcaattaggcaagagaaagaaataaagggcattcaaaatggaaaggaagaagtcaaattgtccctgtttacagatgacataatcttaaatacagaaacccatataagctgtaccaaaacattcttagaatgagacaacaaaatcagtaaagttgcaggatacaaattaacatacaaaaatcagtaccatttctatacaccaacaatgaactagtgaaaaaataaagcaagaaagcaaccttacttacaatagctacagaaagaaaatataaaatacctaggaataaatctaaccaaggaagcaaaagatctctacaattaaatgacaggacactgataaaagaaattgaagatctggttacaaaaaaaggaaaatatcccatattcatgaattggaagaacttatattgttaaaatgacaatgctaccaaaaacaatttacagatttgatgtaaaccttttcaaaataccaatatcattcttcacaggattagaaaaaatcctaaaatttatgtggaaccactgaagaccccaaatagccaaagcaatccccagcaaaaagaacaaagctggaggtagcacattatctgactttaaaatatacaagaaagtgataataactaaatcatcatgttactggagtaaaaacaaacacatagaccagtggaacagaacagataaatcagaagtaaatcctttaattatagcaaactgatttttgacaaaatgccaaaaacattgagtgtgcaaaggacagtctattcataaatgatgctgggaaaactggatatccatatgcagaaaaaatgaaactagacctctgtctctcacatatacaagaatcaaatcaaaatggactaaataattaaatgtaaggcctcgaactataaaactaagaggaaaacattggggaaaatgcttctgggcattggtctgggcaaagattttttggataagacctcaaatataaaggcaacaaaggttaaaatagacaaatgggattatatcaagctaaaaagcatctgtacagcaaaggagacaatcaacagaatgaagagacagcccacagaatgggagaaaatatttgcaaactatccatttgacaagggattaataaccaaaatatataaggaactcaaacaactcaatagcagaaatgctaataattcagttttaaactgggcaaaagacctgaatagacatttcttaaaaggagacatacaaatggacaagaggcatatgaaaaaatgctcagcatccgtaatcctcagggaaatgcaaatcacaaccacagtgagataccatctcaccacagttataatggctactatgaaaaagacaaacaataacagatgctggagaggatacagtaaaagaggaatgctagtgtactgatagtgggaatataaattagtacagccattatggaaaacggtatggaggttcttcaaaaaaactaaaaatatctacaatgtgacccagcaatcctgctgctgggtatatatctgaaagaaaggaaatcaggatattgaagagatatctgcatacccatgtttactgcagcactattcataatagccaagatatggaatcaacctaagtgtccatcagctatggatgaaaagataaagaaaatgtggtatatacacacaatgaaatactattccgcttattttatacaattaagcctaaaatatattttaaaaaataataaaatcctatttgcagcaacatggaactggaggtcattatttttatgtgaaataagcccaacacagacaaatattggctgggctaagtggctcatatctggaatcccagcaatttgggaggctgagggaggattatttgagcccaggagtttgagaccagcctgggtaatatggcaagattctatctctataaaaaaattaactggctgtcctagctacttggaagaccaaagtgggaagatcgcttgagcccagaaaattgaggctgcagagggccgtgtctgtgccattttaactttactccagcctaggtgacagactgagaccctttctcaaaaaaaaaaaaaagaagaagaagaaaaataataagaatgacagacaaatattacattctctcactcctatgtggaagcttaaaagtgtggatctcatggaggtagaaagttgatgggtgctactagagcctggaaagggtggcaagaggggtgaagagaggttggttaatagatataaaaagacagctagatagaaggaataagttctagtgtttgatagcacagcagggtgattatagttaacaataatttgttacatatttcaaaatagctgcaagagagaatttgaaatgttcctaacacaaagaaatgataaatgttcaaggtgctggatatcctaattaccttgatttgatcattgcacgttgtatgcatgtactaaagtatcacatgagcctataaatatgtataattattatgtatcaataataaaaaacattaagtttaaaatatatctttaataaattaaacttttgttaaaagcccaaattatagtaaataaacccttctgcatacaaaaagtgatctattagccactgaaaatcttataagagagtttttatgacagacttatgagcaataataagtattttaaaatataaatcagatcatgtcatgccttggcctaaaactcttcattgtttaacagttactcttatgagaaattccagtctcccagccaaggtctatgaaactcttcaaaattgactcttgtccacttctacctcctcaccaattatcaacctcactaccccagtcactttggccttttttcctctttctgatacatcatgagcttattatggcaacaagtcttttatatttgttaacttctctacctggagtacttttcccaaaatattttgcaaggtgggctcttgcttgacatttaactctcagctcaaatatcacctcctccagatgcctcctctaattgtcctttacaccaataacctctgacacattcatatgttttacagtcttaggaatatcctcaatgcctgacttaccatattcatttattggctcccatatttatttccccctctcccaaataaaataaaagctcaatgagagcaatatcttgtctttcctaaaccattgcttggcacatattaaatgctcaataaatatctgttgcacaaatgaataaacttaaataaataaaacacatctttgccttaataccaagttatttttaaatcatatccttatgtaatatcgaatccataagactcaattatctggggtttatttgacaaatttgattatcttatttgggggttaataccatgaatggctaaaaataggccaattgccaagcagagcacacaagcaaatatgatccctccccaggatgcttgccatccaaattacaagcattgaaaaatcttggcaaggcgcctatgctaataagaaagtgatccaatattcatgagaagaacttgaaaaactattatttttgcctgcaatcttcttggcttttccataattaatatgtcattatcatcagaaggctaagagatcaagagtggtaaaagcaacctttcatgtaatactcatagggacaatggtatttagcaaatatcacattgacttctggtaagagaaataatccagaatctgtggttgctagaaacctagtatatggaaaaaatagaggggcagttggcatcaagacagaaaggtagggttttaaagctgatctagaggtagaaaaaaacacattctagagattcctgaagaaacaaattccaagtactcattgtcatgaaaaacggtatgatggagtcctaccctctgtctgtattgttcttttttaaatagatcttcctggttaggtcaggaagaagctattcttgaatgccagttaatacattcctccatttactcaacattctatccctacaccaaattagctcagtagaaaggctatctagactatctactacctaggtcataatacattagcaacctgtacaaatgtcttttcagagtttcagtttatagcatgccgtggtttgttatccagggtgaatctaggaaacaattagatctataatctcacagcaaacttcatttgactatatttgcaaatgttatcaactatgttatttttttaccatcatatatataacgattgatataaaaagtttttcttacagttaggaaaaatttgtctctcctgacaaagtggtattcttccttttgcaactaatggcagttatgtaacttgcttctcttagatggccttggccatctaagaagctcagagcagaactaacttgtttaggtcgtctagaatgacttcttccgatccctatttttctctgcttaaacttgttgttcagttctgttaggacttttgttttgttttgttttttacatatatgccttttctcattagttggttaaaatacgcttttaaagtgtataagataaaaatagtagagccagacacggtgccttacgcctgtaatcccagcactttgggaggccaaggtgggcagatcatctgaggtcaggagttcgagaccagcctggccaagatggtgaaaccccatctctactaaaaaatacaaaaattagccaggcgtggtggcacacgcctgtaatcccggctactcaagaggctgaggcaggagagtcgcttgaacccaggaggcagaggttgcagtgagccgagactgtgccactgcactccagcctgggcaacaagagtgaaactccgtcccaaaacaaaaaacaaaaaaaaagagtaaataattttgaaattttaagctcccttttaccaaaaaagggttctgacttctggccagaatgtagtaaatgtcaagaaatcagtcacagctgaggtagtgccaggaatttggtgtgggggacaggaggagacaagcaaagactatttaaaaacaatgaattttagcctgtctataagtactcttttctatgaaaacataaaaggaaatttcccttacaaatgttgattgataaacatgaacgtctatatggaaaataatgcgatatctgagctaaaaggactcttagtgaactctgatccaatctccttgatttgaggatagggaaaagtgtaatccctaaaagattaaatgatatttccaaagaaacaacaagttggtaattaagtccggcctgaaatctggggcttctgcttcccaggttatgagctttctaacactccaagaactgtgaaccctggagggaaggttgtaatctgactttaactcctgaggacatgtggatatgcccttcagggtccagggacatttgggttgcacattaacagttaaaatatgctaaagcaccgcattttctccaactccattcaatgcctaaggtttattgtttgttcagttttagccaactatatttcctgagtgtttcaaaaggcagcaaggtggcgaggatacaagggaaagccgctacacattcaacataggaatacaaagattatagtagaattctacgcatcaaattccaattcaaatttcttctggggtcagtgtcagtatctcccacttcctcctgacacatcctgagctgaagatcccttttaaattttctttctaagaaaaaaaaaaatataggtttattgatctcctttaaatgatagctttagaataacatgtcaaattatttctgtttcttgacttattctaggaaaaaagacaaagaaataagatattcatataaatgaaaagtttcacagccggcaaccaactaattggtatatatttaaacacatttaagatattacttgattacattcaataggcataatgtccatataagaacaatggttttgtttggaacatataaaagtgatagttctgtaacatgtatttatttaactttttattttgagataattatagattcacttgcagtggtaagaaataatatagacagatcttttgtatccatcacccagtttctcccaatggtaaatcaagatattgacattgatacaatccacctcagatttcaccatgttagatataagttctaaatttctcatcaaagaataaatatgccagtatgttcaattctttgccttctacttttaaacttaacttcctcgtaaagtaacctttttcgattacctactccaccccgactcattccaattcctactccaccccaactcattccgatcacctactccaccctgactcattctgattacctgctacctgctctgccctgactcattctccacgctgcataaccattttttttccctccaaagcactcaccccctcactctctttaaattagccaattggaattagtttcgcctgcgtggtctaatcctagccaacaggggaacgacacggcagcaggggccatgtgcctcagggataagaacaccttcccctcccttgtccaagtgtgcgctcaccattgttccatctgtaagggcgtacccttctgtagaagtaacttgccttgctgagaattaaaagaaaattttatattcgatgccgtttcttttgcggcaccgaaactttatatataacaaccactttgacattcatttatataaagatcaatttttaatagctacaatctatagagcacttctatatgccagaccaactgctcactgatgaacaaacattcttctagttcattcctacaaaaaacaatttaccagtggaggcaatagtgaggactgtagcttagaagctttcatgctacaatgtagtatatgctacagtgtagtaccctatagctgtatgggtggttcattttaaaaattgtatatgcagccattcctcaataggctcaaaataaatattgacagaaataggtaagtaaatcaaaagagaaaatcaaagccaggaatcaaaagaagaggcaaattgggttaatatgattcaatttacgtctgggcttcttggtagacaggacaaaaaggtaaacagaatgagatatgcaatcctttttgtcaaaaggggaaactcatattgatcctttaagatatagatgtttaaaaatatgtctatgtctgtgcacatacccttatgctagctccagctcagttttttaaaataatcttttcagtcagagtttatgaacatccaaataaaactgtgtcaacacatgcttaatacatcagtaaaactatttttaataatgtactctcctattgaatatgggttggttttctgacttgctatggcccattgagtgcacagatgtcacagtgttctacttccaggtagtccttaacaaggctggcagcttctactttgaaactttccaaaaaattagcttccatgatgtaaaaaaaaaaaaaaaaaaaaaaaaaaaggccaatccagaatactacatgataaacacttgtgaagagactgaggtcatgtgcacagcaccaatgcacagatacgagtgaatccgttgatcttccagggcagcatagccgaaagctgaatgcagcctagtgattgacccagcctacaccaaatggagcggaacaactacccagccaagccacgccccaattcctgacctacagaaccttgaaaaataatgaatcactgttggtttaagcaacagaagttttgaggtagtctattacacagcaatcaataactgaaacaataacccaaactgataacctgaaaattcattttgtaaacctgcatctaaacttggtacaataattaaacattttctgtgcaagtagtccctcttatatgactagaatgtgtggaatgcctaggagcagcttttccaaatgaattcatcaataaacataaaacataaaatgaactgctctagttttcccagagattctgcctagaacagactgccctaggacagatgattaagttagtttgggtccaattcatgactacataacatggagttagttatgtcttaggctacgtcccttcaggcaacttggagcctcccagggttaaagaagctctgccaaaactcaaaatcaatagggccatttaaatgatgacatccccagtgggtaaagatatttgactccacacatcaatggcatgagctactgtcatgggcattcgtcaataggttgaagatctcattaaagctttttaatttctgcttagtggtattaggatttaattgatgccaaagacactgcctgtcactatacagtgatgttgtggcagtcagtagagaatgtcttacacacagtcctagaagaccttcctagaaaggccagggcagttctactggctgcatttcctggcttgacaggctactgctactttatagtagctctctctatgttgttctaccttcccatcatccgtgcacccatcttcttttaccagcaacccaattttctgaaaaactactccatctttattcttagtccatgttgctcagaagggtttgattctacccacagcttcaggcatgggcacaccacccagatcaggttgatcaccctggacatataactcaagacagtgtcaatgagatcaaaactttgaactctcaccaatactattggaaatgagaaactctattgtttcccactgggttgctaaactggtagaatggaatgggtatatataactgacagcctttttgccattccagggagataaaccctaagaacaaacaatgcatagatcacttgatcttctggatccagcagttctagaagtcatacgtgtctatattttttcagtatataagccaataaaatatcattttcatctaggctgttttgagttgtatttgctatctcttgcaatcattctcagaaactgccaaaagatgggctgctgcacaactatgggatgatggaatgccatttattttctgggacagtgcaatttattacaatttattacactccctttctgagccatagatcagaaagtacccgggcgttaagacaacagcacttcaaaaaacaatatcatacttgatcttcataaagttaagtgagcaaacaaggaaactaagacattaatgagacatgtggttcaaaagtcatccatcaaatcaaatatggcaccaagactggaaaccaagtcttcatgaaatgcgaggtttctgttgcttgaatcaatggaccttaaaggtgatttggtcttatggctccccaatgtcagtccatggattgggatctgttgccagagtatgttcaaatcatcaatagtccacagagtaatgagaaaaataaagaaactttgataggttttaatggagcaatttcatttcacttttaaagcctgaaatttcatccttccaggtttgtttggttttttcttttggtgttaacatatcctctttttgaaataatagcaatagtagatgtaaatcatcttttttggctaaatataaagtaagcaagcccatagcctcccctggaaggcactgccattgtttccaatactctcagctttaacactgacagctacccttgctctctttctcactgacacccaccaactcaaccagccctctcccaccacacaccctttctcaggtcacctctgtgctctccacccttggagctttacctctgggtaattcccttgtcttttgtaatgtatattagagtgtatattagagtgtaatgtatattagacgtctataactcctgctattactctgctcagcaccttcttaggacagaagcagctatcctttctcctgagaaggtgggaaaaaggcaaattatgcatacttataaataaatatttgttggtctcaaacaagtaaatttataaacattgatactaacattactggaagcataaaagcattagaaagacattaaatgccctacagtagagtgaaaattaaattctgccatctaggagaatagtatttagtcattaaagttatgattataaatactttgtaataatatgcgtaaatgcatatgatataaggttaagtgaaaagatacataactacaaaatacaactatgttaaaatatccatgcatggattaaaaaaatacagctttaactgcatagtggagttaccggtaatgtctacttttatatttatagaaatctctgttgtccagattttctgcaatgggtacatatgacttttgatggggttcagaacatgctaccacaaaacatggcaccttggcattttgaatattttaagctgaaggagtctgagaaacagcatgtgctggaaggactctctgaagcaggtcagaagccccttgtgtgagaggtccctccctaaacccagagaaaaggagcatccttatctctgaagatggagggacacacggagaagaaactccaggaaccagccttggtaagtttcccctagtttactacacttagttcatatgcttttccacaagtttccactcttcatcaaacctagtataaaagcactcaggtttaactgattcatcagattttccttccttatgaatgctctagtgacacataaaacttgtattaaatacatttgtatgcttttctcttattaatctgtcttttgttatagagccctagccaagaaactaaaatggttaaagggaagatttttcctacactttaaagtgtacaaatatatatttattaaagttagttccaattattatgtagccaatatttactgattactctactctgtagatgccaagaaagccatactctttcctgatagtttcctttgtgtgacaagatttgccacagatgtaggcaatgttggtattatacttttcttgacagctagaataacttctgctaagctaggcaaccacatctctccaagccatccttaatgcctaatgactgccactgcacctgacctagctccagggctgaccctttcatgtttaccccaaggccatgcccatctgggaaaccacctgggcaggtaccttccaaccaaattaaagtcaaggattccatccactatcactaaactagcacaaaccaagagagagaaatcaaggcaccacataggggttaggacaagtaatcaaagtcaggtagaaatcccagaagggtggtatacaatttatatttccctagtgaggcccattctagaataatgggaaaggttcactgttgtcagaatgccaagaatgaattctctgaatctggccttccctgaaatcaacacttaggttctgacaacctctaaattcatcctcactaactacatcaaacatttagcatgctttttattgtggggatgggggttgcttttgtttgatttggtttatctggcatctgaaacaaaagatgggaaaggatgacattcattcttaacctcgtgtatagttaaccacatcaaaaaaggctattgttagatacaaataaacgttaacatacattagttccaaaaggctaaagcctttcaggtgaacattattggacactttctcccctgtgccagacaaaactatgcatggcttattcccagagtcaccccgtcctttccaaggcattctatgctgcctcagggatgcaaacaattatggtacttccaggagagaaggagcacataaattctgtcaccccttgaccccaggatccaatttcacagcaatgggtgaaaggattttttagtcaagagatgatgtgagacgcacagataccccttggagtcatttgggtgacagcattaaagagaatgaaatgagctatcttgaaatggaggccaagtgcagtcactgcatctggaaagttaggctccttgatattcaaagctctggggctcggcaaaaaattcaaagagcttttagtattcaaaacaaaacaaaaaaaaacaaacaaaaaaacaaaaaacactctttaaaaaattaaaatattcaaaactgtggaaaacttgcaagaatcatatcatgaacatcccatactgtcttcccaagattcatccatttgctattattttgccatatttgctttatctcttcctcctcctctgctccccttccctcaaacaaacaaatgaaaagtggtttttgctaaaccatttcggtgtaggtgtgaacattaaaagcttctaggaattacagtagtctctcacacatacaatgatcaaaatcagggactttaacgttgatagaatactatcttacacgtagtccatatttacttttcttcaatcccgagtgtcctgtatggccactttcctccagtctaggatcgcactggcttttagctgtcatgtctctttagcctccttgaagctggaatactttctcagccttcctttgcccatcatgtcattaacattcttgaagaggacaggcctgtggcttttcagagaatctatgctggtctgactgttatatgaggattagattcatagtacatgtttttgaaaggcatactacctaagtgatagcatatccttctcattgcattacatcagttggcacctgatgaaacttggtcccattcttgatgtgttaaccttgattccttaaataaggtgttttctgccagattacctcactgtatgtgtgtgtatgtgcaggtattcctctttttcccttttataattaataatgtatgggaagacttttttctgactgtgtaaacaccctgctaatcaacaagctttcactcaatggtttaacacctattgacaattctactctgaatcaattattactataatagttgtaaaaaagtgatttttctaactctattatttctttcacagcaattagttggttttctagtgcaagaaacagctgccctttctcccttctttccttcctttccctccttccttccttcctttctttctttctttctttctttctttctttctttctttctttctttctttctttctttctttctttcttctttcttttggttatatcttactcatttgattcttaagtgtcccatttcaagctggttcctgtgtcattcagacaggtcctcattttttttttaatcagtttttattttctggcacaacaaaatgttccaggcttttcttgtcctttccctgctctgaaactgcaattagtcattgctctaagcaggggtccccatccccaacctccaggctgcagactggtaccagtctgtggcctgttaggaactggctgcacactaggaggtgagcagcgggcaggggaacctaactgcctgatctccgcctcctgtcaggtcagctgcattagattctcatggcaacattaaccctattgtgaactgcgcatactcattatgagaatctaactaatgcctgatgattttagatggaacagtttcatcctgaaactatccccgctcccctgccaccgatggaaaaattgtcttctatgaaaccggtccctggtgccaaaaaggttggggaccactgttctaagggcccttatttttagtggggaatgctatttagaaagcaagagctgggcactcagtgtgttcactgctgctaggagtgttattgcttgcaggccctttaagaggacaagtaagaattataaatatatattgagtcatgtcttcctattgatacttctaatctccatccaatagctcaggctcttccttgcctttccccaatccacagttgtactgccctccttccacagtgataagcctgactccccacaaaataatacatttacttaatcctacaatggatacaaagtaatttcagaattgtcccacaaataacacaaccaagaacaaatgtataaagttcaagatttctttccagtacttctgttgtttgattgaaggccatgcccatctgggaaaccacctgggcaggtaccttccaaccaaattgaagtcaaggtactgcattcaaaataacttgaatcagtatttttttcctatgtgtaatcatgtcatccatttgatatatagttaggttcatttactctgtactcaatttcccccatcttgttatttaatgttatttcggaatatacaaaccatgaacatggtttcaaactcaaaactatataaaaaggtattcagagaagtactacatcactgtcttccttccctaactcttctaatgctattcccaccctgtagatgaccaatttcatatcttctagtttatccttcctgtgtatccttttgcaaaaataatcagacacatagataaagacatttttatttccccttctttctacctgaaatgcagcatgctatatatagtcttccacattttgctttttgcactaccaatatcttctggtgatcactccaatcccgattcacagggatcttcctcatcctattttacagcacactactgcattaatgtattatggctcattcaaacaatctcctcattacaacataaccacgatgatgctgcacatattattatgagagaagttgaacatattttcatatacttaaggacccttttttatcaatttttgtgaactttctaggtctttgctgcttttctatcggatttatggtctctttagtctcctcaacgtgtagtaactttctatatattagcaatattagcattttatcagaaatacatcttgcaactatttcctcctggtttattacgtgtggtttatggttttttgccatgccaaagaggattttgtttaatttctaactttacacaatcagattttactacatctgaagtttgaattgtgaaaaacctttccttgtgcttttcctttttgttataaagcaatttcttatactggctaatttttaagtatccctcattacactatacatgggaatgtatgtaagaagaaaatcctatttgcctactgaccgctgggcaacttcaaaactgcatgacctttatttctgcaggcccttcatttcctagctgcatccctttcattttccctaaccccaggtttcctcagcaggccagcttcactagagagctgtaaactaaacctaaattactaaagaacacattactcactcatcataaccataggaatctttctctagagcaaataagaattagtagtacaaatctgttttataatcacatactttcacaaagcaagaatcaccaatagtatactttattgtctctcattgatgggtacattttctcttattatttttattatcaaataatccatgtttattttaggataaaattaaaactacagctaggcaaaaacaaatcaagatgttggaactgttaatattttagggcatatatgtaaacacacacctatttaaaaactctcttctttttatacctattaaaaaaaccctctgttctctactatacttgctattttgtaatctgtttccattttcatttaatataaacatctttccatgttactaagttgtctgcaaaggcattttaaaaggctacatggtattatactgtataaagacataaaatattgaaccaaatattgtgctcttaggatttaaaaaaaatatcgtaaacaactctgagaaaatttactcagacacacaccttcatgaatttgttcaaatgcttctttaagataaatacctaaatgtggaattgcaggattaaatagtacacaagattttcagggttttgatatacgtggtcaagttgccaccagcagtgtatggtgggttccctttacccacactgaacccacattagtgttatctttctctgtaatcctttttatctcctgatttagcaagactaaacaacagtgtaaagttctgcaaaagcaccagataagcaaatttagaacaaaacattactgatgtctgcccaaaactctgtaaacctgttcctaggctctaagctgtctattgaaatgtcctaagaaaccatttcactcagagaagaacatttttttcactcttcctgcacagctcagtctttacgatgttaaaatcctgtacaacttcctaacagcccttcacattcttcaggagcccgagtttggttctggttataaatgcataggatagatcccatacgggaagcatagacctaagaaatttatggaaaggaatttatgggaaagcttctctcatcagggctgtaccaattaaaaatccataaataattctcccttgtcagtttctgtataaacacattggccttagaaatttttacttcaggttctagtctaatggcctacacttctaaattatgcttttaattgaaaaacaataacatgcattttttttccagaaccatctgtgctttcccaagaacatgtaactactacagataaatccgctactttgaacaccctaattatccagtttagggttccaaaagcttaggaaaataatgccattcctgaaaaacagtacgtgatcagaaacacttgctttaaaattcgatatttggtgtgtgaagcttcttaacaagtgtttattaaactgcataatttcaaagcctggagtggtatattgcaatgttttcctcggagttgatcacatttgcatatctttttacacttcctgtgaaattaatattgccttttgtatctcgaacttagctaatataacttgccatttttacttttcactgctatgagtaatataaagtgaacccccaaagggacccctgcaacgcctacataagctttattctctcactgttgtattttttcatatgaatatattaaatcaagattaataaacctttgcagaatccactggtcctgcaaaaaggcaagattcataacggtaaaggctgctcagcaaataaaggaaacctgctcctaaaactggagccaaaggccggggttcatggagctcttgtcacatccaacagtgtgccagagactcttcacctcacaagaagtctttcaacagtcactcaataatatgtgcaaaagtggcttaaccaccaggataccaaaacccagccggtgattatcaggctgccttggctcagggatacatctttgtgagatgccaaaaactgaccataatcccaggattttaaaaatttcagctgggcttatggggatggaatgtgataataaagaaacaggatggtaggggctgaggaaaagtggaacatgatgagaggctcctaaaagcaaatcaaacacagaaaagggaaatctctctgaacactgcataccgcactgggcacaggagtcctcagttgagcatcccccactcattgggccccagcagctactttgcctagctaagaatctgctcaaagctcagggaaacctaaatggcaatacaaagaaagagttgggggcagcttcaagatagcaggctactggtacaaatactttgtgaggtcagaaaggctcactatcatgacttgtactgctgtcattgattctcctacttcaagatcatctccaacttggtcaagaggcagagtaatggggattcagggccacagttagggtgcagcaaatgaggtacaaaatttaagtagaactaaaaacaacctcagtagccaggtgtggtggccatgcctgaagtcctagctacatgggaggctgagataggaggatcacttgagcctaggagtttgaggctatagtgcactatgattatacctgtgaatagtcactgtactccagtctgagctacatagtgagatgcccatttcaaaagaaaagaaaaaaaaaagaaaaatcctcagtaatcaagataataatacttcagtgcaatctttttagaaaccaaaaaaatcatggtgaagaaaacacaattttaaataaatattaatgccctgccaaccatatttgagcctgcatggacacttctacctacatttttaatatattttaaaaattaatttttttggagaaccttaaagtcattgaagaaatactgaaaaattggaaagtaggtatattaaaacttacaatattaaatgtaaatattttatttatactaaaatcagaattcattataatttcactttcctgactctaatgggacaaagtaattttatttttatgttttgagatagagtctctctctgtcgcccaggctggagtgcagtcgtgcgatctcagctcaccacaacctccacctcctgggttcaagtgattcccttgcctcagccttccaagtagctgggactacaggtgcatgccaccacgctcggctaatatttgtatttttagtagagacgaagtttcactgtgttggccaggctaggggacaaagtaatttaaacatgttttcaaaacttacttctttgtttgtcttcttttcaatggaagaattaccatgtttgacattctcttatcacctagtgacaatcataaatgatttttaattaaacaatttactttctttaaattaattttattttgtttttccttagctttaggctccaaaatggcttggcactgtactaatccttatttaaaacttcaatgttttgttcatcatggatttttctggcatttatttgatttttgaaaaaaatggaattaaactatttgtcttgatcactaagtatgttgacattctcttaaactgtgcattaccttgttccatccaaatcaaagtcaaggatgtagccatctcagacaaataacataacaatgactttaagtgtggaaagaagcctaagatcttttattaagtgaaagaagtatgtggcagaataatatgtatagtatgggctcacttgcacttaagaaaggccagaaaaacattttaaagaataactctaagtcattacacatcaaataaacattgacggcaaaaggtaaaaagtgtagttactgaagcaagagtttctaaatcatggtgctgcaaaataatacactgggtgtccaagtagcagtaacaactaagtattaccctctgctaacatctgatatctttgaaagattgtctctacaataatgtcattctcattcacttgtagctaggtactttttttttctagagaaagagatgggatttcagcatgtgtactaggatgacaagcaaacactgtaggttcaaggaagttcatgggcatctcaacaatatgtgtggtggtgaaaaatacactgagaaccactcatctagctgctactgatcctattccataagctaggaatacgtcataagtactgttttgtcctcgcgttggggatttttgttttgttttgtttttttgtacctcctcagtatcctcctctgttaagtaatagcatttttgtttgctttttagccaggtttatggaggtataatttaaaaatagtaaaatttacacttttagtatatatttatatgaattctgacaaatgcatatagttatataacaaacaccacaatcaagatacagaacatttctatcatcccaaaaagttcccatgtactttgccatagtcaatctttaccctaattctccagcctctggcaactgctgatttgttttccctataattttgcctgttcaaaaacatcatataaatgcaatcataaaccatttatgtctgacttcttagtgtaaagcatttgagattcatccatttgatgcatatctcagtaatttatgcctttttattgctgaatggcatcctattttatggatataccacagtttatttatccatggtaataggatttggattatgatttcacaaatcacccatacttcctttcaggtcatgtggtttataaagggctgacccgaaagttccagagatgcccatagccaggcctgatcaaataacatattcagtcatcctgataatatggatggtttagagctgggcacatggtttgatgtaacaattttcgattcaagacaactgacagaactattggtaagaagttactgatggtataatggaaactgtttctggtagctattgcaccaccacaagggagccccaacttgaggataataaagccaacaggaagcaaagtgcaactaagtggatgagataccttcctaacctagtttgagcacctggatccagacatgcctaaagatctacctgtagacctgtcagttacatgaacctataaaattccttctagcctaggccaattttgattatatccctcattcctgaaactaaaatctcttgactctacagcatagaaagaaatctttcatcaaggaggttacaagagagtcttggaaacaagacacaaaaaatggttttgacatcagacaccccaactttaccacttactacttcctaagtatacaatgtcaagaattctctttactcctataaacctgtatttcctcatttccaaaatgcagagaataattccttacccattctaaaatattatcttgagaatcaaaaaaactaagttggttcaaatacaaaagaaaaataaaatgtatgattattatacacacaaaataatttgtatatgaaaaggagatattaagtgatgacggtgagagagaatcaagaggcattataaggatcaatgcagaactccagtgcttatataaggatcaatgaacaataattgtaactagaggtatttcttgagtatattcttgtgttaggcattgtgtcaggtattttacctacattatatcatttaacattctaaatatcactaaagtaactttttaaacccatttttgattaggcttagagaacataaaatactttttaagttaaagtactaactggcagaggccaaataaagacctaaatctggaccactgaaactagtgcacacttctaagttagatggaaggcatgaagcaaacactttggaaattaaaattcagttataaaaaccatcacaacacaattaatttagcaactacattcctttatacataattgtgccgagtgcatctaactcattaagatgtagaatgtttatgctgtcatataatattatcacatggtaataaatgaagttgcactatatctctaaacatctggatttcagagccaattttacacatttaattcagctatttggtgtcttaaacacatagcaaaaatacacaaggaaaaaatgattgtacatctggcatcaagatggctccaagaattggactgccaatgaggaagtcaggtttttctagcctatatcctctggaggataaatacccaaaatagtactgtttccaaagtaaccaaaatcaagaaaggagactccacaaaggaaacaagaatgaaaaagacaggcctagcccttttcaaaagctgagccttccctcccaggatccaaggtacttagggtttctcatacctgacaacctataaacgagaaagagtatcacttgtttgtccttccatttctcattttccagctttggtgcttatcaggttctccagaggtagcaaatttgtaagacatttcatctatttagattttcatttattcatccatcctttcagttactcagtgatgacttctatctgctgagccctgcactaatgatccaaaattcccaatcttcctgcctaggagagatagggagaggtagggaatatggcttctccattttctccttttcctttagtaaccaacctctactggaattaatcctttgagttcagctgggccttgagatccaacatgatttgttttaaaaatcaaggcaactattaatgtaaaaacaaaacaatacaagtattaggagaaaacatgagagaatttctgtacaactagatgtggggaaagcctttctaactataactcaaatccaaatgcaaaaaaaaaaagaaaaaaaaaagattgagaatttcaattacctgaaattttttaaaatttgcatagcaaaaaataccataagcaaaaataaaaaattaagtgcatgataggagaaaatatttataaaatatatcacagattaagctccaatcaccctaatatatattttaaaattcttggccaggcgcagtggctcacgcctgtacttcctagcactttgggaggctgaggtgggtggatcacaaggtcaggagttcaagaccagcctggccaagatggtgaaaccccatctctactaaaaatacaaaaatcagccaggcacggtggcaggcgcctgtaatcccagctactcaggaggctgaggcagagaattgcttgaacccgggaggcggaggttgcagtgagctgagatcacaccactgcactccagcctgagcaacagaacgagacttggtctaaaaaaaaaaaaaaaaaaattcttaaaacccatttttagaataagaaaaatagaaaaacaagtagttcacagatgatataggaattgcccttaaacatatgaaaatatgcttaattttacttataataagagaaaagcaaattaaaactacactaagaattataaccatattactctaacataagaggttatcaataggagaacctgggtgtggtgtacacaggaaccctttactatcttcacagcttttctgcaaaccgaaaactcttcttaacaaaaaagttgatccaaaaaaagtacattgagatactatttcttgcctatgagattgtcaaaagttgaaaaacttgacaatatactctattagcaaacagagtgtagagcaacagttcctctcaggcattgctagttagagtgcaaaagggtataacctgtgtaaagggaaatttggcattagttaacaaactatgtgtctatttccttttctatctttctacatacctatctatatatttacttaccagcaatgtcagttacagcattcaccctgaacatacaccttcaactgtatgaaaaaacgtggacataaaattattcactgtagtgttatttccagtaaaaaatactggaaagaatctaaatgccatccatagatacaatcaatagtagtcctttgtgtgaacaaccaatatacacatagaactactattcaactgtaataaggaatgaggaggatctttataaaattatatgaaataattgccaggataaaaaagcaaggtgaaagagtatacatagcatgctaacttctgtataaaaaggaagcgtatgtatatttgcttctttttataatgaagacatgaaggataaaccagaaactaatgaaaatattttcaaagagcgtgagtaaaaatggagctggaagggtagggatggagtgggactttcttgaacaatttttttttctagttttgacttgaaccaggtaagttttgacttgaaccaggtaagttttgacttgaaccatgtaaagttttacatattcgaaataaaaaatttaaaaaggatttataaagcaaaacctaaacttgcatacaggcaggacataaatggatctaatgatatatcacatcaacgtaaataatcacagaggaaaaaaataaattcaaataatttctgaagacagtattctgaatgtatatccttagtggaatattaggaaaaaaagaagtccaaataaatcttgaactttacttaatagattgattgtcaggaggggtattgatatagtaattctgaaactattttccgtgtactataggatagagcaaatgaatcgatacattaggatctcactgtggaataaaggagatacaaatatgaaatgagggaaagtgcggaagaatcctgtgatgttgaatttgaatggttgagttgtacatggtaacatacatgcatctacctatctgtctacttatctacctatctaatctatctaatctacctatcgcctagcggcaatggcaccccagtagcaatgaacccacctagcggccaaaactttctttctaaattccattctccagtaaagggagacagggcttgactgattcttgattggggtagggaaaatgtaaggtaaggttgatacatctttttttactccaggacatactcaaagactgatggagatatgtcaaaacgacataggaactagcatcaggggatcccactggctaaatgacagacaatttgagcctcacaaaagaataaggagctaagtatagttatatcattttgtggaacttcattgagctgtgtgcttataatttgtgtatttttttgtaggtatgctgtatttcaatatgaaatgtagtgtctttttttaagaaagctgtgatacaagcagcaaataagacatataatttactttagcagaaaggaagaccgtgctctatgaataaattgttctgattacactgatggtcatccatcctactatggaaacagaggtggagacctcttttggtaagaaacaacgtcagcccagaaatgtataataatacaaagagaaaaacatcattaggcacaaatcatcgatggacaatagaacccatgagtgaaaggttcttgggacacaaaatagttacccagtctcaaagtatcaccccacagatactaatttcaaggcaaaacaaaacacaaaacaaaaaaaaaccttaaaaatggagtgacctgaagaatatccaagatgaaacagcatcaccaaaactggcacaaacaaattatatgactctgctgtgatccactgtgaagcaggcaacattacctagatagtactttggcctacaatgaggaacaattggacagatccacattgtgtggtattccacaatcactgggtcggaatcttcaaaaatacagactcatgaaagagaaataaaaggcaggagaatattctagattaagagggtccaaagagacaaaataactaagtgaaatgtgtaatccttgattgtattctaaaaagaaaatggaaataaggaaaaagagacattacaaggtatgagggacattaatggaaacatttgaatatattagattacatatcaatgttaaatttcatgtggagagtgataacagtattatgattacatattcatcttaggaggtataaggtgaaatgtcagggggtaatatgatatctatgactgaaatgcaaatgattttttaaagtataataaatgagagaaaaaaagccaatgaacaattacaacaaaatgttaataactggatcctcaagggggaagagtaattgggatagactgtacaaaaattaatcaaagataactagcatattttgaatgctcactgttgtcaggccctatttagagaggtttgcaatactaactcatttaatccttgcaataactctatgtgattgataccacatatatccattttacagacaaaatggaaacctatagaagtaaaataacttgcccaggctagtaagtggagtagctggaatttgaagttaataaatttagagtcaaagtttattatcatatccacaatactactctgcccttcaaataaataagtctgtttagaggagcaaacacattaatcacaccaatcttatgattacatgcaactgatatctcctgtgtgcctaatgcagaattctggagggttcaattggttccaattagttctttttcctgtaccagaaaagaagatcagcaataactggaattctggggtggcatggagtgggggtgttaaattttacaaacacagcatccaaaaatagtatgttcagtcatgagtattatctttaaaatagagaatataaagaaagtctgaagatcaacatttaaatcaaagaaaaaagaacaaaagtacaggtgctttgaggtttagactatgctgaaaatgccattatagagcagtccatttcctcagtaggtagccccaaaagacccctgacacagtagaaattatatcattatacaattaatcagttttctttcacaatggcacaatggggtgccctctttaactcaacagagtaaccagctcaccaacagtatctagaaaagaggaaagtcacagaatggaaaaatagacacaaaaagctatggagaagagagactgaaacagacaaaggcggttgtactataaaagaaagcgagaaatggaaagggaaatgtcagcaatctaaggttaaaagagaaaagatcaggatataaaaagatgtagaagtctcttatgaaaaaaaaaaaaaaaaagggaggggaccagtgaagagatagaaatcatgaccagagtcgaagcttgaaaacgcagggcaacacacaaagagaagctgtaatagcagagccattcactcaatcattcatttcactcattcatttaatgcctaacatatgaagggtactttgtggagctttgagagacacaaaaatgactaagacaggacccctgccctcaaagagcccagctgttccaaatattctcattttggtatgctccaatttttaatgtaattttaattattgttgtcacaccttagctaatattttcatactcaacatgtacttccagaaattgcagcaactataccatctataaaagagggtaatcttggcagggagcggcggctcacacctgtaatcccagcactttgggaggctgagatgggtggatcacgaggtcaggagatcgagaccatcctgcccaacatggtgaaactccgtctctactaaaaatgcaaaaattagccaggcatggtggtgtgcacctgtattcccagttactcaggaggctgaggcaggagaatcgcttgaacccggaaggtggaggttgcagtgagccgagatcatgccactgcactccagtctgggcagcagagcgagactctgtctcgaaaaaaaaaaaaaaaaatgagggtaatcttaaatggatggcagctgccatacagaatgagttcattcgttgtggaacggaaacatgtttacatttctgatatgctgatagtatataatgcagtattgtgatgtggttctctgtatatatagatgctgtctatactttttttggatacagcacactccacatcattctattttatttttatcatcccattccagagaggaggcaaaggacaaggaagtctaaaggatgtggaaagacaaataaggaagttaaaaaacaggttttcattttctttacaatttcccagagggcttctatgacaaaaagctgtactgaacaacggaatgcgtatttgtcatagagtagctgagagtgaattctaggtaaacatacaagggagaggctcctagacagataccattgcctagtacctttcatttaaaagatacctagtgatatatgacttgggaaaaccagaaattgacctcccagcctgcctcagtatatggtctttgctcttaccaaggttggcttgctccctgaaaagacctgaaaattcaagtttgaaaaggtgtttcatatacctaatttagaacacacccctcctagatctataagagtaggtgagaagcatagaaatgaacacctattattttgaatgctcatcttctgattcctttaatgcactgtcccgccctttaccctctccccaaatctttgtggttcttttgggatttcaattgaggtgccccatctctccgccagagataggaatgtgactcaatctaaccaatcaaaatcttctgggggaagtgtatgaatctgcagttagagagaaggctttccgagatcttgggcacttaaattcacataagtctgaagctgcttagagatatttcttcccccaccacaaagactgtgactgaagaaaagatgaagaccacatggagaagaggaggactgtgaggggggtgagagcagaggcgaatttatcctgaagctactacatcttaagcttacaggtctttctctctttttttttttttttttcccagacggagtctcgctttgtcgcctaggctggagtgcagtggcgcaatcttggctcactgcaagctccgcctcccaggttcatgccattcttctgcctcagcctcccgagtagctgggactacaggcgcccaccaccacgcccggctaattttttgtattttttagcagagacggggtttcaccgtgttagccaggatggactccatctcctgacctcatgatccgccggccttggcctcccaaagtgctgggattacaggcatgagccaccatgcccggcccaggtctttctctagcgatgtgttcatatggtcatttataatcttcttatagagaaggctctccaaactgtatgagctttgggccacaaaatcctagattcacccctgggagagacagttgtgaagatacaataaggcacacatagccacccataacagaagccagtgtcaccccactggacctgcaattatgtgagccaatattcaccctttctttttatcttgggataatccaaatttggttttacccacttacaaagggaagaaaccggagattttaaagatagaaataaagtcatggctcgtaacttgctggcaggaaaaaatgagaaccaatgctgtttttgactttcagagtatctatcataagctatcattttgtttttgtccgcatttcagtatgtggtttaaaaggaagttccaacatcatatttgtaactagttataaggaaccggcagggaacagcctccagacatttttcaaatatatttttcctttaactggctataaaggacaataaggattaagttggcaccacaaaaagtcgcatttaatgatacccttttgtgtgttacccatttaccaaacatggatttttatttctgcattctatagaatacttattcgccactgagagttccatttaaattctttgcatgcacacacacacacacacacacacacacccttccaccaccactaccaccaccatcattttcatcatcatgtgatttcagaagagcagtcatgtctacagtaaaggtatttgagagctaaacaaagcctcctggctagagatcctggtatcttcctttaaacccagatcattcatggtatgggttccctgcagagcactggttgtggccccaccaagcactgccatttccagcactgtcagtttctttaaccttcaagagaacacagaagagtcattcaaagccagcaagtgaagagatgtcctggcagtctaatttcaaacaggcctcataccagagtcttttttatggtttttaaaagaagtattttatgctgctctgatgaaaacctctaacagtagtagcttctgtctgacaaataccatagagaatgaaacaataagtctgaagcaaagggagggggtaaaattatttttgtttcaatagccaacacacaatgaaaacaagaaactatagaggtttaaagaataaccgatatttattctggtaaagacttttctcatatcagcactttaccactgtaagatgctgacaataattatgtgaatgttgctataaaaaaattaaatctcccatctcatgggtttaaaggtgtttccgcctctgccttacacacacacacacatacacacacacacacacacgtacacacacatatttcaggtacctctgtcaggatctcccaactcaattatactgcatggaggaaaaatatgtatactactactactagaataagaataaactagtaaacaaacaaatagaatacaatgtaagctgcagtacatgtaatctgaaggcctgaagctcatgtgtgctaggtttttgattgagcagtggtgggggtaaacgtggcacagcagttatcagcctggactgtggaatccgatcataccgggaaatgaatcctggcttactcattgagtaacctggtaactgaacctccctgaggcccaggttattcatcaacaaactgatgacagttatcccatggggttattatagggattaagtgagaaaatgttatataaaggtgaggagtggcagaatatgccaccccaaaatatgccactttggcatgaggattattttgagctgaaggcagttgagaagaagcagatatgagagaagctctctgtcttccccctatttgccacaaaacaggatatagatttataaaggtgccctccccacctatcaggaaagaaaaagttaatcatcagagataactctagatattcactagccagaagagacaccagaggaatctatgtaacaagctttactaactagcccttccattagttcccccatatatttaccttctcacaatttgcagaaactcaaagtcctttcctttgtcttaccatttctctaaaaatttattgctcttttttaaaaagctatataaggtcacattttaatcacccctttgagtcactcatcactgggtacttccatgtgtatgtgcaagtacatgttaataaacttctgttttttcttatgttaatctgtcatttttcactctactttagagggccacagctggagaacctaggagggtagagggaaatagatttagtacaaagagcttagtgcagagcctgtttcacaatgaagcactctgtaggtgaaagcattgccatgattaatgattgccacaaagcatccatgttggttaaacagacaccatgcctaagggcatataatgactctgaggaaagctagacttgaagaaaacacgacttgcccagccaagtaccttggtcaaaacacatatttgtttgactctatagtgttgagacttgagtatctaatatacagatgaatgagccagtacagaatttgaaatttcaacaaaaaggcaagtataatctgcctgataataataagcaacttgtaaatctttgaatggatgggcttgcctgttttcacccatgctactcaaactgtgaaccacagaacagaacatcagtttcacctggggacttcatagaaatgctgagtcttaggtctcaccctagaccttctgtattccagaattataataagatctccagatgatttgtaggcatattaaagtctgaaaagcactgctgtggaccacaaaatttaatgtactgcttatcccactttgggtgtgtttctgtgatctttacaacttaataaaccacccccaaaagttagtgactttaaacaacaatttatttgtcctgcttcttcaatattggcagggctcagtgagacggctcatctctgctccatatggtgttgactggggtagttcaacacagactgcaagatgcaagctggcttcccttcattcacatgcccttggctgacctggctgggacagttgggggctggctgggcctctctccatgtctttgttgttcttcaggacctctttccaaatggagtggtctctctcctgcagcatgatcagacttctttaagtgatggcaccaggctccaagacagtgaagtcagccatcttaaagtctaaatctggaactggcactgtgcatttctgccattttctgttgatcgaattgagtcaaaaggcaaacaaatgtcaaggggagaaaaaagactttatttcttgacgggagaagaggtctgcacagacagtgtggaaggatttgttagcaacagtttttgcagacaagctaccacagagtatctgttacttttcactttcttcatctctctgttctcctgattggtcaaacagccacttcatttcaattacacaactatatgcgaggtcccattgggagcataaggaattttaagacatgatatctcccatcaaggagcttgttataatacaattggtaaaataaggaatacatatcttgaaattttaataacaataaaatactgtaataataaaatatttaagtagcagtgccagataataacagaaatgatgtcctaaggccatgaaccatttatttaattaatcgtgcacacaataaccatcctgagtgttcagaagagagaatggaaggggaggagaatggccatggaaggacggttgtgcagtgagtaagacttgcataggaaaatgagtaaggttttcaaaaaaaaaaaaggtccaatgaaatacacacaaaggatacaacagaatcaaggagccaagggaatggggtcatagggacacaaggccatgaatgagtatctgcatgttcttcaatgatgattatcaattcaatgttcctgaaagaatttcctgcctcataacgtccacctttacttctccctttagatatgttcataagctatttgtggaatccccaccagcaatataaccttgtattaataatgaagggtttttatgaaccttataaattttattataccttgtagagagggtgggggaacaaacaaacagaaatgtaggcattgccaaatggcaacttgtaaacttcactattcattgtgtaggaactaacacttttggtattgttaagtagccttgtaaatttcactctcccttagaaaataaaaatggaatgaaaggtgctgcttagaagaaacgtataaatttcaatctccactgcaggaaaataagctctgattacactacatagttcatacacctcaatgttccgaacacttgtttttttacagattcatgtataatgacttggttttccaacaacagagagtgaaatttacaagttgttatttaacttttttaggagtgtatttttcttccatgtcttttttttcttctttgcccctactcacaccagaaacctaatatgagcaatgggatttctgaatagtaccatacattaattccttcaataacaatgattaaaacattttaaacattgttctcagggcctcctgataccacatataaaagtggggaatgacacagcttttggccacacagttcaaaaaattgctctttaccttgttggggaagaagagggcttattaaaagtttataataagcagtattactagtatttaacttctatttgttgttgaaaagaactgagcctataatttcagaggcttccgagcattttcataaatatacccattagatattcaatagccagtggatttgaatgattttgccatttattcgaacagatagctgtcctggacaggaaggatagaagcattggaagaaagtgttagaactacatttccataaagtcatgacaagaaataaagaaagaaggggagtcaccacctcaatactagaagtgtcagcacaatgatatcctcataaaaggtgttctaaaagaaacttttaggtgttctaaaataaagttataaatgccataccaagaaatactgtcaaaacaaaagtcaagtacaatacagcccagaaagaaccaaatacatctttacatcagggagtaaaaatatacatagatataatatccacaattgtcttaatttatagcttttaaatagataatatacatacaaagtgaaaaattgaaaccacaccaaagtacgttgaaaaatgtcttcccactcatgctgttaatgatctctgtaccctcttcaacatatgcatatgtgaacatatacacacattttaaatttccatgactacaaataatggcatattctaacccatttttcacttaaaaatgtcatagagatggttctgtatagacccatttttgtgatggtctaattttattacaaagattataaagtatagatattccataatttatttacagattctcctattgcttggacacttaagctgtttttaatcatttgttgttaaatgcaatgccatggcgaatatttttgtacatagaattttgtgcacctgcatgactatagttctaaaataaattactagaaatggaactgctaggtcaaaaggtatatatgcattctattttgatagttagagccaaatagctttccaaagacaatataacaattcatgcttctattcatgataccaatacatcttgcattgaaggaattccaaaacaaccaaaagttcatcatttttctgccaactgatcctttctctcttaaaaagagtcggggtaaaaatcacccatttttgcttataaccataggcagttataatcattattgcccaagattcaaggccatttcattacccactgcatcaccatcctcactgtggtataattctaactggtcagagagacctttaatttgcagaccttctcagaagacagattatctgcattctgcagacatctgcagaaagccatccacaagtgcatatttcatggctgaatatttttacataacatcagctggaacccatcgttccagcattctcgccaagtgtcacaacctgctctattatatcaataagcagtttcaattagtcattttcttcccatggtgacgacagctataatagcatgcagtagtctgatgaagtttgtaatataaagtggagatgggagtattaaaaggaagagaatacagaattagaatcgcataaaaaaatccatctcccaaatagtcatttggggaaatgacaacatttttgaaacagtgttcaagaatgaatacaaaaatgcaattacttttgaaaagtcagataaataaatttgccatgggaacacattcttgccccagatagaaccctagtttttactggctaattagtcattaagcaccatctcaaaaacaactgtatatgaaagaatattgggtaaatagaaataaaacttaaggcttaacagaattgtaaaatgaaaataaatgccaacagagaatactactttgaaagcattggatagtagtaaataaattagaaggaatgacacagttgctctgccctcaaaatttatccctaatctgttactacttcctactttgtgtgctaagattaccaggctccaaaccatgcttgccttccctggcacacagccagagccttctgactggccacctgcctctcttcttgtccccttcagcctcttctttacacagcagctgaaatgattttctaaaaaatataaatcagatcgcatcatttccttcttttcagccctctactggttttgctcataattaaaatctaaaatctttgccatggctggcaaggccacatatggaatccatctaccacttctttctcctccctacactggcctctatcaagcacattcccaactcagaccctcaggtcttgctgcttccagctaaaaggttagacccccaaatattcagatgtttttcctccttcactttattcaggtatgtcctcaaatgtcacctcatcacaaaggattatttgaccaccctatctaaaaaataacccaaaactctttatcaaatgcatgcagatttactttccttatatcatttaactccactcgacattatatgatgtagttagatgtatatctgttcattctgtatatcccctactagaatgtaacttcaatgaagatgagaagaagcaaagataaaaaagtgcatcccaaccagacagaaaaacatactatgactgtgaactacacccattgatatggtttggttgtgtgcccacctaaatctcatcttgaattgtaactcttataattcccacatgtcaaaggcagggctaggtggagataattgaatcatgggggcacttccacccatactgttctcgtggtagtaattaagtttcacaatatttgatggttttataaatgggagttcccctgcgcaagctctcttgcctgcagccatgtaaggcatgcctttctcctcctttgccttgcaccatgattgtgaggcttccccagccaggtgaaactgtgagtccattaaacctctttttctttataaattagccagtctttactagcagtgtgagaactgactaatacacccatagttgagaaaacagcatctacctgactttggttaaattcattcaactcagcaaacatttactaaactcttattagataagaaattccagaaacataggtcccagtgtctatctgttatatagtttagagacaaaaacttgcatataatttgggaggcaagacatgaaatataaactactgaaatgacaactaaaaagagttaatgatcaaaagccaacatgagtagggcaggcaataagtgtcagagagttctgaggaggagagatttgtgtaggctgagagggtgaaggaatggttcaaaaagaaggctggagaagatctgggaaaggaaaccaggaggaagaaggcatttggggtgagagcacagcaggggcagacacatagattataccagtgttccccaaacatcaaagcatggaaccttggtgttacatggtccactgacaggacaaaccaaagaataataaagttatatctctttccatttgattttaatctttctaatacatgcaatgaaaaagtattaattcagcattaattgttaaacaccttagtaacacttgccaatctgaatggcattattttactttttattttttgtacttctctttaaacttttactccctatttatgataagggcttttatttatggaataacatataattttattcatatgtaaacttctatgggtaaaaaaaagggagttgctttaatggcagtcaatcatggactaaatatctgggtcactacctacccagacacaaagcagagtcaacctttaaagtaagcaaagggggctcagtggaaaagagaagaaagttaagctcttgtcaagatgatgcagggggcctcatgtcaggctaaggattctggaaaatattctgtaggactgtggtttcccaatttgcaacaaggtcaaattccttgaaaacacacgcgttatatttgagtgtggcatgcttcttattttcaagacagcaagaaatatggcaatcttcaattccattataccatttcattatacaaacttaaacacaaagtggaaagaagtaaatacaactttatactatatgtgaattacaaaagcacaatcacaaccacagtttttttttttttttaaagctgtctatatctattatgatatgggcaagaaacagatgactcacaaaatactcaaatagggtaatctgcagaaatgcttagaaagtgtattcatggtgtggagaaaccaaggattaatgcaatacccagggacaaggcgggagcctacttatagagttcacagagaactgcccaagcaaagagcaaagcagagagtgggtaggaaaggataaattgaagataaccaatatacaaacaaggctattttcacatatttcaaatacttaccaggtcttcgaatactttacctgtctaatcacgagctgtatattttttatagggaataagagtgcataggccaggcgcagtggctcatgcttgtaatcccagcactttgggaggccgagataggtagatcacaaggtcaggagatcgagaccatcctggccaacatggtgaaaccccatctctactaaaaatacaaaacttagctaggtgtggtggcatgtgcctgtagtcccagctactcaggaggctgagggaggagagtcgcttgaaccagggagacagaggttgcagtgagccgagattgcaccactgcactccagcctgggcgacagagcgagactccgtctcaaaaaaaaaaaaaaagagtgcatatagcatggacttaaacctcagcttgccattcacttctatgtgagtttcttaagctcaatgaatttaattttttcaataaaatgggagataataacagtatccactataaggctggtgtgagaagcaaatgaataaatgtatgtaaagcacttagcacagcatttgcctataataaatatgcatgctttgggaaaatgggggagggtcatgtgagctgccaaaatagtgaagagaaatttatgagagaaaagcttaagattgcagaaattatcaatttaaattgcattagcttagtatttcatatgagttgtccaaaacatcccatattattcaactattccatttcattgataaaatacttcaaaggcatacaaagaaggaaaatagtctagatcggtagaggcaggtggggttatagtggtggtgatcagtggtagtggcagggaatagacagtaaaggcctccttcagaaggtaatatttaaaataagaccaactgaaacataaaaggagttaactaagtgaggtgaaaagtgccccaagcagaggaaacccaacatgccaaggacctggggaagaggaaacctcctggattcaacatattccacgatcaacatgtggaagagtaaacaaggcgtggggagaactgcagctggagcggtagaaccttttcagtcatgtttaaagaatttaaattacatttatcccaagggtaatgagaagcctttgaaagactttcaagcaggaaaaaggcatgatcccatgatcggattatcatcattagaaaaccactactaaagagaacagggaggcattagagagttttgagttaaggactgaacaagaaaaataatgtttcaaatttcatttttattattttattgtttacaaaaattgtaaactgccgcagacgatttctctgagggctaactgtataagtataggttcatttggtaactcactcattccgtaagatatttattaagcacctaatgcatacaccggaactgtgcatagataggggacggaggagaaaactcacaaataagcagtctaaaaagtgctaagacttgaaaggcaaacgacacttctgagtggtgggtaaaattccaaaggtggaccaggcagtgtctttgctaaaacatttttcggtatggctgaaccataaaatgcatgggccgtattgaaccactcctttcacaagaatttactgagcactgactatatgctggtattgtatagctttggtgacatggtggtgtatgagaaatcacttaaaatataatagcaataacttttttattgtaaataaggctgggttgattatcaagagtgcatgagaaagaaaaacagagaagtgaagaacagtgccttcacttaaggagggttcgaatggcaataaaatacttttaattaaaacttctctgctgagaatagacagcctttgaaagcttgtgtaaacataaatgaactacatgtaaatatattcatgatattatagctttttaaataacattataacttttaaaatgtcaaatcctttgaatatgaaatgccatcccctctccccaaaaacatgaccaccatgaattatccagttgatcttaaatcaaaagccacttacttaaaagtgaaatgttcattccttacacttactagaaaaactgcttcaaatatgatcagaccttccctttgtcttcagagaattccgctgctgaaacagacccaacaagccagccaaggtccatctggggcagcttagggaaggggcaagacatgttccctgcccaacactatcttttccaacttagcccctgatcatgccaagacatcacagtgtaataatagtaatttaataatgtagtcggccaggctctgcccacagtagaaagcatgagaaaataaatgaggcttgaaagctaaacagagagaaacttctccaggcactgcctgcagcagggagatacctggtaatgaaatacccactgatctccattcattacacaggaggcaaaccttaaaagagagtctagaaaggtggatctctcaaaatagaaataaataaataagctcacctgccatggtggggtctctgaaaatgacttggaaggactgcctatagaatttttgtggggatgcagcaaagttttgtcagatgtcaagggaggtaattattcccgacttgcttgggcacatttgctggataaattggcctctttaccttcatctccccatgcgggcaccagataaagaaaccgtgtttaaactctacagtgttctctctggcttttaccatgaaaaagaaataaaaatgcatcctgggtgcttggcaaatcagcccagtgtcagatggggacccattatctttgaccttcacatttgtgccccttgggactcacagaaaatcctcaaaaactcttttgggtaaagatatatgatgtctaggaggtacccaccttcaggagaaagaaattgcctttgcaatataaaagttgcaaaagttgaagttagtgatttctttattttttatttccatttttgtctatctgctcaaatttttaaaatttacctacaaatgctggaagccttgtttactcaaccatgttatcaacatgttaagctatcagccatttctctcccttccctgctttcctctccaatcaccaagacaacactaacatttctccatcttaccttctttaaagaaaaattcttacagttaactgtctgccatctactaccacttccagaaccagtaatgaaatgtcagaggaggaacagttaattaaaattgtggaatcctactttgcatcctctcacagtcaatacatgtacaattagagatgcctttcagcatgtggtataactagtataagttaaactttgaataacacttgatcattaaaaataaaaaatcattaatgttaagcaaatacgcagtaaacatcttgcttcattggccataaaactcctttagctcagctcaactagtgtggtagatttaatattgggattcacttagatggtgctttttagtaagaaaccaaggaacatgtctacaatctgcaagtggtttatgggaataaaaactgtgcctaattatcccacatgggtttacctaagttgtcatttttttacaaaatttctcaagtttctccacaaacgtttagggaagaaatgacatagaatggtggttaagggttcagactctggagtcaaatgttgtgtgtgtttcatccctgcctctgctacttgctaaacatgacactgccataaccatttttcttcatttctcagagcctccatttccctgtaggtaatatgaagaaaacactattcattcacagggctactgtgaggatgaaatgagataatgtacacaaagcattttaaatagtgaccagaaccttgtaaagattaagtaaatgcaagctggtcctcctaattgataccttattcattcaataattatacttcctaaaagagtctggtaattatgtatttaaaacatattcacgaggtggagccaagatggccgaataggaacagctccagtctacagctcccagagtaagcaatgcagaagacgggtgatttctgcatttccaactgaggtaccaggttcatctcactgaggagtgtcggacagtgggtgcaggatagtgggtgcagcacactgagcatgagccaaagcagggcaaggcatcatctcacccgagaagcacaaggggtcagagaattccctttcctagtcaaagaaaggggtgacagacggcacctggaaaatcgggtcactcccaccctaatactgtgcttttccaatggtcttagcaaacggcacatcaggagattatatcctgcacctggctaggagggtcctacgcccatggagcctccctcattgctaggaaagcagcctgagatcaaagtgtaaggcggcagcgaggcttggggaggggcccctgccattgccgaggcttgagtaggtaaacaaagcggcctggaagctcgaactcggtggagcccaccacagctcaaggaggcctgcctgcctctgtagactccacctctgggggcagggcatagacaaacaaaaggcagcaaaaacctctgcagacttaaatgtccctgtctgacagctttgaagagagtagtgattctcccagcatgcagcttgagatctaagaacggacaaaatgcctcctcaagtgggtccctgacccccgagtagcctaactggcaggcaccccccagtaggggcagactgacacctcacacggccgggtactcttctgagacaaaacttccagaggaacaatcagtcaggaacatttgctgttcaccaatatccgctgttctgcagcctctgctggtgaaacacaggcaaacagggtctagagtgggcctgcagcaaactctaacagacctgcagctgagagtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagcgcctctcctcctcgaaaggaacgcagctcctcacaagcaacggaacaaagctggacggagaatgactttgacgagttgagagaagaaggcttcagacgatcaaactactccgacctaaaggaggaagtttgaacccatggcaaagaagtaaaaaaccttgaaaaaaaaattagacgaatggctaactagaataaccaatgcagagaagtccttaaaggacctgatggagctgaaaaccacggcaccagaactacgtgacgaatacacaagtctcagtagccgattcgatcaactggaagaaagggtatcagtgatggaagatcaaatgaatgaaatgaagcaagaagggaagtttagagaaaaaagaataaaaagaaatgaacaaagcctacaagaaatatgggactatgtgaaaagaccaaatctacatctgactgatgtacctgaaagtgacagggagaatggaaccaacttgcaaaacactctgcaagatattatccaggagaacttccccaatctagcaaggacggccaacattcaaattcaggaaatacagagaacaccacaaagatactcctcgagaagagcaactccaagacacataattgtcagattcaacaaagttgaaatgaaggaaaaaatgttaatggcagccagagagaaaggtcgggttacccacaaagggaagcccattcagactaacagcagatctctcagcagaaaccctagaagccagaagagagtggaggccaatattcaacattcttaaagaaaagaattttcaacccagaatttcatatctagccaaactaagcttcataagtgaaggagaaataaaatacttaacagacaagcaaatgctgagagattttgtcaccaccaggcctgccttacaagagctcctgaaggaagcactaaacatggaaaggaacaactggtaccagccactgcagaaatataccaaattgtaaagcccatcgaggctaggaagaaactgcatcaactaatgagcaaaataaccagctaacatcataatgacaggatcaaattcacacataacaatattaaccttaaatgtaaatgggctaaatgctccagttaaaagacacagactggcaaattggataaagagtcaagacccatcagtgtgctgtattcagacccatctcacatgcagagacacacataggctcaaaataaatggatggaagaagatctaccaagcaaatggaaaacaaaaaaagcaggggttgcaatcctagtctctgataaacagactttaaaccaacaaagatcaaaagagacaaagaaggccattacataatggtaaagggatcaattcaacaagaaaagctaactaccctaaatatatatgcacccaatacaggagcacccagattcataaagcaagtccttagagacctacaaagagacttagactcccacacaataataatgggagactttaacaatccactgtcaacattagacagatcaacgagacagaaagttaacaaggatatccaggaattgaactcagctctgcaccaagtggacctaacagacatctacagaactctccaccccaaatcaacagaatatacattcttttcagcaccacaccacacctattccaaaattgactacatagttggaagtaaagcactcctcagcaaatgtaaaataacagaaattataacaaactatctctcagatcacagtgcaatcaaactagaactcaggattaagaaactcactcgaaaccacacaactacatggaaactgaacaacctgctcctgaatgactactgggtacgtcgcgaaatgaagacagaaataaagacgttctttgaaaccaatgagaacaaagacacaacataccagaatctgtgggacacattcaaagcagtgtgtagagggaaatttatagcactaaatgcccacaagagaaatcaggaaagatctaaaattgacactctaacatcacaattaaaagaactagagaagcaagagcaaacattcaaaagctagcagaaggcaagcaataactaacatcagagcagaactgaaggagatagagacacaaaaaacccttcaaaaaatcaatgaatccaggagctggttttttgaaaagatcaacaaaattgatagactgctagcaagactaataaagaagaagagagagaagaatcaaatagacgcaataaaaaatgataaaggggatatcaccactgatcccacagaaatacaaactaccatcacagaatactaaaaacacctctatgcaaataaactacaaaatctagctccctctccctctccctttcatctccgtctcccgctttccacggtgcccccctccctcgtctccgtctcccactttccacggtctccctctgttgccgaggctggactgtactgccacgatctcggctcactgcaacctccctgcctgattctcctgcctcagcctgccgagtgcctgggattgcaggcgtgcgctgctaagcctgactggtttttgtattttttggtggagacggggtttcgccgtgttggccgggctggtctccagctcctgacctccagtgatctgcccgcctcggcctcccgaggtgccgggattgcagacagagtctcgctcactcagtgctcaatgttgcccaggctggagtgcagtggcgtgaacctccacctcccagccgcctgccttggcctcccaaagtgctgagattgcagcctctgccccgccgccaccctgtctaggaagtgaggagcatctctgcccagccgccaatcatctgggatgtgaggagcccctctgcctggccacccagtctgggaagtgaggagcacctcttcctggccttcaccccgtgtaggaagtgaggagcgtctctgcctggccgcccatcatctgggatgtggggagcgcctctgcccggccgccccgtctgggatgtgaggagcgcctctgcccggccgccctgtctgggaggtgaggagtgtctctgcctggccgccaccccgtctgggaggtggggagcacccccgcccggcagccgccccgtctgtgaggtgggcgtgcccccacccggcagccgccccgcctgggaggtgaggagcccctctgcccggccgccaatccatctgggaggtgtacccaccagctcattgagaacaggccatgacgatgatggcggttttgctgaatagaaaagggggaaatgtggggaaaagaaagagagatcagattgttactgtgtctgtgtagaaagaagtagacataggagactccatttcgttttgtactaagaaaaattcttctgccttgggatgctgttaatctataacattactcccaacccagtgctctctgaaacatgtgctgtgtcaactcagggttaaatggattaagggaagtgcaagatgtgctttattaaacagatgcttgaaggcagtatgctcgttaagagtcatcaccactccctaatctcaagtacccagggacacaaacactgcagaaggccacagggtcctctgcctaggaaaaccagagacctttgttcacatgtttatctgctgaccttctctccactattgtcctatgaccctgcgaaatccccctctctgagaaacacccaagaatgatcaacaaatactaaaaaaattaaaaaaaaaaaaaagaaaagttcaaataaagtgtatgaaagaactttaaaaaaaaaaaagaaaaaaaaagtgcgaaaattagccaggcatggtggagtatgccttggggtcccagctactcaggaggctgaggctagaagatcacttgagcctgggaggcagaggctgcagcaagccatgattgtgctactgcactccagcctaggtgacagatggagactctgtctctaaataaataaataaataaataaataaatcctatttttaaatgctaaaaaaaaaaaagaaaatctagaagaaatggataaattcctcgacacatacaccctcccaagactaaaccaggaagaagttgaatctctgaatagaccaataacaggctctgaaattgaggcaacaattaatagcttaccaaccaaaaaaatccaggaccagatggattcacagccgaattctaccagaagtgcaaggaggagctggtaccattccttctgaaactattccaatcaatagaaaaagagggaatcctccctaactcattttatgaggccagcatcatcctgataccaaagcctggcagagacacaacaaaaaaagacaattttagaccaatatccctgatgaacatcgatgcagaaatcctcaataaaatactggcaaaccgaatccagcagcacatcaaaaagcttatccaccatgatcaagttggcttcattcctgggatgcaaggctggttcaacatacgcaaatcaataaacgtaatccaacatataaacagaaccaacgacaaaaccacatgattatctcaatagatgcagaaaagacctttgacaaaattcaacccttcatgctaaaaactctcaataaatgaggtattgatgggacatatctcaaaataataagagctatctatgacaaacccacagccaatatcatactgaatgggcaaaaactggaagcactccctttgaaaactggcacaagacagggatgccctctctcaccactcctattcaacatagtgttggaagttatggccagggcaattaggcaggagaaggaagtaaagggcattcaattaggaaaagaggaaatccaattgtccctgttcgcagatgacatgattgtgtatctagaaaaccccatcatctcagcccaaaatctccttaagctgataggcaacttcagcaaagtctcaggatacaaaatcaatgtgcaaaaatcacaagcattcttatataccaataaaagacaaacagagcgccaaatcatgagtgaactcccattcacaattgcttcaaagagaataaaatacctaggaatccaacttacaagggatgtgaaggacctcttcaaggagaactacaaaccactacttaatgaaataaaagacgatacaaacaaatggaagaacattccatgctcatgggtaggaagaatcaatattgtgaaaatggccatactgcccaaggcaatttatagattcaacgccatccccatcaagctaccaatgacttccttcacagaattggaaaaaactaccttaaagttcacatggaaccaaaaaagagcctgcattgccaagtcaatcctaagccaaaagaacaaagctggaggcatcatgctacctgacttcaaactatactacacaaggctacagtaatcaaaacagcatggtactggtaccaaaacagagatattgaccaatggaacagaacagagccctcagaaataatgccgcatatctacaactatctgatctttgacaaacctgagaaaaacaagcagtggggaaaggattccctatttaataaatggtgctggggaaacctggctagccatatgtagaaagctgaaactggatcccttccttataccttatacaaaaattaattcaagatggattaaagacttaaatgttagacctaaaaccataaaaaccctagaagaaaacctaggcaataccatttaggacataggcatgggcaaggacttcatgtctaaaacaccaaaagcaatggtaacaaaagacaaaattgacaaatgggatctaattaaaataaagagcttttgcacagcaaaagaaactaccatcagagtgaacaggcaacctacagaatgggagaaaatttttgcaatctactcatctgacaaaggactaatatccagaatctacaaagaatcaaacagatttacaagaaaaaacaaacaaccccatcaaaaagtgggtgaaggatatgaacagacacttctcaaaggaagacatttatgaagccaaaagacacatgaaaaaatgctgatcatcactggccatcagagacatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactgggtatatacccaaagattatgaatcatgctgctataaagacacatgcacacgtgtgtttattgcggcactatttacaatagcaaagacttggaaccgacccaaatgtccaacaatgatagactggattaagaaaatgtggcacatatacaccatggaatactatgcagccataaaaattgatgagttcatgtcctttgtagggacatggatgaagctggaaaccatcattctcagcaaactatcgcaaggagaaaaaaccaaacactgcatgttgtcactcatagctgggaattgaacaatgagaacacatggacacaggaaggggaacatcaaacaccggggcctgttgtggggtggggggagtggggagggatagcgttaggagatatacctaatgctaaatgatgagttaatgggtgcagcacaccaacatggcacatgtatacatatgtaacaaacctgcacgttgtgcacatgtaccctaaaacttacagtataatttaaaaaaataataaaaataaaacatattcacatatttacgtattcatgtatttaaaatatattcatttattttacactatgtgcaactcatttttctacttaagaattagagagatgacatttcggaggcccctaattccaaatgctgccgcctgtttttagtacagatctgtgttaagcaaaggaaaatgaagcggtcaaatcgcctcagaagcttccggcttccacccctgtttgtaaacgaaactccatattagtcaaactacactccccagggagcacctgtaaaagtccctgatttacagaagtatttactttagggtatggagtttgttttttcaggtttatctctgggagagcttggtgaagctgacagtccagcaattttattaaactgttcaatttcagcattttttaaagagcatatataaagaacaccggcagtagctatttaaatttcccagtggatgctagaaataataaaaggacacttaaatgaccatttttgagcagagccaacagcatgtgtcctaattatccaactatgtgaaaaattctgtggatttttaccagagcacaagggtgtgatatgcacaattcagaacactaacggctacctcactagggtgtagagaacttttcaagtctaaatataaggtcccagtctgccagggtaagtttttctgctactttccctcttgatgaacttgttagacatgataaatggacaacatggtaagaagttgatatggtccactgataagcctctgatgaagaacaagtaaataaaaaaccattgtgctaagtgctctccttcatttattctcacgatcacattctgaggtaggtattactatgcacattttacaggtcaggaaagcaaagctcacacaggataagtgccttatcctacagtttaagtatccaagctggtgttctgattttcctccactcacctcttcctatctcttctccacccacctcttcctatctcttctccacccttctctgccctgctggtggtctcttccttactgatctctacagactcatctcccgtgccctttggtttctatagggctaagacaatggcaggcagcattaagggatcagagaattggaggaaagagtctgggggtatctattccccatttcctctctcctcccctcacactgcacaactgagacttttgacaagtgcccacatttttctagctttgactataatttctgtcagtggccctttttccctaattcctagctagggctctcattggattcttgtaattctgttctctgtctttgctccttcagactttccatagttgcttcaccatcttttttggttcccttaaatctacccacacctctgtcaatcttctgttcattaaactctcttccaacctctcagttttggtgtcatccactttctgctggagaaaggagggtagcccctagcagttggtacctcctcctctctagcttccctttcatctacccacaaccaaccactcacccttcccttgtagccagtcacaccacaagcaagtctgtgactcagcaaactggctcccagaaacaaaccctaggagcataattgaagatgaacccaaagatacagttataagtatgctcgtggagaatttgtaattttttaaaaaatggtagttatctaagaggacttgattaatcaatgaagggacattcataaaatgaaaaattataaatgattaaaaataataccataacttatatttcatgacatgaacatattctcaatatattaacttcaaaagggaagatacaaagttgtgtgtagaataactcagtttttctttgtaaaaattttgtatacatggggagaaaatggtccaaaagagaccatccaatagaaatacagtacaaggcacataagtaattttagtgtcagtagttacgttttaaaaagttaaaagaaaccagtgaaattcatttagtgatatattttagtccaacatatgcaaaataatatttaatcatgtaagcaacagaaattaataatgtgatatattgaattcttcttttgcatatgaagtcttagaactccggtgtgtagttgacactcagagcacatgtcaactcagtcttgctacattttaaaagctcaagagccacatgaggatagtgactaccagattggacagctcaggtaagcctcaaaagcgggtgtgtagagtaggaagttgaatgttcttcactttcttattatttttctccttttttaccattaccatttactactgatgcatgtcacctctgcaattagaaaaacaaattatttttaaacactaagagcaaggcttttttcttctgtctctggaacactttttggctcatgtcctttgcaattcacagactacacacttactagtatagaaaggtgccctcctttcttcccctccctttacattttctttggatagctacctatcttcagccctcaggcataagagtaagaatcaaatgttgattttcttcagagtggctgctgagccagctcccactctccagtggtgtgacccggaatctatcaggcctcacaccactgttttagcagctctgaatggcttgtggaagggcatggaatggggccagaaactgcttaatttgaggttaattaaatagtgatgacaagccttaatctccaacttgtcatcagattgtaaacactgattgcagctgcagcaatctgcaataaacctattgagaggaatcttgaccagaatgaaataagtacgttggttacccagatgaggctgggagaggtgagatcagagaaatctaggcttttgcagtaccaggagaaatggagacctgaaaagagggaaattcatgggcgaatgtgtcaattctgattcctgtacagccctatcaaaaaaaagaaaaaaagaaaagaaaaaataactggatcccatgcacctggaaattggaaagaacaagggcagaaatataaaaccactaaactaaggacctggaaaaagctgaaatagctttacatctattagccattgatgaggtttccatgaaaaaatatgtctgagccactgcatgccctgaggccgctggacagatggttataccaccagagtgagctacagcagtggctttctagagtgcaggcaaggatgacagttacagtgtgttaggtctctactgtgtctcaagcacatcacatgtaacgtatatgataattctcaaaagtactttatgaggtagctattattttctccattttaaagaggagaatgctaaatctcaaaggagtatcctaccttgcttaagtacatgtaacaaatgggttgaacccagactgtctaatgccctaatgcaaattctaaatcacaagaatctctgcctccagctttgaggcaatgttgaagtgggaaaggggaaagaatagtcaagttcctgaagaagatgggaaaaaatgagtcaaaaatctccaaagaatagggaagcacaaagggctgaggtaacaaatgccagatgagtaaacatgttcataacactgcaccccggaaagtgcccctcctggctccattttcatggagaatgctttctcattcttcaagatccagcacaaggccaattttcacctcttctgtgaagccttccccaaacctcctagtgagagaggcactttaaaaaaatatgtgagatgcattgagagacagatggacaccataaaagctgaactcaatattacatgtgaagaaaatttacaaaaaaatcttaatctgagtgtcagaaaaattggagtagtgaaagaaccattacagttattgtcaaatagttaattaactattatgtaggtttaaatccatgtattcttccttaaaaccttttggaacaagataaatcattctcatccattcatttattcattccctagcactgtgataacactagagaaataacaatgaccaaaaacagacacaattccactctcgaggtacacatgtttaaaagggaaaacagagtaatgatacaaaaatcacacaaataaatggacaattatgacatgtgttccaaataagaggtaaatgagatgttattattttatccaggatacaggactggaatcattaaagagaatacacagggaaataagctgcagttcattatttggaaaaagtttcaaacaatccacacagaaatggccccacacatgagcctgctctcttctgggcattggatgtgtcccggctgaggcagggaagacaagggtgcatccgtcgataacttctcaagtctcttctgactctaagaaactgtgaccctatcattccaaacaaaatattttctcagataagaattagaattggctaggttgaatttccaggagacttaggaaatatgtacagagaataatcacttcctaaatagagaggggagtcaagcaaaactgagtcttctaaactgctcggtagcattctccttctcttcgcacatggacacacttctgctttatgcactgccctgacagcttcctgaggacagaggctgatggtcttgctcatcactgaatcatcaatgcgtggcacatattaaatatttgttaagtgagtaaatgaatatggtactaaaatgtgcatactgacagaaacttttttctgttgtggcccttgtaggtgaacttccttgaataattaatgaacatgaaagtcagtcaatcactcacctcctgattaatagtcagggtcccttgtccaaacagccacttagtccattaaaaattaataattttctacagaataaatatatgctgtacatggtacatcaagggttccacttttaatacgcaattaagtaatgcagaaagactaggaatctattaactaagaaagagctccatgaacttgccctccaagtcatcattcatttactatccatttctcttccaattttaaaaaattatttagccagaaaaaaagtagttctgaaaacagagtaaataacaacatgttgtcatattttggctaacatttgcaggccgacacaatgtgtgtttgttaaagatttgagatatgctattccttctgtgaaatgacgaatacattagggcagatcaatacaaaactgaagctctatatgtaaaatgttaagggtctattcattgaaaaattatgagccatgttatagaacttaggtcagagttaaattattgatctacattcatttttcccctttccatgtgactatcttttgattttttataacatacattattgcctatgtagaaaatgaatcctcttcttctagagctagtgtgtctggtgactgacaattttctaaaattaactgttgtgttggtagcatttagatttgtaaattgaactccccttgcataaacatttaaacattgaaaataaaatctgtaaactttggtagcatgaactcaaagggaaaagaggataattttcattttttaatacaaagaaagcaaagaaaaaaaggaaaggttatttttcttaacatcattctactactttatggttcttgatacatttcattgatgaggccaaattgtattcagttgactttttacaaatgactaaactgtattgctaagcaaagggatgtaatcaacactttgtgagctgaagtctcaattttcagacctaaagcttactcaagatgtataacctcaaattctgtaagcaggttagatgtcttgaaatacaaagactctcatcccctatcagcccccaaagtgacaaaggaatgtgtcttcaatgaagattttctctcatctgctgaaaagggaaaatgtgcaaatatttcaaagaaatgtagattccacagacccacattaattcatgaaaaaggaagctaatgtaagagttcttagtaggaatgatctttgatttggggctgtatttggtcagtaacttttgcctactaggagaatattttctctttaacgaagtagtatcagacacagagggctcttcattttctctaatggagatacaatcatttagattcgtgctccaaatgaggcagaaattacccctaatgtgtagtttgaacatttgtatcaaaatacagtgaaatgctgtttcagagtctgatgagaaaaatatgtgagctcacagaatgtctgcctctctcaggtgcagaagtggtctactgctttttttttcttttttcttttcttttcttttttttttttttgagatggagtctcactctgtcacccaggctggagtgcaatggtgaggtctccgctcactgcaacctccacctcctaggttcaagcaattctcctgcctcagcctcctgagtagctgggattacaggtgcacgccatcatgcccagctaatttttgtatttttagtagagatggggtttcaccacattgttcaggctggtcttcaactcctgaccttgtgatccgcctgccttagcctcccaaagtgctgggattacaggggtgagccaccacgcccggccctctgctacttttcttcacattgtcactgcaggaatcacctggctctagggggatatcccacagtctcacataaataccaatccctgtcgctggaacaagggggtcccagcctcacagaaggcctgagggactctgtttctctacaggtcagctccaaagcagagggccctttgcaccataaatcaatgtcatccacagaaaactccaggagaaagttaaataccagcagcaaacaatgtctcttgtgtagcagtctctcaccactgtttctgctaggtgacaaaagcagtgagaaaagcagaggaagcaagggctgaagacagaaaagtcaaagaattgcagaacttgagagttggaaaggggcagagtccaaataggaaaagacttaagcttcctactgtgttgtgctatgtagaatgctgtatgaggaagggcagcaggctttctccccagaagcccagctgaaagtcatccacactttacatggtcccctataccaggcttcagcccccttggccttggttttctcaacacacagtatggaatccatttctcatgagatggacttcattaaacacactcatgagaccaacatataaaaccagaatgtcaaagtagtagtctacgatttgcagtatagctgttgcacagatgtcagaaagaccaatacattcattcccttcctgtaaatgtcttccctgcaaaaccaaatcctaatcaggcagcaatctgacatgtaaggaatctgaacaagaggagttcatctgatgaactgaatgttaaacagcgtcaggggagatggagtcaccaatgggaaagaatacccaatgtcccttggctgcagctctctacatccattgccgtaacagaaatggccttgccaatagaaaaacaattctccaagtttctcacaggaggtcccgtcccctccaaagagagctacatgtgtattctttgtgtatttttatcattgagaaacataatttgaatgggaaagcctttctttcgttctaaaaaccctgcatcatttttctcattgcaggttaaaatatgttcattgtaaataatgaacatacggaaaagggtaaaagttattctatttcttccgcccagaaaactataggtggataatctttcagtctgtttctatgtatacatcttaggttgtccatataaaattatcattttgcagataaaaagcagtcaattaggtgcaattctacatggtccaatctcatatacatacgcacattacattaaagtcaaatgacaccttaacttctactttgttgcttttctttgaattaactagggctcatatacagttttccatgttactcggtaataccataattgattctcttgcacgcacttgtttaccaaaacttctcattatttccttagggaatattcacagacatagaagtgcttggttaaaggatttgcacacacacccattcatgcatatactgtctaaggttgctctcatcattaacagcagagttgagtagttgtgaccatactaccaaaaaacctgcaatatttaccctttagtcctttacagaaaaaggttgccaaccctgacctagaatccataattaactagatacagaatccagacatccattcaacaataggacacagacttcctatttttaaaaaattcaccgtgactacaagcagatctgcatttaaaatattttattcccattagtatttttaattggtccaaatgctctatgtgatataacttcactatcattagaatagtattaaagaatactattagaaaaatgtagctccattatttttactacagaaattattataaccgaagacataaatgcgaaccaaataaaacaaaataagttgtaaaaattcctttcttcaacaattgcataataatctataatacacatagatatacatgttcttaaatatttcatgtaaaaattggttactatttaataattaattttagaaacattaaaagaaatttaacttctgggtctttgatttgaaacagctaagaattttagactggtttccatttttaatcatgatcaagactcagaaacgtagctaagaaaaatcatattgtactttttattgaaaaggaatcacacagaccatgtctgaattattataaaggcttcattaattagattttaatctacatgactataccatatgctaaaaaaccatccaaacaaactctatgaaacggttttactgctattacttaaagagccatttaaaagaatttctacgggataaagactgggtgatttatcatagttttatgctcctttaatctgctccatcttcccattgtaaaataaatattggttttaaaataaatggttctgcccaggttttgatgagaaaaattgccctgtaaatcacaagctcacgtgtgccaaactctaagtccaatgttaactagcctattctgaagaaaaataagtcaattttatagaacaaaatctaaagaagacaattacttaagtgtattttcaaagctgcaatgtaattaatctgagatatgagcttctgtaccccaagttttttaattctcaaaataagaactagtggatatcaaactggtcctccaactggattttttaaaaatgggttctgtactatagtttttattatattctttccgaatccaatatacaagttatgtaactgaaaataaatacaatgagggttatatgataatgtctgagggttatatgatgacatctttatcaatcacttttttcatacacagagagccaaatcaatttaatagtcaggttcttagaatatttcatagtgttctgaaaaattgaccttacagtatacatattttcctataataagcatagtggttaaaatgctctggaagttatgaatggtttaaagcagtgcttcacaaactatttaggatgtaaaactagttgactatatttttcactccaatatgttgtgggttggtgatacttttataaaatacaataaaaattgcacttggatttagtggtagtgtcaaactgctatgacagtctctaaaccagcactgtccaacagaaatatcataggagccacatgtctgattttaagctttctagtagccacattaaaaatgtaaaaagaaacagttgaaattaattttaataatattttatgtagtccaatagatccacaaccttatttcaatatgtaatcagtatacaaatataatggagatatttaactttttaaaaaaattaagtcatcaaaatccagcatgtatattccacttacagcatgtccccattcagactggccacatttcaagtactcaacagtcacatgtagctagtggctgttgtgtgggaaagtgccattttaaaccattactcccaaactctgcacctccctcttcatgaactggtccacatacaacactttgagtagtactgtctaaactactgctcccttaaaaatggcaccttcatttctcttctataattttctactctgtgttttaaattgagggctccattccagataagtccaacacttaaagaaattaacaaactcatgattgcagctaactttatacatcctttcaggaaaggaatttgcatttataagggatggatacggaggtcccctctgctctcccttctctagaagcaatcactattctgaatgatattggtttctttctttcctatccatgtttttatactttttctactgactatgttcttaggatttaaataaagcaaagagaaaatttgtttgcacattgctgagatatatgaatttaatgcgtttagctcatacaaatcctgaccatattccatggcaaccactgaaaccgaatcacacacctttctacgtttgcaccctctgatcccctattcgtccttcataccacactgctttgatatatcattttctttctgctctgtatttagactctgttccaccttctagcctggataatttctacccattgagatcaaagcttaaatatcacttcttcaagtaacctttgttgatctgccctttgccctggtaaaattaggttccctgtcaaacactctcacttttcctatactgcacttaccaaaattgtaaatagtttctgttgttgttgttgtttttgagatggagtcttgcactgtcgcccagggtggtacaatggcacaattggctcgctgcaacctccacctcctggattcaggcaattctcctgcctcagcctcccgagtagctggattataggtgcccacagccatgcctggctaatttttgtattttttagtagagacaaggtttcaccatgttggccaggctgaagtagttattttttttactgatttgtttaatgtctctctcattcataaaaatatgttagcaccagcataattaaaagtatacagtaggtatccacaaatattaattgagtgaatgaatgaattttcattctcagaagccagacttaacctggtcattatgtttctcaatctctagtcatgacactagcttacaatgtgtatatcatggatatatatacatagggtatccctgttaattagaaggtatattttcaagagtatggccataaagaagttattcatggtatattcttttgaccttctattttcaattgtctctatatttagctcccatttttcatttctaatactgtttgtatttctctctctctctctctctttgttcttctctctttgtagttgatcaagtttgacaagtgagaatgtgctgttttagtctttaaaataatcattttttgctcggttgatcttctctactgtttctttgtattctatttcatttttggtaatatttttgtattattccttccctctactgtatttgggtttactctgctattttatttatacctttttaattgaatccttaattccctaacaatgtctccttccgtttctaacgtatacatttatgagtctataaatttccctctatatacctctttgtgtcccacaagacttaaagtatgtactaatttctatcatcatttttctttgactcacaaattattgacaggtacagttttgagtttccaaatgtataaagttttgaaaagtatcagtttctaatctcctgcttttttcctctgaaataaagaattagtaaatataatttttattcatcagcattaagactttctatgtgtgtatattatctgttagtggagtttgaagttctatatatgtctatttgtccaagctaaccggttatgtggtttaaatattctttatcttttctaagcttcttagcttgtttgatttatcagtgtctgagagaaaaatggttaaaactctcagattatgattatatgggttttcaatacttcttggtgactgtgtcaatttttactttctatatttttaaaaggatgctactaggtaatgtaggctcaggattaactcttcctggtgaattgttcttttatcattaaataataactctttatctgtaataatatttttgcttttaaagtatattttgtccgatattaatagtgtcaccagctttcatttgaatgatatttatatgatgtattatgtcaatttcatctattttctcttaatcttcccatgctattatccttaattgggttgttccttgtaaacagttaaagagagtatagctgttctctctatccaacttaagaatctttgcctgcagacagataggtttaatcatttgtatattggctttgattactgattatttggcctcatttcaactaattaatctacagcttcctaaaagtcagtaattatggcctctcactgaaccaagtactgcataccatagcaagcattgctgtatctatcttacactcataatttagctgttctcaataaataatttagacacattggcaaataatattctcttaaagcttcaagctcataagtacttatatatataacacagaaaatccccaactaagatggctaatccactactactcttatttctttacctataacatgaaaataagtgaatccacttgtcatctacctccaatgttgctgtactttcctcttcaacctcctcatttttaaaaatttctatcgggaacagctctcattctgtctcttctacctttcttcttccctatcccagtctctcacctgttaccttgacaattgaattagtatcttttctctccctgccttcatcctaccacctaacaatccaatgtttcctccagttaaatgagggtcgcatagtataagttaagaaatttgaactttaccctacagctcagtgtttctcaaactgaacccaaaggcacagtatcatagctccaaacattctatgagaatatgctttaggtttttatggttttattccaattaatgtcctgaagaatctaaatgacaacctgataattgagctatgctttccaaaagcagtgcctgagtttgtcttttttttttcctccatcaactctgttctgttctcagtatcactggaaccaaacaatcactttaaatgacagcttttaactttcagtgtgtcagtgagcacatctggctgctaggttggcatgtcctaatgctaaaattgtcccatgtctgctattgtgctcttcttgaagataatttgcaatggaaagatagtgtcatggaataagactttaatttattaagttatttaattaatggagactttgatatgacatcataaaaactcatagtgtggcagagtaatggtctattttaattgttatgggctaatgagaaaagaacaaaggcagaattaacatgtaaatgatgcgtttatatcaaatgaaagccaaatgatattatgggacagtgcaaaaggaagtttcccaatttttcaaatagagaaaagtggtgagaaaattgagtcatcatgtggctctgagtagtagaggcatgccaaattaagagtctttgccatagtagtcagcacactttattgatgaaacattaatttatcaaatatatgttaaatacttcatcaataaacagtgagtgttaaacactgttctaggcactaaggatacagaagtcataagatagtcaactctccagtgtcacggaagttatattctgacaataaaaagatgaacatgaatttataatacaacatcagggagtcgtaagtcttgtgaaggaaaacgaagcagggcaaagagatggaggatgatgagggaggaggaaagctacagtaggcaagatgatcaagggaggattctctgagaagatgacatttgagcagacacctaagtgcaacaggaggcaaaggcatacaaatatctcggggagaagatttccaaacaaaagcaagagcaaatacaaagatgttgagaagaacagcaagaaaaccaatgtcaacagactgcagggagaaaggagagtggtatgagactaggtaaaaagaagagggctgaatcttgaagagccttgaggtcatagcaaaaagcctgaatttaattctaaggatgatggggagttactacaggttttttgttttgctttgatagagtctcgctctgtcacccacactggagtgcagtggtacaatcttggctcactgcaacctctgcctcctgggttcgagtgattctccagcctcagccacctgagtagctgggattacaggcatccatcaccatgccccgcttattttttgtatatttagtagaggcagggttttgccatgttggccaagctggtctcaaactcctgacatcaagtgatccacccgcctcagcctccctattacagggtttatacagttcatgcagaataccagaaagggagatggggactgtggggatggatacaggtaggcttgtagatttgctagagaaaataaggtagtttcttctgattgtttctctttctccagtgaaataagaagtgagacaatcaactgattgagagagctggggatggccattggagagttgaggtacaggtgaagatataaaatagttttctcagaaagtagaagtattaggtaaacaatgcaggatcaccgtgtagaacagaggatccactgcagtcagcatagttgtgtgtcctccatccatccacactcaggcccaaagtaggtggaaagctgaatgagggtcatagttttgccagataagaatgacagagaaagatgagcaaaggagttcagtgtgcatgtaaagaagagaagaaccatagcatctgagctgagcaaggaggaaagtgaggatacaggaggatgacggattgtacataaatcctgtaagtcaacagattggaggccccacaggatcaaagaactgttggagtagagatgctaatgtcacctgaggcagcagccctgaaaagataggaagtggtggtcagagagtgggatgctgtgaaacatactttgaaggttagcatggcatttcataacaagggcactattggcatttggggaaaacaattcttcatcgtgcataacagtctcatgtactgaatgacatttagcatccttaacttctgccctctaaataccagtagcactccttacatttgcaattactccctaggagagtggtacttcctagattgtgaaccattggcctggggtatgactatgaggtagggagagatatttgcaagtgagaaactcagggacctgatagaccaggtatgagtattctctgtggatgtttttactgagaatgatgagtataaagacagggcgctggggggaacgtcttcaataaatacagaggagtaggctgtagaagagttttatggcatgtgctttaaaagcctctgcggaggaagagaaaaggaactgtctagaagtgacaatgaacaataccagaagacaccaactccactgtcagacactgagaaaaaaacagacacccctggagagggtgatggggaagcctccttaagagtttgccaagagtatcaagcagctatccaaaagaactttctgtgatgatggcaatgttgatatctacgccatcctataagatagacaataggcacatgtacttcttagcccttgaaacgaggccagtgtgtctgaggatgtgaattttttactttgatttgaacgaatttaaatgtaaacagtcagatgtggctactggctaacaaattggatggggcagaacagtaaaaggtgaaggaagcattcagaagacaaaattcttcttaatctctgagtcttgaggaaaagggcaagggcaggtatgagtctagggaagtttgtacatttgtagcaggaagaggtgaggagcatctaatagcacaatagcatcagcatttccaataagcaggattccaaaaattcattttaatttatttcagcctcctctcagactaaattctataccatattgttgtggaagacccttaaaaaaaaccctcaaatatttaaaatatcaccatcatgtaagaattatttcttctcctaagaagcatctggtattaatagactatgactatcgcgtgttttctaagatctaagtgtcccttccctccaaagactggctatctatatctaacaaaggaaaatgtaacatttgaaaattccctgttaaaagattttgttgtcatttggaaatcatatttcttgctgtttgcatttctattaaaaatataaagaaatttgttctttggtatcccaaatgaagtaaaagtattctaattggttgcattcacaagtctacaatttgcggcttaacaaaattatttttgaaaaggtcataacctgtacccacatgcccacccaaccacacacacagacatccagaatggtcttgtgatcatgtcttcagaagtttggctgcaaagttacaagcaacaactgtccatctgcacccaccaacctagtgaacaatgccagtctgggacccaaggactatttactcaacagaagaattccaacttcaggcaggggataggcgaagtccagataacatctagatatttcttgacattgcatttgattggaaataaaggaaaagtaaagcatttctggttagtttctgtttcttagtgtctctagttcccattttatttcaatcaaaatatcaaaatactctttagcccatagaggggacagagttcctagtttaataaaccctaaaatatataattaagataaagcctctgtagggttactcagcacaacactataattgctcagattccctagtggattctccagtcaatttctctgcatccttgaggcaaaatcttttccttaattgtcctcacttagaccaggtgctaggtgtccttcctagcctgcaggtcttacaggcccattcatccctaagggggtcttatatattaaccttgcttctgaactctaagcactggcaagtcaggcagaaggcccaaaggacctaacagcccataggtaactacaatgttggtaaggtggattctgccagatgccagccttggatccattttgggtccctacagatttatgcttctactataatgaatttcataatttctagtatgtgacccagggttgaactaagaagttattcttgctttcccctttagttttccctaatgggactttgatcaacatgaaaactaaaaatatcctggtgctagaccattaacactagttaactattccagactgtggccactgtcaaagacagccatcttgtaattgaattccactggggacaagaagactcaaaacagagtaggtgaatggattgcttaaagtccatctcagctactaaggagaatgaagagcagcagaaactgaattattaattcccaactctattcacaagccccctctggtggaggaagtattagtaatgaaacagctataacaataaccaaaatttttttaaaagagaaaaggcaatccacaacaaaacaatcagcccctgcagaaatgagagtcaagtgtagtgattagcaaatatgagctgcaacctgaaaaccacttacagatgaagcagtatgatgaatgatttaccaaaaggtcaacaccgctcttttgtcttcatcacccatcagttttccatcgccctcaatttgtctggcacataacagaaagcagggcataaaatattccccataaaaattaaccttactttgcaacattaaaaaaaaaaacttatagttgtatatagttgaagcgtaggggccagcttctcaattagtactcctagcatacagtagaaaaagcgttgacacttaaagccctattacaagaggtaatgttcttagcaagttccggaactctctgccctattcttgccttgctgacccactattctcaagcgaaggaaggggtcagtaatccccctaccaaataccacaccaatggtggcaggaggggagcatgtgacagcatttccccttttactctcctggaggccaaacttctttgcaatctctgcttttagctagcgtggatgccagcctttcaaccttgctatgcctgcaatactttctgacagatgagctatgagatgtaccaccttcccactcccatttgacaacctttgtacaaaaagaaacacaacgccaagggaaagtatatttttaggcatgagggattctgaaaatgaacatatctgcaaacttctagatccccttaaccagacctgaaaaagacattaatctattttaactaaactgattaaattgatttaatcagaaagcgggtcacttccctcctccctatcctgtcgctgaatttactaattgtttctccggctttgcccaatcaataagatattttgcatcttgcagatataatgtaagttatcagttattaaaaattcctcttcccggtctctggttaaagtgggtacctaaatatctgcttatttatttacgtcgttgttatttgcagatttcttttttaaaaaaagcagaattaaaatgaaagaaaaggtcaaaagagtttggaaaaaaagctatctacagggatgttcatcactgcatcatttataatagtaaaacttggaaatcttaaatttccaagcaaaagaagactgttcaaattaattatggtatagccataaagtggaatacagtcatgcatcacataatgaagttttgatcaatgacagaccacatatatgatatcgatcccataagattataatggagctaaaaaattcctactgcttagtgacgttgtagttgtcataaagtcattgtgcatgcattaccttttctatgtttagatatgcaactacttacctttgtgttacagttgcctatagtattcagtaaagtgatgctcacaagagtatgaaattgtctaatgacacagttttcattaagtgaggcatgactacactatgcagacattgaaaattaagtggtggaatatttaataacaaaaaaagatttgtggtactattaaggggggaaacacattgcaaaacagtagatactgtaatatcatatttattgagagctgttatctttgtataccattggtttgacaaacattcattggtcagccatcttccattcataacctcttctctccagcattccttgcacttgggaattgttctataaaataaaatattaaagaagaaggctgctaggtagggcttttttttctttttttttttttgagacggagtcttgctttgtcacccaggctggagtggagatggagtctgactctgtcgcccaggctggactgcagtggcacgatcttggctcattgcaacctccgcctcctgggttcaagtgattctcctgcctcagtctcccaagtagctgggattacaggcacgcaccaccacacctggctaatttttttttttttatttttagtacagatggggtttcaccatgttggccaggctggtctcgaactcctgacctcaagtgatccacccgcctcggccttccaaagtgctgagattacaggcgtgagccaccatgcccggcctaggtagggcttttcttcttgtctgattaaaaggagcggatttatctaacaggtctctttttgtatttatcctttatctttccaatctaaacataacgtctggaggaacagcagcttcattgtgaccatgaagacaaaaaaataacacgctaagaacagtagaagagaaatgccaaaacatcagctctagattatcctctaaagacttggagaaagtcactattggttggattttctttattttgcagctgaacacattcctgatacacaggagattctgtttttgttttttgcttatctgtggcttttatattttctaccatagtatgtactgttttatcataagaaaaaaatactggatacaagaaaaagggtcttttgtattcttcaagagaaatctagaggctgtgagttggagtctcaaatcatccaaggaacaaaagcacaggcaaagaagacatgccaataataaaattcttagagctgcttaacattattaatattttcattcccttcaacagaaactgtttacagctattagtattactgtttttcgagtcatggaacacttaagatctactatggtgtcaggtgctacttaaggcaccaagtatccaaacaataaggcagcccatgaccaaaaggaaccgtaacaagcaaacgaagaggaaaaacctagcagggtaaaacacactgcctaacattgctcagctggttaatggtgaagccaggactggaatgcaggtctcttgacacctaacgaccttcatcaccctatcatatgcttaacccacttaccatttagaagaaagaagtgcagcttgctaccagcacaacgctctcggagcaaacgggaaatgggttaagcattaatatctggctaaaagatgtaagaaaaactctggtgagagtatttaaggagaatgatctagatgggggtcaaaaaacatcagagacagaccttgttcttcattaactagtatttatagttatagcaggattgttttccctaaataaagggaaaggtctctttgagtggggcagaaaggattccactttttggctgggtgcagtggctgatgcctggagtcccagcactttgggaggccaaggcgagtggatcacctgaggtcaggagttcaagaccagcctggttaacatggtgaaaccccatctctactaaaaatacaaaaattagctgggcatggtggcgggcacctgtaatcccagctactcgggaggctgaggcaggagaattgcttaaacctgggaggcagaggttggtgagctgagatcatgccattgcactccagcctgggagacaagagcaaaactccgtcctccccaccccccccccaaaaaaaaaaaagagattccactttttatctatctataccacaccgaatcagtcgatcaatccactgaccacagattgtaatctcggccaaccactatagtggggaaagaaaacatagcagtgcaatcagctgttggataccacaggcaacttgacaagtcagtgacaacttggcctatttattcatcttttaaccgtttgttctggtgtctgtgtagtcacaatcaaagaatagtccctaggaatccatggagtttcattgaaatggagttagggctttggatcatatgcagaatctcagtactattccaggagaagggcagccacattgcctctgaatggccaaaacatagggtagtgaagagtgggagaatatgccagcccgaaatatgccactttagcctaaggattatgtggagctaaaggcacattaaaatacaaaacaaaacccagcaggtgcaagaagtgttctctaaccctcccctttttcttcctgaaaacatgaaacaaaacccccatatagaagacgtccagctataccagaaggaaagtctcattcttatcatcaaggatgggaaaatgagactaggaaaagtctgtacaaacagatcttgttaaaataattcttatcttcctttagcctttccacacagttgagttacttttccacaactgcctctctttgttcaacctaatataaaaccatctaggttttgccacttctttgagtcttcatttccttatgaggtatctcatgtcacataaaacttatattaaataaatgtgtgtgcttttctcccattaatctatcttatattcatttaagtcttaggcccagctgaaaagaaaaccctaaaagagtgtacaattttgcctcctctacagtatccatcttgaaagctgaaagttcactctcaatatgccttaagaataagaacaagtgggggcatgttttttagccatagttattcgtaacccaaacaaacaagtaaaggataatataagtgccaaaaatataaatgttgtctggattcacacatatcttatttgagtgactgtcattttatactgtcgtaatctgtttgcatgtctgtctttccactaaactatatgctccctaaacgcaaggacgatttcctttcatctttgctaagaatgtccaagccttcctccttccaaggctcgaactggattccaactataaaagtctataaaatatgacagctatttggaccgaaatccttcattccaaactatcctacttaaaaaaaaaagtcaactttttaacatttccaaaatatcctgaagggagggaaaaatcacacattaaattctgtcaagtaacatttacctcctcaagccctgactaatcggaaatgactggacttggcagctccttttatcacgtggtctatcagctaaatttagctcctgttgtgccaattgaaaaatgccaacatcccttcccatctcatacaacatcccaacccgccaatgactctagggtctctctggcaatctggtgtgaccactcctcatcagatcaaaatataaattacaaaccaaacttaaagtgtccaagtagccccatccagaagagcaatgatgaagttagaagagacgaagacgagaagggtgccagattcattactattgattccctgctggtctttcaatgtcacggaaagatgtccattatagttctatgaagagcatttggctcagtttaaactcttttgttttcagttcctttaaaaacaaaaatcaaccacgaaggataaacaactagaaattaatggagcccaaagggtttctgcagaatgagaagccttcatcactgcaccctaattatgtaaatctgctcctgcagagtccagtacatttatttattaagtctcaccactgccatcctggtaacccagagaagaagccaatctataatgactcaagccacatttcaaaatagactccaaaggacacatgatgtcatttgctaaaatgactcaatccagatggaaagcattctgacctatacataattgattgacctttgctatgctttccccagttatttatatactatcatatgcatgaatgtatatcagtggtatttacacttggcagctacttttaagaacacattattcaattgggatttgaagctttttacgaccatttcctgaccaaacattcataaatgacgaacaaggaaagatgttatcttaaaaataatgtttaataggctctggagagtttagagaagctttgctactctagttattttaaattacaggggacaagatctatgtacataaagctgagttcaaaccctgaaactgaggataccaaaggacattttatttactttccagtttggagctcaataatgatagtaaaatatgctgtacagaaggcatggaatgttttagatacatgtgagaagagcatcaactgtggtgaaggtagttagagacaataacaaattatcagaatctaaccatggatttcattttccaaaagaggttagctgcaaattggataatacccagataatcaagatagtttcaagatgatcatagaaggggaggcagatagattagggaaggcaaatatgaagcaagcatgtctttactcccattaggaatacccaaggcagacatccataactgattactgaattcttaaccacagagccctcacttggctcaaaatacttttccaatagtactccaggcaaacaccatcaaccaaacagacttgtcctaataacataaacagagaaagttgtatcttatttactgatcaaattaattctatttattgttaccatatactccaagattcaatctaaaactaaacaggtttttaaattcaaaatttaaagtcacatctctgaatcctaagaaaacgttaagtcaaatctagtagttttccatacttcatggtaggctagaatgacccttaatgtaaatgaaaagcaagcaggaaagctaaacaggagaagatgaaaatgcttatatgttcacataggaatattatatagcagtgaaaaggaaggaactacggccacatgcaaccacaggaataaatcttagaaacagaaatccaagtggaaatagcacatggagaagactacatacagcagtgctttccaagtagtgtgcctcagtaagtgggttacaagtgttcccaatccccttagttctggggtgaatagtacctggagtagccaaagtcttgtgtcaagccagagcatttatatcaggaggttctagaatattttcaagttctatgtatgccatgatggaagaagttaggaagcactgacatacaataattctttccagagattaaaccattataaaaccattttataatacttaaaaactaaaatgtatctgcttaggcatatatatacatatatatatatatatatatatatatatatatatatacacacacacacatatatacatgtgacaaatttatttcaaaatgataaaagaaaagcaaggaaaacatgaatggatacttcatccagtacatccattcattcagtataatggttactgttggaaacaataggcaggagatgagttaggtacaaaaacacttcagtagatggtaatgttacagttcttaaggtagatggtggttcatgggtgtttagtttattatactccaagcatattattttataaatacaacatgttatatactacttttctcaaaacatcaaggttaagaaggaaggaaactttttagctgattctgagtcaatttttcacagttgaatctcaatatggcaattcaagaatagatacaactacttttggaagactgaaactcagaggtcaagattttgtcctcatgcaactagaatagtccaaaggtttctaacagtcaactcatgtaccctatttaatgattacaagattttgttctaatccaaatagagtattaatgaaaaattgttgtaaacctaaagttacatttccctactgaaacaaaaacatcacaaaacccatatgtaagcctcttagttaagatccatttagttataaaaaacaaaacccaacctgaagtgttcaagtaaaaggattctggatgaggaattagaggtatcctacagcacataggatagcaagtacagccaggccttatgaagaaccagagccagggtgtaggcagcctttcagatccgaggttgaaacattctctctctcttgggctgcaggttcttgtgtctctacttctttctggaacctttactttattgtccctacctttagctgtgctttttctgctttggcatcgacatgaccaaatatttgtatctcttgtgatttaagtttaaaccaagtagtgccctgaagacaatttcaaaatgcccagaggggaaaaagaatctaattaacccaaccaaggtcaaaatctgtctacaccgggtttaatcagacacagctgtacataaggagttaccaattccaacaactacaggggccaggcaggtaattaaaagtatgatgctgaccaggtgtaaaaccagaagctggaagaaaagggtcttacaacaaagagaactcatgctgcctctccactttggatatgtaataatagaaatccagattttcattgaaatttcttgatttttaaaatacatctgtatacgttaggccacaggcttctactgtcagcgtcctacaaaaaatgaattgtgaatatttcagtttcggggggtcacactgggcaaacctgacttagataccagccctttgggtagaagagcaggtctcacagaagggctcatggtcaggcagtactgcaacaaagcctggattatgcactactttacacaccctccccatgaaatacacacatcagctaaacttctaaaaatatcttgttcaaaatcagatactaagccgggcagagataatcatcatgtagctttgtatgggttcatagtaaaaagcattaaaaaacaaagaaatcacacaaaagcaaactagagccagaaaaacacagcaccatcttcttcttttctttctttcttttttttttttttttttttttgagacagaatctcactttgttgctcaggctggagtgcagtggcgcgatctcagctcactgcaacctccgcctcccgggttcaagcgattctcctgcctcagcctcctgagtagctgggattacaggcacgtgccaccacacctggctaatttattgtagttttagtagagatggggtttcaccgtgttagccacgatggtcttgatctcctgaccttgtgatccacccgccttggcctcccaaagtgctgggattacaggcgtgagccatggcgccgggcccatcttcttttctgtccacagccaaaacatcctgccacaaaaggaccatttgttacaaaacaactgcatattcttttttcagttaactgaaggtaacacaggccctcctgtgtcaatttcttcaccatacaaaactgggagacacagaagtcatagcttaagtaagtgtcacttcctctcggaagcccagcctgagtccctgatcttgtataaggcaaatgtccctttacaaagcacctgtttcccttgctgtggtgcctaaccacagcacaactgatattgtatatgcacaactgtctatttatctcttccacataggtgagcttctggaaagcacagatactgtctaatcctccttctctgttcttaacacctgtttgttaaataaatacattctgtagtcagacatgtcaaaaattttattttttaatttttagcagctaattttaaaaatgctgaatttagactagattcctccttattcttttgtacgcacttaaaaattttcaacaaaacacttaaaatcttttactcagaaaagaactacacatatcactctgaattactacagactcaatatcacattgttgtggggctttcaagaatctgtgcttatatttaagctaaaaatccttcacagcacctcctgtcagtttgtagatacgcatagattttctcaatatacctgtattgatatagatataaatatacctggtatagaataaggcacggtaaaattctctacctagacataaaacccatatatttaaacttatgagaaatctggagaagtacagtatatacatgtccagcaagacttatgttccattttaaagaaatgagccttggcaaatttccctagcactgagaactgtttagcaagaattaatttttaaatgaaataagctaaaaataaaatagatgtagtattatttatacttaagtcttgttctttagcaattattaaaggttacactggtatgttttatcattggtaactggactcaagtttgaccaaatgtttctctttacccatgaaaaatagttgcaatgttccaattttgactgccattccaggtctttggtggcccttcatcaagtgcaatttggtagcctaaatgatatgggagggacagagcataatttcatggcagtaagtatagctgagacagaaaggttaaacaaggtccatgtctttggacacttgaccctaagttatgacagattaactttaaaagacaatgttttatcttgaacagaggggagttttgtcttctccttccagctaggtggaagtatttggcaaatgtcttctttggaaagaattatttagcaatggaattataatcggaattatttagcaatggaattataatcaatgtagtaaggacagaaaaagcaaactaaggacaaaggaataaatgaagaaatgacagccacacttgccaaggtgaattccattcagggaatttgccaaatgaaaaggatattaacattaacttaagcaggtttccttacttcaggaattgtctgtctttaatattcataatggtcctcatgaattttccaaaggatagagtatgcagcatttatgattatttaaaggctttataaatgtaactgctcttgggcatagtggtgctatcaggcagacctaggttgaaattctggctctgtcagcggctgtgatttcatgtgctaatttcttaactcttatgagcctcaattaccttgtctgaaaaatcagccctttcatttatatttcaacagaacttctgcccttgatgtccctttgaagttatttcccataattagtcacagatcatagcatcatcagctgcaatcatcttatctccattctattaacaaatttacatacattcttttgtatgttcaacaaacagcatatgccaagctgagctggcaactggacaaaaacatattatatgtggtttctgaacacccagagctcactatcttgttggggagaaaggcagtgaggaaatagtaatgcagagcagtgacaggtgcccataaggggttcgcctagtttggagaggagaaaacatttgagttgaaatctgaagagagaaaatgaagccactggagatgaagaaaacaaacttccatggggctgagggaacaagaatgtgcaaatgctctgtgggaggcagaaagaaagagattttgaggaggaaaaagggcagtgtagtttgcgtgcaaaaaccaggtgagcaagatgggagaatcaggagaggctttttctttttttttttttttttaatgtcaacactgtttggtgtttatttggtgagcctgagggcaattttcattctcatttctttttcttattgattatttccaaccctttcaacagtgaacatgcgttgcttttgcaattacaacaacaacaagaatccctatagacaaagcaaaaaatatatactttgtaatgtttttaaaaaacaaagattaaactacactaaaatataaggtgattatctctgaatgataagttttggggcagttttttttttaccctcatcactgctttccgaattccaaaggtaaaaagatactacttgaataagaagaaaaataaagagagttgtgtttcaagctttccctcttcccttcttcccaccctatctaacacttggaatatcccatgagggtctccaacgtcagcaggaactaagagccaagagtcgactgagagatgactttctttctctttcttttttgttgtgtggtgaagaaagaaatcataatctgacgtctaaagagcacttcactgttgctcttggttggactctaaatcacattgggaaaattaaaactacaatgagaaacatcttacaccagtcatgatgactattattttttcaattttatttttattacactttaagttctagggtacatgtgcacaacgtgcaggtttgttacatatgtatacatgtgccatgttagtgtgctgcacccattaactcatcatttacattaggtatatttcctaatgctatccgtccctcctccccccaccccacaacaggccccggtgtgtggccccggtgtgtgatgttctccatcctgtgtctatgtgttctcattgttcaattcccacctatgagtgagaacatgcagtgtttggttttctgtccttgcaatagtttgctcagaatggtttccagcttcatccatgtccctacaaaggacatgaactcatccatttttatggctgcatagtattccatgttgtatatgtgccacattttcttaatccagtctatcattgttggacatttgggttggttccaagtctttgctattgtaaatagtgccacaataaacacacgtgtgcatgtgtctttatagcagcatgatttataatccttttggtaaacacccagtaatgggatggctgggtcaaaaggtatttctagttctagatccttgaagaatcgccacactgtcttccacaatggttgaactagtttacagtcccaccaacagtgtaaaagttttcctattactccacatcctctccagcacctgttgtttcctgattttttaatgattgccattctaaatggtgtgagatggtatctcattgtggttttgatttgcatttctctgacggccagtgatgatgagcatgttttcctgtgtctattggctccataaatgtcttcttttgagaagtgtctgttcatatccttcgttcactttttgatggggttgtttgtttttttcttgtaaatttaagttctttgtagattctggatattagccctttgtcagatgcgtacattgtaaaaactttatcccattctgtaggttgcctgttcactctgatggtagtttcttttgctgtgcagaaactctttagtttaattagatcccatttgtcaattttggcttttgttgccattgcttttggtgttttagtcataaagcccttacccatgcctatatcctgaatggtattgcctaggttttcttctagggttttatggttttaggtctaacatttaagtctttaatccaccttgaattaatttttgtatagcgtgtaaggaagggatccagtttcagctttctacatatggctagccagttttcccagcaccacttattaaataggaaatcctttccccatttcttgtgtttgtcaggtttgtcaaagatcagattgttgtcgatgtgtggtattatttctgagggctctgttctgttccattggcctatctctctgtttttgtaccagtaccatgctgttttggttactgtagccttgtagtatagtttgaagtcaagtagcgtgatgcctctagctttgttcttttggcttaggattgacttggcaatgtgggctcttttttgcttccatgtgaactttaaggtagttttttccaattctgtgaaggaagtcattggtagcttgatggggatggcgttgaatctataaattgccttgggcagtatggccattttcacgatattgattcttcctacccatgagcgtggaatgttcttccatttgtttgtatcctcttttatttcattgagcagtggtttgtagttctccttgaagaggtccttcccatctcttgtaaattggattcctaggtattttattctctttgaagcaattgtgaatgggagttcactcatgatttggctctctgtttgtctgttattggtgtataagaatgcttgtgattttttgcacactgattttgtatcctgagactttgctgaagttgcttatcagcttaaggagattttgggctgagatgatggggatttctaaatgtacagtcatgtcatctgcaaacagggacaatttgacttcctcttttcctaattcaatacactttatttctttctcttgcctgattgccctggccagaatttccaacactatgttgaataggagtggtgaaagagggcatctctgtcttgtgccagttttcaaagtgaatgcttccagttttgccaattcagtatgatattggctgtgggtttgtcatagatagcttgcattattttcagacacgtcccatcactacctagtttattgggagtttttagcatgaagcattgttgaattttgtcaaaggccttttctgcatctactgagataatcatgtggtttttgtctttggttctgtttatatgatggattatgtttattgatttgcgtatgtgaaccagccttgcatcccagggatgaagccaacttgatcgtggtggataagctttttgatgtcctgctggatttgttttgccagtattttattgaggatttttgcatcgatgttcatcagggatattggtctaaaattctcttatttggttgtctcactgccaggctttgatatcaggacaatgctggccgcataaaatgagttagggaggatttcctctttttctcttgattggaatggtttcagaaggaatggtacccgctcctctttgtacctccggtagaattcggctgtgaatccatctggtcctggactttttttggttgctaggctattaattattgcctcaatttcagagcctgttattggtctattaagggattcaacttcgtcctggtttagtcttgggagagtgtatgtgtccgggaatttatccatttcttctagattttctagtttatttgcatagaggtgtttatagtattctctggtggtagtttatatttctgtgggatcagtggtgatatcccctttatcattttttattgcatctatttgattcttctctcttttcttctttattagtcttgctagtggtctatcaattttgttgatcttttcaaaaaaccagctcctggattcactgattttttgaagggttttttgtgtctctatctccttcagttctgctctgatcttagttacttcttgccttctgctagcctttgaatgtgtttgctcttgcttgtctagttcttttaattgtgatgttagggtgtcaattttagatctttcctgctttctcctgtgggcatttagtgctataaatttccctctacacactgctttaaatatgtcccagagattctggtatgttgtgtctttgttcttattggtttcaaagaacatctttttttctgccttcatttggttatgtgcccagtagtcattcaggagcaggttgttcagtttccatgcatttgagcggtttttgaatgagtttcttaatcctcagttcttgtttgattgcactgtggtctgagagacagtttattataatttctattcttttacatttgcaaaggagtgctttacttccgactatgtggtcagttttggaataagtgcgatgtggtgctgagaagaatgtatcttctgttgatttggggtggagagttctgtagatgtctattaggtccacctgctgcagagctgagttcaattcctggatatcattgttaactttctgtctcattgatctgtctaatgttgccagtggagtgttaaagtctcccattattatcgtgtgggagtctaagtctctttgtaggtctctaagggcttgctttatgaatctgggtgctcctgtattgggtgcatatatatttaggatagttagctcttcttgttgaattgatccctttaccattatgtaatggccttctttgtctcttttcatctttgttggtttaaagtctgttttgttagagactaggattgcaacccctgcttgtttttttttttccatttgcttggtagatcttcctccatccctttagtttgagcctatgtgtgtctctgcaggtgagatgggtctcctgaatacagcacactgatgggtcttgactctttatccaatttgccagtctgtgtcttttaattggagcatttagtccatttacatttaaggttaatattattatgtgtgaatttgatcctgtcattttgatgttagctggttatttcgcccattagttggtgcagtttcttcctagcatcaatggtgtttacaatttggcatgtttttgcagtggctgttactggttgttcctttccatgtttaatgcttccttcaggagctcttgtaaggcaggcctggtggtgacaaagtctctcagcatttgcttgtctgtaaaggattttatttctccttcacttctgaagcttagtttggctggatatgaaattctgggttgaaaattcttgtctttaagaatgttgaattggcccccattctcttctggcttgtagagtttctgccaagagatctgttgttagtctgatgggcttccctttgtgggtaacctgacctttctctctggctgctcttaacattttttccttcatttcaactttggtgaatctgacaattatgtgtcttggagttgctcttcttgaggagtatctttgtggttgtctctgtatttcctgaatttgaatgttggcctgccttgctaggtttgggaagttctcctggataatatcctgcagagtgttttccaacttggttccattctcctcatcactttcaggtacaccaagcagacgtagatttggtcttttcacatagtcccatatttcctggaggctttgttcatttctttttactcttttttctctaaacgtctcttccggcttcatttcattcatttgttcttcaatcactgatattctttcttccacttgatcgaattggctactgaagcttgtgcatgcatcacgtagttctcatgccatggttttcagctccatcaggtcatttaagttcttctctacactgattattctagttagcgattcgtctaatcttttttcaaggtttttagcttctttgcgatgggttcgaacatcctcctttagcttggagaagtttgttattctgatcttctgaagccttcttcactcaacttgtcaaagtcattctccatccagctttgttcccttgctggcgaggagctaggttcctttgtaggagaagaggcactctgatttttagaattttcagcttttctgctctggtttctccccatctttgtggttttatctatctttggtctttgatgatggtgacgtacacatggggttttggtgtggatgtcctttctgtttgttagttttccttctaacagtcaggaccctgagctgcaggtctgttggagtttgctggaggtccactccagaccctgtttgcctgtgtatcaccagcggaggctgcagaacagcaaatattgcagaatggcaaatgttgctgcctgatccttcctctgaaagctttgtctcagaggggtacctggctgtgtgaggtgtcagtcggcccctactgggaggtatctcccagttaggctacttgggtctcagggacccacttgaggaggcattctgtccgttctcagatctcaaactccgtgctgggagaaccactactctcttcaaagctgtcagatagggacgtttaagtctgcagaagtttctgctgcctttttttcagctatgccctgaccctagaggtggagtctacagaggcaggcaggcctccttgagctgcggtgggctccacccatttcgagcttctaggccgctttgtttacccactcaagcctcagcaattgcggacacccctcccccagcctcactgccaccttgtggttcgaactcagactgctgtgctagcagagagtgaagccccgtgggcatggaaccctccgagccaggcaccagatattatctcctggtgtgccctttgctaagacagttggaaaagcacagtattagtgtgggagtgtcccgattttccaggtaccgtctctcacggcttctcttgactaggaaagggaattccccaaccccttgcacttcccaggtgaggcgatgtcccgccctgctttggctcatgctccgtgggctgcacccactgtccgacaagccccagtgagatgaaccgggtacctcaattggaaatgcagaaatcacccatcttctgcactcctcacgctgggagctgtagaatggcgctgttcctattcagccatcttggaacctcctcccatgatgactataagggaggcttttaaatggtggaaatgaatggtttccaccaggacagtggcaagattcaattatcattttaaaaatctctgtcaagctacagtgtggaaaatggattggaaggagacaataatggctgcaagggtatcaattaagaggctattgtagcaaggatgataatttaaactgcaattggaacagaagatatggtaaaatgtgacaaatctgagagatatttaggttggtaattaattgggtaagagaactgtggtacattttacacataaagtcctaaggtgcagtatttgatttggtctataaattgtactccaaatcagctgatgcttttatagttagagagaattatctcagtagacgtaatacttctctttcaaaaactgtcatggttcttaatcatattccacaatggtcagtatggggatgtttatgcctcatggaatagagaaatcaaaaatttaaatctatatttgatgttaaatataaatagtatcttcttataaaaatacattaccattactcttagcttgatatattgtaaattgctttattcacctcctcagccatttttcatcagcagtagtatatgtgctccctgttcctggcagtgattcactggatgagaacataaatgtatttgtgggaatatgtatgaacgttgctctgggaacaaaagaaacagttctgttataccacattggtggtaatcattctttcccaaaatcattgcttgatcccttaaacaaacaaaacaatgtgaaataacaagcattgcaaatacctaagactttggtgtattgactgcctatctgtcaaatttgacaggaaggattaaccatggtttcaatatttacacttggattttgaaagactagataccaagttgatgactctttgaaaataatatagaaaagtatatataaatacataggtaaaaaggatgggacaaaagtgtcaatggttactgctgaaatatggttttggagtgcaagtataggggatttctgctattcattttatgcttatgcaatgtttaagttttaggagcaggtatcagtttctaagaaaaatcgaaaaaagagcagatatgaaaaacaagatcaataaaatagtttcactgtttaataatgccaggttagtgagaggcaacattcatcatggaaactaaatgcattacactagactttcactatttataattatttttctaggaccatgatcagactggcccacggtatataatctacaaattgactactgatattgtaagagggctcagccatattcaaataccatctattaaaaaaattaaatatgctaattcgccactacaatttaaaattcaactgtaggtaaataaaagtaaattgtgccaatatgcatgtggaattacttgcttctgatcaactaaaaaaaaattagtaagaaatctggtgaacatcgtattggtaaacaaaaacaatttttaaaggaaagtggcaagatccatgtccagtctgatccaaggtgttgccagaatggcagcccgagttgagagcagaaatgtgtttctcctcacacctttccaacttttaggctgtggtcacttcaaactaagaagcaaatcacatcttagcccatgtagtaatgaggttatccacactagaatgcataaacgtcaccttgtggcttgttaaaaacacagattcttgcccatcacaagattatattaaactgactagggtctctaatataatgatgaataaaaatggaaataataaacacatttatgatctcaacaagaaaattgttaatatttcaaattaagtatgaagtctgctgtaggactttttttttttttttcgagatggagtctcactctgtcactcaggctggagtgcagtggcatgatcttggctcactgcaagctcctggggttcaaacaattctcctgcttcagcctcccgtgtagctgggactacaggcacctgccaccacacccagctagtttttgtatttttattagagacaggatttcaccatagtggccaggctggtctcgaactcctgacctcatgatccacccgccttggcctcccaaagtgctgggaatacaggccgccctgcccggcccctgctgtagttttttaaaataaatatttatctgattaaggaagctcagctctattcccattttgctgagattttaccatgaatgaatgtgtttgtcaattttttccccttatctattgagatgatgatatggtttctcagttttactctattaatatggtaagttgcattgactgattttcaaataatcagcttgtattcctggaacaaacccaacttgataatgatatattattctttttatatatcactggatttgatttaccaatgttttggctaggatttttttttcatttatcttcatgaaaaaaattgaactgtggatttattttcatttaatacccctcatctttggggtcaaggttatgctggtctaatgatgtgagtttacatataactgatattgcttcttccttaaatgtttggaagaatttgctggtaaatttaaatgggctcttttttgtgggaagatttctaattatgaagctaatttctgtaatagatataggataattcagattccctaaaaatatatcaaatttagttgtatttttaaggaatttaaccatttcatttaaatgttcaaatttactggcataaaatcttactaatatcttttttagtgcttttttatttctgattattatttcaataatttctgctcttatctttattttcttctactttctttgcatttattctgtttcttttttagattcttgatactgattactagattactaattttcaggctttcttcttttctaagaatttaaggctataaatttccatataaaaactgctttagctgcaacatcaaagcttgatatgttatatcttcattatcagaaatatttttaatttttgttgtgattactttctttgaaacatagggaagaaaatattacctaatttccaaatattggaattctatcattatcattttattactgatttccaccttaatactactgtgaacagaagataaactctatggtttaaagcctttgacatttgttcagaagtgcttatgtctaggtatatattatatttactaaatctttaaaaatgtatatgcttatttggttgttgcagtgttctatacataagattaagtttgttacaagtggtgtttgaatcttctatatgtttactgacttttttgtttgttttgttttcagacagggtctccctctattgcccaggctggagtgcagtggcatgatcacagctcactgcaacctctgcctcccaggctcaagtgatcctcccacctcagccttctgaattttttggttttgtagagatggggtttcgccatgttttccaggctggtcttaaactcctacactgaagcgatctgcctgcctcggcctcccaaagtgttgggattacaggtgtgagctaccaggcccagccgtttactgacattttgtcttcatattctattaactacctgaagaggtatggtaaaatcccaactaaggctgaagatttgtatatttctctttttcagtgctgttatttgctttcaaatattttgagaccatgctatatgtacctatacatatagctatgtctgcttcttttggaatactgtgtgtttgcacaatgtttctctttttacaactttgaatctttatatggatttatatttagactgtacctcacatagttagcttatagttgtcttgttttaataatccagtctaataatctgtttttaaatagaagtatttagtgttttgtattaatataattaaggttatatttatattcttatcactatcttaatatattctttatttgtctcacagttttctgttcctaaattctctttttgtcttcaattaatcaaatatattttatattatccattttccccctctatcagcttggtaactgtacattctttaagtggttaccctggaaatgaaaatatgatttcttgacttattagaatctaccataattgatacttttatcctgtctggataaggatttcacattattttaacttcatttaatccactctcattctacctgttattgtttgttgcctttattttaattccacaaatattttatttttcaagctttttattatggataattcccaacatatacaaaaatagacttaataatctaatgaaacgttcatatttatcatcctgctttagcaatcattagctcatgaccaatcttgttccatctctatccccatccattttctctccaaatatattattttaaaacaaattccaaacatcatattacatttcttatgactatttctgtatgtatatccaaaagatgagtatgctttttataatatataactatgatgtcattatcacacatacgaaaaaataatgataatgggccaggcgcagtggcttacacctgtaatcccagcactttgggaggtcaaggcaggtggatcacttgaggtcaggagttcaagaccagtctgtccaacatggtaaaaccctatctctactaaaaaagtacaaaagttagccgagcatggtggtgtgtgcctgtagtcccagctactcaggagtctgaggcaggagaatcacttgaacccgggaggtttcagtgagcagcctgggtgacaagagtgagactctgtctcaataaataaataatgcataataccatcaaatactctggaaatactcaaatttccaaatgtctcaaatgtgataaccatttttataggtattttgaaatcaagagccaaataaattctgcatactgtgattggtttatttgtcctttaagcttaatttaacctattgattctccctcaatctttttttttttgcccccttgctatctatgcattggagaaaggggcttgttggaactgaagttttccacgctctgatgttttttcccccatgggtattgtattaaataaaatgcttcctagctgtaatttctgtttgtttgcagttagatctagaggcatgcagattcaagttcatttgttttgtttttggtaagattacctcatggctagtggtttatgttcttttctcttttcccataaatattcagggcctggatccgttaattcattaaaataaaaaaataagaatattacacttttaaaacatttattagcaggaatcctattatcaagagaaaattcccccatctatgtttacttagtcatacaagagatgtggaacaaatgcttgattttttacatttgtataccatttttcaaaacaacaaattggttcactaacatctttccatggtaaccaatcggttataattattcttaatgttatgaactcatggatataaaatatttgatgaatttgcatctgctgcagttactgtcaatgagtgcttaaattgttctatctttagttataggacttacactccactaaacattactttgattgttttaaacaatccatattcatagacacttacttatatatttatactttttggtgttcttcatgccctccttcatttacatgatttcaactgggactatttcctctgactgaggagctccttttaatagttttgatatagatatgctgataattaattatcttagttttaattttctaaaaatgtcctttttgaaggatgtgttcggtaggtataaaattctgaattggcaattactttcttttggcactttaaccatggcatcccattgttttcttggttccattgttttggtttaaaaattagctttatgtctcattggtgtgcctttgaaaatatatcttttttcctttggatgcttttaagatgcatttatttgtcttcaatttttaagcagttttactacaatatgcctccatattttatttggctttttttttttcttacacagtttcttgaatccatggcttgatgttattcattaattttggaaaattctttactgctattcttcaaataatacttatgccccatcttccctgaaatctcctcttgggcctccaattgcctgacacagacctttacactaaccaatatgtctcttataaaattttctttatttttgcattctcttttccactctgctttaatctggatattttcccttgatctattttccagatcatgaatcctctcttctgttgtgtcaactctattattaaacctatctacttagttttaaattacacttactgtaattttaactttcatgttgtacatttgattcctttcataggatctagatctctggtgaaattctctgtctcttcttgaacatattaatctcttatctgaaacagattatagctatagatcttatagctccaatttctcagtcacttttggatctgttacttttggttggttttctgtcttgattattggccatttgttcttgtttcctggcatgcctactactttctagtgaatgacagatacactttttatggaaattgtacaagttttgaatgatgttatctttctccaaagatgatttgattttcttctggcaggcagatagagtacaggaaaatcatcttaatccagttgaggctggtatatttccagtttgctcttaccctaggttgtagttcttcaggggcctcaaggaccttgagtatttccatggtcctacttctttgaaagccctgaactctgtgagacactgagactgctacaatatctgctttgccatttactcctgtatcagatattttcagctttatattttgttgtctctccctgggagtgtacaaaaaggcctcaagggaaaattccatgcagtatgttgaacttacatctctgtggctcctttcctctgggatcttgtttcctccagtcctttgttggtagccctgaactccactggtcaggaaagaatttaagctatttccactttagaaactaaaatcttaagttacgctccttgttgatgtattcatgcttttattttccctgatttttaatattttaaaagctggtcacattctcatcattttggtatgatcacaaagaaacatgtagtaatggaaaacaaagaagtattgaccttcactaggcaatcaaccctcagataatgtcaggaaatctgaagctttctcaagtaggagtatggaagagtggagaagggagatgtgttatttatcacagacaatactcagcacaattttattgctccttggggaatccaaagcttttaaagatgatattattatttggaaggcctccagagagcactaagtattaaaaatagcacctgcattctgctaagtcaaatcacctgtttattatccagggtgatgaaaatcatttaataaaatattacagacgcttgttcaaaatcatgcacacaattcataggctcagagacattaatgtctatgcctggctcactacatatttgttaaattgataactcaggtggacattagttaatattaccactttttaaaaattaatgatatcaagttatttgaaatagccagtagaaaacctctgcagtaacatttcccatttttcctcatacaaaatttacataaaacctttgctttgtaatagccactatcttttttctttagagaaccttctcctcctcctgcctttagaatataaatataagaatgtgactcaggtctggtcagtccctgttcatcccattggccagagttattggttcagaaatgagcatgtgatctacattattccattgagactcagtacttggattttatgaacactactggaaagagaattgctgctggttggtaaagggatagaatgaaagattcaatgtggttatcaccacgtaatgaagacctgcctaagactgaagccaaaactacttaaaacttctcagttacatgaatcaataaatgccctttgttgcctaagccagtttattaggactgggtttcagacctggaaccaagagttcttactaatatagctataccaaaaaagtgtgtagcagcaaccaagtctgtcaacaagagtgattaaccctcaggtttaagaacaaaactgaaaagacgcagtagcattaggaacatgtttttgtggtgataagatttattccagtccactgataatgttttactttcccacctacatttacaggatgcccaagacatgaggcctgaaatttatcaataatatcaaataacatagccccattcttgaagttccaaagttagagtattattggcatttttcacctattcctcacagagcttagttatttggggatgaagtaagttacagaagtttccaaaaaagaaggaaatctctatgtgtttcatgtttttaaaattctgtcttcggctttggcttaagttatggttactgatggtagctgtaagtaatattcccaggagaaaggctgcaaataaaatgagaattcctcagcatctttattgtccttcaagtggacacgaattcaagcaggtgcacatactgaggatcatacatttctactcatggcatttaattaggaggaaagtaaaatgtgcagggccagaactttaaatattagtttaataacctttatgcacctaatttctgaatgattttcttactctctggagaggcatctaatgtcagacagtggcattaaggtgaaattaaggtgagtcatggtaactgaaaagccatgaggcaggcacatgtcagaattattaattttaaaggatatatgaaatattttctcctctgaaaatatgcccagttaatgtatgctgaacttgaagtatggctttatttccctcattcacaactaatcactgtctccaggaggaacagactaaagagagaaagattacaaaagaagtatagccatttcaaaatccccaaacaaatgagaaatcaaaagaacaatgacaagcttgttggttatgtagagtaaaatttttagtgtgccaatcatggctgataccatgttttgaccatgtcaaaattcatcaaggcaggagttttcaaaccttttttgaatatgacccacagtgaaaagtatttctatatctatctgtaatatgactgtgtatgcatatacatttacaaaactcttaccaaattaaatgaactctcatattttctattctatataatttcactaaaagcaatccctaaattgtctcacaactcaccagtagcttacaagttgatataaaacatataatttgacatatattccacatcttaggctaagagaattacacatattcaaatcattaccaatgccaatttcagattaagactgttctgaaatgaaatcaaatcaactctttctacacagtggaaattcttagaccgtttattaacttcactaaatattttcataaagcatttgaagcaagatgctttcttcaggataacacctccaaacatactttgtatctttcgtttttctttttcttttttttttttttttttttttttttttgagacggagtttcactctgttgcccaagctggagtgcagtggtgggatcttggctcactgcaacctctacctcctgggttcaagtgattcttttgcctcagcctcccaagtagctggaattacaggcacatgctatcatgcctggctaatttttgtatttttagtagagacagggttttaccacgttggccaggctaatcttgcactcctgacctcaggtgatctgcccacctcggcctcccaaagtgctcagattccaggcgtgagccaccacacccggcctcagaacatactttgaaacaacccaatgcaagctcaccacctcaaatccagatccaaagacgacactatctttaaaacaaacaaacgaaaaaccatgtctctataaaaaggaatgaaacataatgtcacagggtgatattctaatgagacaaagaggtagtcccattatctgttttgttttacctggtggtatcaactgttgtttcatcactgtttctgtgaagaacatgttttcttaatgaacccttgagaaggacagtgatttgatgaatgaaagatgtgacacatgaaacaaaatattcctcattccacacctgtgtatataatatcatttggctctccaaattatcttaaagtttgaatctcatttcttccttcctcaatattttcttttaccatggaggcagggacagcaaagaaatgtttcctctccagatccactattaactgaaaattccagtgctctgaatacttgtttttttttttttatttttaaaaagggacctgaatttctattaaaggatttcctttattaactcctgctgaagaatttacatattggcaggttggaaagtaagccctgtaggaaagaaatcggacttgtttttcatcatcaacatgacggtctgatgatgggtgtatgagtttcctgttgacacccatgtcacatttactgaattactgttgagaccacagggtagacccagcttatacaattcttttgtcttctttctgcttcacagatcattcataatcacacacggggtaaaaaatgagggagcgaaaattgtgtaagctaattttcactgttgctggaagcggaagcaaatagttctcagagctgagagtgaacctgggtggtgaagagcagtcagcattaccggtggcaagttcagcattctgaccaaaatgagccactctgaaccctggtgttcagtcaatggcggtttcctcaaatttgtccttaaaagttgaaatgtatcatacttctgctcagccacccttaagaaacttgagtgtatgagtgtgtgtgaaatacaaataaaacctacacagctattgtctggattgaacaaacaagcaaatgtgctcagttttccaaacaattgcagatgctgtaataattcagaaaagtgtgtgctgagcagtgggggatgctggcatgctctgttagaatcattgtggctgggtgcggtggttcacgcctgtaatcccagcactttgggaggctgagatgggcaaatcacctgaggtcgggagttcgagaccaggctgaccaacatagagaaaccccatctctactaaaaatacaaaattagccaggtgtggtggcgcatgcctgtaatcccagctactcaggaggctggggcaggagaatcacttgaacccaggaggtagaggttgcagtgagccgagatctcgccattgcactccagcctggacaacgagagcgaaactccatctcaaaaacaaaaacaaaaagacagagtcattgctaaccatgttgcttagcacaattttggaaggaggcatgatgctggcacagaaaacccttgtcagaaattcctattccttaattttatgctctttctttcattcttttctcacttcattgtcatacaggcaagtgaaaaagagtggaaagagaagaggcggtgtcaaaggaaaagagaaaaaatacacctgactcctgttgtttatgattgtcttgtcagttaacacctgggcaatcatcaaccatgtactttccttgagccaggtccttaaagaacccaagatgaaggaagtagacagaagcagctttggggtggttagggtagtgcttctagaactttaacgtggctacagatttcttgggagtcttgttaaaatgtggattctgattctagagtggggcctcaaattctgcttcagttggtgatcttgttaaaatgccgtttccgattatggggtggagcctcagattctgcacttctactcttagggaaacccaagcctcagggttagtctttgagcctggggcagtggcctatcctgggcctttttctttacaggtatttcacttgactacttctccttttttcaggggcctgcagtaaagagaaataaagcatgacatagtctgaaaagcactggttctagaatcaaacaaacttgggttggaattccaactctgcaactgatttgcaatctgtgtggtcacaggtgagttttttgaatccctcttaaattcattttctccatctataaactgggtatgccattttttaactctcagggcagctacaaggaacaaatgagatcatgtgcatcatcaggtaggttcacattcattatgaaatgaatgactaaagagcctaaagcacaaccgttctatctacaggtaataaaaaggaaggtagggtgcaacaatgtttaaatacatctttatttttcttaataccatgactttggctcttccttagatctacagctatgggttgtgtagagttgtaaccacattaagccaagcatgtcttcccatttcgaatacttttctgactccagaaattcattctctgatcatgctttcagtaatgacaaaatccagaacagattgggtttttgaaaatatttcttgctatatcaaatgaggaaaatttgaaaatatttcttgctgtatcaaatgatgaaaatacatctgatgatttacttgccctcaattaattcagttcttaggcttgctcttctggacttctctggctcctgtttccaacaacagatttcccttcttctcaagctcccctcttcccagtctctctcctccaatctgaaattgggctccctttgctcccatagtaaataaggcaaaagtgtcccttcattcccatgtgatccagctggggaatctcagtttctctaaaggaatcaagaagatacttcagagttaaccagaggaattaaagaaaaaacagttaatgccagccttctccaaccttcccacatcagcagactgaacaaagcgctcaaaactcagggtttaataaagagggaaaaaggaggaggagctactttattgggtgtagtagagacaaagagggaaatagaagaaaattgtgaagtagtgacattagctgccatgtcctacctcctctggcagttctccagggcagacagggctggcagcggatgggtgttataactcctatggatcatgcctgacccttctgggcccgtcatgacttctgtttagatgacactaaagggtctcagggcagcatcagagcaggaaggatgtgccaaccacagaagtgccaactcatgacaagaatcattgctcattcagggattgctgcccctgccatcaccccctctgtcccaggatctgcattccgctgttctctctcctgcaagctgtgacagcagaagaggggcctccttcccattagctcatttccatctcggacttagtcaaaggaataaattattgtcagctcatctgtcttattagattgagccacatgatattgccatgttgttgctccaatactggcaatttcatgtgattcaacctcatctgctgtttagagaaaggaagtttcactgctatgaaaaactaaaccatttctgtggctgagctatgctgaccagaacagagttatctcaaattcatctactcaaaagctgcatattttaaactgaaatgcactgagcgtcttccttatccctactttccacatttctaagacaagataaattcagcaacattctttagaaaacattccatctccaacagcaactatcagtcaaacaacagggaatcattgtgcatttactctgtataaagcataagaaggataaaaaaaataaacacaacatcttttctgtccctaaggagtaactgacgtagctgaagaaagaagaggggaaaaacaccacaaaaaatgtaaagaatgaagcaacaatataaggaatgtcacaagacagaccatgatcatttgctaaatgagtggaatggaaaataagtacagtgagttgagaggcaggagcaatcacctagaatctgatgtgagccactttctatctaatttagctcatcaatcacctcaccctcccacctacttactgtgggaagttatcacagaaaatgaaaatctcctctctgcctactcataactcccagatgtcggttccagaaatgtatgcccagcaggtctcagaccactcccactcatttattgggtccatctcaggaaaagatgggggaatggggacatttacactggatgcttttctttctctaggtgaagtcagcatgacacaggaaaatgggagaaatctaaatgtgtgtgcctcaatataaactgtagccacctggtagcctagcacttttcctgacttcatgactccttttaattctgaatttcaacctttctgagcagttgccaatagtaaaaaaaatgacataaatttaagcatactacaaatacctgtttagatacaaatgaggtcacattaacacctcacagcccccctattttagcaattccctgcgtgctctcactcacacaatctcccatggtaccctgctcttcctctctgctgagggcctccctcttgaggacaatgcctagccatggaccctgtctctagtgtcctcctggagaagggtgtttcctttcccagggggtcatagccaagggctctgcaaggcagcagcagccctggctgccccagtacttctggcatgaaagccatgctgggatgttccatgcagaaatgcagataatacccttctgcccaacactgtcaccctctactgcctgggttgaataaaagtgaaagtttgctaaggtcccaaggcaacatctctgaccaggccttttctccttctcccctttcttccttccttttttttttttttttcttttttttttttgacagagtctcactctgtcacccaggctggagtgcagtagcgtgatcttagctcactgcaatctccacctcccaggttcaagcaattctcctgcctcagcctcccgagtagctgggactacaggtgcacgccaccactaccagctaatttttttaaaatatattttcgtagagatggggtttcactgtgttgcccaggctggtctcgaactcctgagctcaggcaatccacccgcctcggcctcccaaagtgctaggattacaggcgtaagccacggtgcccagccacttctttccttttttgagacagggtcttgctctgttgccagtactggagtacagtgatatgatcatagcacactgtagcttcaaactcctgggctctggtgagcctcccttctcagtctcctgagtagctgggactacaggtgtacaccaccatgtctggctattttttttttaagagatggggtcttgccatgttacccaggctggtctcaaactcctggactcaagtgattctcccaccttggcctcccaaaatgctgggatgaaagccattgtgctcagccctcaccctccacttctaatccataagaaagacgtgtcaattttacctacaaaacatccctcgagtcctccccttcactccatctcggcagataccctgttggttgcttattaattaccatcacctcttacctgggcctctaccacagcctcctaatgtcctgcttccactcttgcccttccagttcattctgcacaaagcagcaagagggatcttgtaaaaagactaaatggatcatgtcttcctagacttaaaacccttcagtgctttccctgctacactcagaataaagtcaaagcccttggccctggcctacggggccttccaggacttggccccagccttgctctacaggagactgtccagtgaaggttataaactcaaagtccactgcttcccatgagaagcctgggtcagaattctgggtcttctgtttaccatgtgaactgtggagctttgggccagcttcttagcttccctgcacttcagttcctacacatggaaagttacatatctcactggattattagaaataaagtgagatacaacgtatacagtgctaggaatattgccagtcaatagtaaatgcttcataaatataatcagcctggtctgctttcatttcttcgaacacatcttttccacttcagggccttccatttgttgtcctttctgctcagaatgctctccctcctccccgtttgtacagaaaggccttccctgactaacagatctcaatggggactctccctgtctcactctgttattctctgttgcaactcttcatttccttcgtatcacttgtatcctgtgataaactgccattattttctttctttggctattcactgcttattgtctttcccttccatgagactttaatctttataagtattaccattgaattccagtactagaacatcattttgactcagggatccttcaagagcttccatcactatttaaatttttacagtgaggaagtggatgaatcttactaatctctcatctcatggtctatttccatttggcttttacttaaagggtcctctttctgtggaggtcagaccaactctctggggcagggttggacaaaaaacaccatgattgactcagtctccccaactcccctgaaagtacatataagcttcttttcaaggactccttgccttcttggacagatatttaactaagtaacctctgatggctccttttatctcaatccgatttaccttctctcttgtgtgtgtgtgtgtgtgtgtgtgtgtgtaatgcacacacttactaagatgttggcttagcccagagtcctcagaaagcacagcctgaggcaaaatcttacataatcctaatttattggaatgtgccatccagggaaggaagagggagagaagaaggaaatgaggaagggacggagaacaagcagatagatacaagggtatatttctgagctggctgccactgttactcagcacaactgatgtcagatctccaggacccatcttctgaggcaggctgtgtgaatgacagctcctttggacaataagtcagggtaagaaggagatgaattccaggttgcacatacgtgggagctgagccatctagtgcatcacaggcctcagtggcaacatgggagccctgggggagatgacaggctgacttgagagaatgggagcagtcactgtaacagcctttggcccttggcagcaacaatgtcagcagcattagtgacctggctctgtaaccatgagagcagcacaaaccaggcaagcatacagatctggaggatggcctaaactaagtctcgtactgatgggtaggaaggtgatgactgtccaaatgtagtgtttgaggatggcaagcatgggacatataggctcaccactcctgaagcttgcactcatggcagacatctttgtactttgtactttgtctggctgagcccaagtacagcctcaaaacacttcttcatacagagctgtaatcagccactacatcacaacagtaatgcaaatgatgacagcataagataaaaaaaattgtaattcacacctgaaatgataaagacaaaaacagtataaagctaatgaaaatgatgaatttcagaaagtgaaaaatccaccaaagggaagcccttccagagcatcttccatctaacccagctccatagcccagaaatcagcgtctgtggatcttcttgatattgcaggaaaagagaatgccattcaaatgacagcttttccagaactggaattctatgtacaacctagcatcacagctctcatcattctgtatttgatgacagttttgtgggtttcatatcccaaaatgatacctgcctaattcacagagcaaagtttatttcatttaaagcagttctgatcaggggaaaatgtttcattgtggtgttataaggaattgatctgctaatgttcttcttaagctttgacattaattacagagaagatgcatcatcatttctactgacccttcattccacccccacctaccaatacacccacccaaatgttcagagctttgtatatgtgtcttaataatctgtcatccaatacttggcaagtgaaatgtgctatcatatggtaccaagaatgttcgcagctctggctaaaacttcactggatctgatatttaagccttagtggtgatctaacataggcagagaactgtgctaagaactgatagatgcagaagtgaataaaacactgcccctttcccttagagtagtaagttccaaactaaaggatagaacccaatagtgggtcttgacatcaacttaggaaattgtaacgagaaattttaaaagctacaatagaattgaatatagtagaacatatctcaaataataataaagggtatagtttcatgaaggggtgtgtgtgtgtgtgtgtgtgtgtgtgtgtgcatatacatgtatttctttctgtaggtgatctaacagtttgaaagcctaagttttccaaaggtgaaaaccatcattcaaacacataatgataaaaatttacgtatagagaatccctggagtcatgcagaatcaacattcagtatgcatacaggatggcagagattagtactaagggggcctgatattcaggcaatggtgagaatctagagtttgccttctaaagcccacattcctcatattactctctgctcagaaaccactgtatgtgcccccatcactacagaacgtaatccaagctcatgagtatggcattgaaggacctccaagcttatttcccactactcttcacctcctcccacaccttcttgatgccatactgttgctataatcatttttgccattttgaatgtgttctgtgtttgaatacgttctgtgtttttttacttctggacccttgcacaaactcttccttcatgctggaatgtctttccttccctatctgaccactaaagtaatatacttacagtggtcagcctttgttttgtctctccagcaagctatccgatcctccttctggtaataatattttctttcctttgagaaactccctgaaatttcatgggttctgtggtcaatcataatgccccactgcctatggccacaggagaagctctgtgacaaacatacagtgattggttgaaaaaaacaagcatgtgacctatggcagaacattatactctatctcatgtacagacgggtacaattccttctctgaattctaacagcagccctcaaaatacagtgagcataataattacctggaagacttgctaaaccacagattggttccacccccagagtttctgattggataaatgtaaattatggcctgagattttgcatttcaaataaattcccaggtgcgttagcttcctcctgttgctgtaacaaattaccacaaacttagtggcttaaaacaacataaatttatcttcttacagttctggtggtcagaagcccaaaacaggtcaaggtgttgacagggctgttccttctggaggctccagggtagaatccatttttttggttctctcagcttctagaggttgcctgcattccttggctcatggcccttctcttgcatcactccaacctcttactgctgtcctcagaactcctactactaacgcttacctcctgtctcccccttataacgacccttgtggttatattaggcctactgagataatgtagaataatctctcattctcaacccccttaacttgatcatatctgtgaagtcccttttgccataagaggtaacttaggcctgagtcctttcacctgaggattaggatgtggacaactttgaggggtcattattcagtctaccacaccaagtgatgctgatcctgatagtccagggtccacactttgaaaaccaatgaattactatcactatcaaagccagcctagtattttattctttagtctgtctgcctcccactagattaagaggttgcagaggctggaatagatcttggcctttttaaaaattgctttaattctatgtacattctcctttctgaatactggtaaatacatctttcagttaaactggaggaataggtaaacagtctgaaatgctgatagaaaagaaaactgtgaagataaaaccccaaagtggagaggtattggttaataggattatctggattccttactgccaacagtaaatctttctacctaattatgctcccaaatttcaaatttctctattgctgacaactatcgccattttgatgccccccagttatttctcatttttctcaaaccaaatttgtgtagctggccagcctatcctgagttctacctcatgggctctggatgtcagagatagcttcaccacacactcaagaactcaagccagaaatttcaccagcatcataggaatagccgctgacagttattcccccactgatatgtgcttggcaacgttctgagttctctgtgggcacttactcattaattcttaccattcttgtcttgtccatttaaaaaatatctcccatagtgctttacatgtagcatacatacactttataagtctacattgcttggttcattcagtagaccataagctccttgagggaagggatgggtcttattcatcatcttgttgccaggatgaaactatgtcacttgtacctcatattacatttgcagtaaaatgttagagagatgagaccatatgtgagcagttggaattaagtcagtcaagttgaagtggggtctaacatcaaattgccttgaaaagcaggcagaacttaaaacatgatataataggcatctcagagctagtgcaaaatcctaagcaagagcataaagctaatgttgggagcaggccccccaaaatctggccataaactggccccaaaactggccataaacaaaatctctgcagcactgtaacatgttcataatggccctaacacccaagctggaaggttgtgggtttagggaatgagggcaaggaacacctggcctgcccagggtggaaaatcacttaaaggcattcttaagccatgaacaatagcatgagcaatctgtgccttaaggacatactcctgctgcagttaactagcccaacctattcctttaattcggcccataagagatacttttagttaatttagtatctatagaaacaatgctaatgactggtttgctgttaataaatatgtggataaatctctgtttggggctctcagctctgaaggctgtgagacccctgatttcccacttcacacctctatatttctgtgtgtgtgtctttaattcctctagcactgctgggttagggtctccctgaccaagctggtcttggcaagctaaaatcattttatagagccaaatcagtaagtccccagtttagcttagaaacaatcagacaaggaccaaaggctttctaggaggtatgattctttgaagagacaagggagattgaaattgagtccataaaattctcttccatcttcctgattctaggtgttgaggtatctgtcctttgttcttggtgatttactatatctgattgcaacttagaattcaaacattaggctctgccttcttttccatccggattctaaaatcaatatctttactatgacgcttattcccaggattaatttatgaaattgtatgatgtgctttgaagactgaaggcttcttagagagagagggaatgtcaccttgtactatcaaaccagtatattaaacagttactgctttaaaaatcagatgtttgttggttgagatgctattaaatcttaacctacaaaaccagcacatgatcatttcaatggtacaaaggcaaactaaatatagcagatgacaattgctacaacataagagaaaaaatgtaatgtaatattttaaccatttagttatatgccacatgaaaataaattcttataaagaataagttttagcacttgccccatttgtgtgatagggtacctaccatgtgccaagggctgtgcaatactgtgatgaacaaaagaatccctacgtgatggagccatcaatctagtggacaggatggatatttaataattatgaataattactacataatcacaggacagaataaaatgaaggatttccaagagcaatgtgaacatagaaccaaatatggagcatatctgaggaaacaagaggctgtccagaggagaccatattccagctgagattttaagggcaaatgagagctgacgagcagcacagaaggggaaagaatcttccagcatttgatcggcatgatacataaaaggagagtagcagggcatgggctgggaacctggaggcctgttcaagactgttcagccttgacaaggtaaagggcaagaggtgatatatttgtttgagctgaatctctcagcattttgcatctcaagtctcctagttttaaacaactttctagagaggaggctgctctttatagaactgagtatatggaagacagccttgagaaccttaaattcaatgcactgtgtagaatataaccatgattctaaacgatacttgttaaaaggcttttttttttttttcaaatggccatggctttgttaaaaaaaaaaaaaaaaaaaaaaaaaaaaacaagataatttggtaactgagtagagacaggacaggtttttctactgaagtctttggtttatggatacacctatagtgttggaaggaagcatttgtattttaaggtatctttcctaggtttgttgctaagttcatggacagcatacccccatgaagatgacaacacagttcttctaagacattatttatttatgtatttattttttaggcagagtcttgctgaagtgccataggagtgatcacggttcactgcagcctcagcctccttggatcaagtgattctcctgtcgcagcctctcaagtatctgagaccacaggtgtgtaccaccacacttggctaaattttttttcttttttttttggagagacaggggtcttgctttgttgctcagtctggtcctgaactcctggcctcaagtgatcctcccacctcagcctctgaaagtcttttaagatatcatattacggaaactttaattaagctcttgctacatataagacactttgcttaggattcaatgtatatctttcatttaaccttcacaacaactctaggaggtaggcacaattattattctgcttatcaacgttgtcaactgaagttagaaaggttagtaaatctttgaagttcacacagcaagtcagcagtgaggctgttaatccctccccactgttaaccaggaaaactctacttctgttaaattctgatcattttttgctaaaggggttagcagtgcttttgactcttttatgtttccctttgatttaccatctaatggttattgctacagtgtttaataagcaatgcattatccctgggcagtggaagtaatatcattactcagagacggtaaacagaagtttgcatctgtgcactgcctggaggtggaagcatcaataaaagcctgaggtggaaggaagagatgaatgtgcaggcttgaatcagaggcaagggacgcaatttgatgtggggtaataagaaattctgcctaggctagcaaagaaacacaatcctttaccactcctagcctcaactgcactgttagatttctcctaacactgcttttctttgctccacagggtacaacagtcccagccccgcccatcacacccacaacccttatgtacgcccaagggtgcctggcatgcaagattctaagagcaatgggttgcaagtccctttgacaaagtttgcctggggaccaggaaatttaagtctacatccgaggaccaaagatatttaaattaaaaacttcctaccaaatccaacagcagctaagagagtggcgaatgcgatattacagaaattggtctgcagcctccaaatgccaaagtggcagcttgttatttatgataagataaggagcagctcgttactaaagatatccatgtcaaccccacgcattgagcagaacaaaggatcgttaatgattcctgggcttgtcatgttagaatggggtggcgatgataaaagagcatctatatatgctttccttgtgacatttcttatttttaaactccaatataaaaatatgtgttaattgttatgatttgtgtcacatgctatgctccagggctggacaggaaacagtgtccccattctagtatttttataataagcaataaacaaacaataaacaatgacaacaagaagagaaccactttccaggatcatatgattagttctgacatttgggaaattgcttcattgccagaagtcaattcccgcgattgcgagcatcttccacacataaaattaataatgtgcccagctcccctcctgccttcattttattatatgaaatttggacctcccacagcatgtaaagtcacatttttaaaataaaactttcttcctttataaaatatataaggaaatgtcttatagagttacacagacctttgaaaacatacatttttccattcctttgtttattcaggcaatacccgtttgagtacctactaagcgccaggtacttttctagagtgaatatgacaatgagggaaaacagacaattattaatattccaaatgaacaaaataagtttggtagtagtaagtgttgggaaaaaaataaagtaagtcaacgtgatagagagacaggtccttcctaatggggacgggggtggaggggcggtcagagagggactctctaggaaggtgacatttaagcaacaagttgaattacaagaaggaatcagccataaaaagatctggagaggagcattcctggcagaaggaatggcaaatgcaaaggcccagtgccggggacaagccgggcttgttcaagaacagatgaagttcaatgacccgagggcattgaggagggcccagtggatgcgggatgaggtcagggagtgggggcaggagcagatcaggtggggccttgcaggcctaatgaagacttagtattttatattaatgacaaggacagccaccgaaggttcaaatctcggaaatgatagattctatttgatattttaaaaattacagctgtctgggcgtcatgggggaagaaaatggacaaaattgtgttccactcaaagatagcatttcccttacagatcccaaggccctgtctttgtcagtacgggtagtgattaagaacatagtgctagtcagaaaacctaggtttgaatccttgctctgccatcaatatgccatgtgatcttagggactccatcaaacttactaaagtcttcacgtgaaaactataataataactcttcccagagtcttggtgaaaattaaatgagatataacacataatacagagtagtgttagtgcctagtacttgatacatataataatagctgttgttgttattattattattattattaaaattaggaagaagaaagagaagcataaggtaaagcactcagcaactactctgatcattcaggtgagaatacagacttatgggagacaggatggaggtttccatcagcatagagcatctctgtgctccaggcccttggacaaatgtcacctctttaatgtcctgaagacattaggtagaatctagaccaaaacagaattctggaaaaactggaaataattcagatgctcaccaacaggaacatgaatcttgatatcatggatgcaactcacaaatatgttgattgaggaaagctagacaggagagactacatgctgtgtaattccatttagatgaagttcaagaacaggtgaaactaactgctgttggtagatatcaaagcagtggtaacattataagggaccgtatttggaaaacatttggaaagagcacaagggagcctgccagggtgctgaaaagtgctctataacttgatctagatggcagttacatgatggatatacatatgtaaaaatatcatcaaaccatatacttaaattagcatactttataaacttttactgatgtatgtgttataccttaatttaaaaaaatatgtatttcaggggatcagaaagtcagctacataaataaacaaatggtgactgctctcttcaggaaaacgatgacctcaggactacttaggagccagttaatttccaaagctacttcccgtttctaagttaaacagctctgcacataatgtcagccacagcaatggcaaagaaccgcagggcaggtgatgaaaaagctcggcttagcagcaggacaatggggaagtgtgttaaactgggaccatgaccaacttcccaaaaccctctctggtgattgccagtgcctgcttaatgccttacctttcaattgtgctgaatttgtctgcattaaatgaaagttcgagggggcaggatcacttcttttttgttttagaaatatagctcaagtacctgtgtgctctataaagaataaaaataataacaggaggccgtggaacaactgaagtatggaacatgtatttagaaagtactttctggcatttcaataaaggaaattcagagggcttccagcataagaacaggatccgaatggattcattttcctgatagagtgacccaacccacaatgcaaagtcattaagtcccatcgcgtggcattaaaaaatgcttttaagctaagatcagccgaaaatgtgcccagggcagatttttatggccatatcatcacaacctgaaattcaaattggtgaactagctagaaatacatgctcactagaatggttcagagtttttctgcatctatctcagtgaaaaatgttagcaaaggaaaccttattttcctggaaaaacactatcaaataataaaacaattcaggaccagttttcacaaagtaataacaggccatacataattgattgcctttagtcttcgtctctgggtattacaaatcacagttactagcgcatcgaacaagctttcattccggattcagactgtccgtcttggcactgcctgaaacggcttgagcacctttattgcacactttactgcattgttcttcagttgcttcttcagtgaagttctgctatacccaacaatgttataccctccttctttctgtgtgtttactgactgtccctgatggtaggcaaaaagtaacttctagaagggaactgatttagacttatgatctcacctcaggcttgcaaggcaatacacaccacccagggagataaaacatattcctatgaaatcatatcctaactctctccattaaaactctagaactgcactaaaagcaggaaagatatactaaaattataccaattctttggcttaccaaacatcaggcagctgcatccataaaaaaaaggaataaataattcattccaaaactcttttttgcacatctcaaggctcataacattggtttgtaggaggaggtctgaacgagggcctagaaattctgagttatgccttggctataacaggaacctgatccctctatcttactctccctttgtatgtacggctaatgatatacacctgggctgccagtgacagtagccatgagccacgtgcctattgagcacctgaaatgtgagtagtctgaaatgagatgtgctgtgagtataaaatacacacaggatttcagagatttactaccaaaagaagaatataaaatatgattctttaataatgttcaaatattaattacatgctgtacatgccgaaatgataatattttaaagatattgggttaaataaaatatactatttaaatttatgttacttcttccattgaacttttttaatgtggttattaaacatttttttaagttatgtatgtggctcacatgtatttcatttggatgacaatgatctagatattctgaattgctatgaaagctaagattctctccttgtggaaatgggtaattacaagcctaacagttacgcatgtcttaaaggatggagaacgtgggggaagaggaagcaatcaagtcaccaagtgtattacatatttagttatacttcaattttcctaagcacattacaaaaagaatggaaagaaggaagaaaaacatgcacagtccttcaccctcctgagacagaaatgagactgaaaatggactttgaaatcaaaccatttcagattagaattctgcctctaacctcagtttctccatttgtaaaatggaagataagcatactcaccttttagagaattaaataagatcatgccgatcaagtacttaaagcaacattgggcacggttgggaataaagatcttggcaccggagatgttgaacctggagcggaagggacattgagaccaaaatgtccattgggcaatgggaatctgagcctggagaccaataaaaagatggatagatgcaagtgtcctagcaagcaagccgcacaggtgagaaaacactaaaaccaggaagggagctggtgtcacataagcagctcacacttcatggaaacatcacagctgcagctgagctccagccagtcgttcccatgaaggaataataatggtacagtgttgccaggttttccaattttctaagagaatctagaaatccagctttttaaatgtttagaaattttaaaaaatttagtttaatttaaaaagcactcattattccagagagaacccacgggaaaatagtttaataccagccaggcgcggtggctcacgcctgtaatcccagcactttgggaggccgaggcgggcggatcacgaggtcaggagatcgagaccatcctggctaacacggtgaaaccctgtctctactaagaaatagaaaaaattagccgggcgtggtggcaggcgcctgagtcccagctactcgggaggctgaggcatgagaatggcgtgaacccgggaggcggagcttgcagtgagccgagatcgtgccactgcactccagcctgggggacagagcgagactctgtctcaaaataataataataataataatagtttaataactctgctgctgcctcaaaggtcaacaaggtaacttgttagatttctaccatatgaaagttaacggggatctcagatgaaattcccacaagcccccaaacagttgagctgccaaagatgaagagggagatttacctcttcctcctcccagctcttcatgctgtaggaacacagttgctgcgactacaggtgtcccagcggtctttccctctccccagaccgtgacctggatgttatgcagaatgtttcaaagagagctgcaaaagcacaaggactttttacaggagacacgtgacataaaccaaggtgctactccggctattatccattgcccgctttaggtctctctggaatattgtctgtttccatttcaggcactctcagctactacccattttggttaataaattatcatattgtgtaaatgtatacaatctgtaagcctggaagaactgtctggaaaaaggatttttaaaatatcacactaaaaaaataaatactagtggcctctctgtatctattgtaaggagtaaaaggatttacacctgaaaaattaaaattacagtagctactctttcctcaagtggttcttagcaaatgcattttaaagaggatgactttccagtgaacactttaattttaatttaaccttcccagaaaatgaagtgctttgtgtagattcttttggttttatttaaggcataaaaattagttctgaactgtgataattgtgggcttaggaatgtaatcattccaagcaccacttctcacttgcttataagccctacaggtcttgagttgctgtttattgctaattcgaagttggcaagttatttaactgtgaagctgaacttgaagtcagagtgtgacgagatggtgggaggtagattgttttgttttgctttcaacaggttatccaaagcccggatgcaaaatgcggtgcaagacacggttctagatatgtgctcctctaactcttaatcttaattaaaatgggatgatgaaatgttctaaaggtggaataaaatattacattaatctataactctatcttgtcaaaccaaccacagataggatacaggttcctatcatccacccttatgattttgttcttaattgtggcattttgttgttgctgtgaggactcaacctaaatactattgcttctatttgattgtttaaaggaaaataatgtaacaagctttggtcatgaaaaatcgtaatgtccataatacagtagatgcagcatttctaaacattttagaattacgtgtttgaatccacgaccacatactcacatacatataatcaacattaaccaaagggtcatatggcgatttttttcctttataataaagagatcctctgaaacattttaagataaatgaattcctgcttaagtatgggtgcatttgaagtgagaatgctttgaataaagttatcattttcacacaccactatgcctgaaagttatgagcattcagacagaaatcattgaagaaaacttaataaaaatatgtttggcatatgccgtatttagtgtgatcaatagtgtttagtaattcaagaaatgaattaaaatttcaccctcattttgccactcctaaatttccatttgaaaaacaataagagaaattattaactccctgaatatttctaatgggcttctcagcattattgagtaaaactaactccacattgcaggcctgtgtgctgactcaggtttccaaggtttctctgggaactctttggtctgttgttgctgttctttattctttattgaaaggcatttcctagtgcatttcctaattttaggcacctggctagactttggggatgaaacaatacatgtggcagaatccctgcccttgggtgccttaccctctccttcatacagcatctaatggatccaaaaccagggagaaggtgcacctcacagccacaggctgcaacagagaaaggtaaagtgctggtactacctggtttgtgtttgtctgtctgtctctttcttttcttctttttagtaggtgtcaatattttacataaagatctaaatttctgacttctcttaaaaaaaaaatcagaagatcttagcatactggaccagaaagactacttggcaacatctggctgaagctgtggggtgggagtgttgaggggggtgtggatggtgcacttttcctagtcatctctggatcaaaactggctctagtttgccagtgttcccaccactccctatagttttatactcactcatatccattacctgctttgtcctcgtattacagtatttacattactgacctgcaagaagtaactagcagtcagaaagcctgatactagcccttggtctgctgcttattaaatatatgacctagcatgaattcgtgaattgcataatgccttggagcctcagttttctcttaaaaaagattaaagacaaaacaaaacaaaacacgccttctctggcactgcaattgcaaatctccaaaaagaaatctatggaggggtttccaaacctggaaagcattaggccaaggaataatattattgtaattttgttttcagaagaaatatctagaaaatcagaaataacagcctatatctgattatacctataaagatcacaaagcactctcaactgaattaaatctcatgtgacctctgagataaatatcactttagccattttgatgatgaagaaactcaggctgaaaaggaccaagggatttgccccaacaccaaatgctgacatttttaaaaagtcaactttcaagatagttcccataattttaacacctatgaagacactattaacaactgacatcacatgatgaaacaataaccagtaagatgagccatcactttccaaggatatactctggatagagagtagcagcttctttgagctttcgtttgtttgcttgttattcaagagcaacattttttaaagggtattacatgttgtaatataaaggaaatattttaagtaaatatttgtaataggtactcatttggacttctaataaactagtagggttaaagcttttgaggacgcactttctcattaaatgtttgtcaacattacattattttcttagagattgtcatcagcaagtaacttctatgagaaacaaatgtccttaattttattaaagtctacttttattaatcccctccctacccctaattgagctaatttgaaccatagtgccattcagaaagaaatatgagaattcatctggctcattgtcacatacattttttccacaaagaacctaatagagttaaaagcttgatttaaacatgaattaaaggtttatcatttacctttaggaacaaactctccataggaatagtaagctcttttaatgcatttacattttattaggcttacagacattcaatttattggtgtctttaggtacacatttactgcatacagtcaaatatataacaccttcatagtaactttttttaaaaagagaaggtagacttatttaagttttttcatggttcaccataattcaggtagcgaagtctaaatgaacaagcagagggcagatgagtgactttaagtgcacaggagatctccacatagtaatttagagacaccgtgggaaataaataaggagatacgtgaaagagtaaccagctcttggcaggacatgtatatgactgagtaacatgcaaactactgtttatacattgcaatcagctggcagccaagcaaaaagcttatagatgagtaaggacactgccacagccatgtttttgttctgaacctcctgattaaacaaataaactcagactagagagccacatggagaatacaatgctagggatacaatacaatagaatacaatacacttagcatgcagggtctaaatattaacagcaactgcagaagatatcactgcagatttgagtaaactttctgaaacaataatctacaaaaccagctgtgtttggtgatggctcttcataaaaacaaacagttgcaagaaatctaacaggattccaagctacagttcttagcttatagatttcaaacactggagagaaatgcataacatcccagctttttattctccaaagtgaagattttgaaagcaaataggattactatctagtatggtcatcataacattttttaaaaagacattattattctggaataggaagtatatgatctccttacaatgaacaattccatgtagaaaaagatagaatatctgcaaagcacttttgaggtaggttaaggtcctgggaaacagattcctcatgcatttagcttgaagaaaggtttaaaaggaattctttagggatcaacacctgcagaaggaaagggaaatagaggaggaagcaggtgagctgaaggagaagtcccaatggtagcttgtggggaataatgaagatggggtgccttagcgcattctggcagttgtaaaaaatatcataaacaacagaaatttatttatgatagttctggagactgggaagcccatcaaggtaccatcagatttgatgtctggtgagggcccacttctggttcacagatgatggcttctgtctgtcctcacacagtggagggactagcaagctccctggggcctcttttgtataggcactaatcccatccatgagggtggaaccatcacaacttaatcacctcccaaaggccccactttgagggttaggatttcaacatagaaatgttgggggtacacaaacattgagaccatagcatggaatgtcctgagtgagggtgagaagggaggggcctttttaccctccagtgatcagtcactggaagcaggccacctcatgaaggaggtatgcctttgggagagggttgtctatgggcagcaccacagcaagtagggtgataagcccttagctcctaaaggaggacctgagcagtgcattacagagtccatgcgacacttctgttccaggctagataaaatatttttaagctctggctgtaaggacagtcacctttaagcttttaatcttagacaaccatcataatacaagggctatttgagacacaatggtaagacattaaaaggtcaaagcatataatgctcttactgtccatcagataacatctccaggaaaatcagtcctgctgctctttgataccaaatggcttcttaggtatcagatctgctggcttgttctgaaaaaaggtagagtgaactcatttttctctactccttccctctaaataccctggaagttattcaacgggaagtgataaagaactctaaaacctggaaaaaaaaggagatagaaactgactaggggccttagcacttgagggacaacaacctggtgagttccgtggggtttcctttttatttccaatataccctatgccgggttccagagacggctgcaaccccaaaacagcaacagggagagcctgctccctctggtcaaatgaccagtaaagaagtccagtagagacctagtggggaagccccagccccagcccctactctaccactagggcagcgatgggcagtgaggccctaggccatcccaaccatatatctgacaaagaattactatctacagtatataaataattctcaaagctcaacagaaaaaaaaaacaataaacagttagaaaatgggcagaaaatatgaagagacagctcaccaaagagcatatacaggtagtaagcacacaaaaaaatattcgacatcattagccataagagaaatgcaatttaaaaccacaaaaatattgttacatatctatcagaatggctaaaataaaaaagcagtgataacatcaaatgctggtgaggatgcagagacactagatcactcagacattgctgatgggaatgtaaaatggtacagctattctagaaaatagttcagctgttcattttaaaacaaaaaataaatttgctatattacccagaagtggcactctcgggcacttgtcacagagaaacgaaaactcatattcacacagaaatttaaacatgaatgttcgtagcagctttatttgtaatacccaagaaatgaaaattatccaaatatccttcaatggataatggtcaaacaaactgtgatataacataacacggaatatttcttagcaatacaaaggaatgaactattgatacacacctggatgaatatcaaggaaattatgctaagtaaaaattaaagccaatctcaagaagatacatactatatgattactttaatatagcattcatgaaatatgataatcatagagatcaagaatagagtagtggtggctagttgttcagaatggggtagggaataggtgttgactctacaggggtagcatgagggagtctctgatgatgggacagtgaagtatcttgatagtggttgtggtttcatgaagctacacttatgataaaattgcgtagagctacacatgcacacatatacacacacaaatgagtacctgcataactggtcaatctaaataagctctatggatatgcattgtactaatgccaatttcttggtttttatattgtcctctagttaggcaagatattaacattggggaaaactggaaaaagggtacacaggccctccctctacatttctttgtttgtttctgtgtatctactgttatttcaaattttaaaatttactttaattgacaaataatacttgtatatatttagggggtgcaatgtgatgttttgatatatgcatacaatgtagaatgattaaatcaaggtaattaacatatctatcatctcataatttatttgtggtgagacatttgaaatttatactcagcaattttaaaatatgtgatacatttttatttactatagtcacaatgctgtgcaatagatctcaaaaacttattcctcctgactaactgcaaatttgtaccctggtttttgcttttatttttgagacaaggtcttgctctgtcacacaagctggagtgcagtggcccaagcacagtttactgcagcccaatctcctgggttcaagcagttctcccacctcagcctcccgagtagctgggactacacgcatgtgccaacatgccaggccagtcttttactttttgtagagacaggttctcactatgttgccctagctggtttcaaactcctgggctcaagtgatcctcccacctcggcctcccaaagtgctgtgagccacaggcatgagccacaggcattagccactgcacctggccactttataccctttgatcaacatctccccattccctctccctatcccccagcctctagtgaccaccattccactcactacttctatgacaaaaattaaagtttgtttcttttttttttaattaggcccgttgattgctcagggtaagaaatcgtaataaaattctaggtatttcttcctttgcaatgtgccagcatctgcatctatcactggaaagtggattgcaaacccatctcagatgcccacacctccattaacctctcctactcccggcccaatttcctgctccataccccttctgatagttgcttgcctggaatcccttcaatggcttagcaaactctatggcagttcctgggttgcacttcaacactttcttgaccctggcccacctctgttgtaatccctttctcaaggtctggtgcaattaagaatgctgctgaaagggtttttgttgtagttcgtgcctatcaaacacagactattctgattacttgtggcattttgcagtgatataaaattaaaactaaagcacaggagaagaatcttaggtttttatataaataatttattgtctataaattctcccaagaggaatctatgtcagtctacagaaagtgtctctccattgagacccataccatttgcctgtaaattcagcacactgatagccatttgcaatctgcaaaagaaaagccatctatctaaaggggcacgccacactgttattcctttgtaatattaagaaatttatcctaatttaaaagataactgaattcttattcttttacaaattagactttaaaacacagccactgaattgaccaagcactaccaagcttttatcctacttttatttaaatgtactgaaacattagtgatgaaagctttcatttaaagaattctgatgattctaatattcacttataatgtccatttagctaccacattgtgtttatgccccttaaaagctgaagctatgactgctctagtactgagttctccagtgcttatcattaattaaaaggtaaaacacgattaccagggtatctgcaatcaagctttcaatgtaagaaatatcaatatccagtacttgagaacattttggaaccaattttaataggtaaaaaagtccaaagagaagaaaaaatgttctttattatttcaaattaaaaccagatcagtatatcttactgaaaagttgcaattgcccatgccttccaggcatctgcctagtttttctcttatagcagatgctaaagaagagaaatctggcatgtccatttctgtaatatttacagatataacacatcagcaatacatcagtttggttttttatggaagctaacctcaagaagcaaaacatgctctgtgagtgtacttgtgtacttacttcagatcatccttatgcttgggggtgggcagacagattattaaataatgactgtactgagtgtctactaagcacagtggtgtacttgtgttgagggcaccgagacgaatagaagaatccctaccctaaaggagtgcaaaatctagtatcggagccacatgaatattgtgcaagtgaaagaaggtgagcacagattatgtccatggtgaaacaaaagttctgaatatctgttgagactgataaaaatagatcctgctaatgttaatggcaaaaatggcctgagtgtctttagctccccaatcaactctaccagtatccacccaagccaccccaaataaagtgtttgcccagtgtacatatgcagtttcaaaaaagttgcccggtttctcctcttctgtattggtaggaattgagcaggacacagatggcccactgaaattagaataatttgaggaaggtttaataaagggactatttataaaactttgggtagtatgtaggaaaaccataagggacattcaacactctggaactgttatcatcacacgacataaagggagaaggggaaggagcactgaccagaacttggaaagagaaagtctggtggagaggtcaacctcgagaagagctatctgctttgatagaggaacatagccagctcaaagggaccccacagggagtgatccaaggcaactaataccttgacctcactctccttccattttccagtctcctgcttgggtccccccattggccagaaggcaaaaaaacccactgatgaagcatacaggtcagcaggtggaaaaggatagcatccctgattcctggtattaagaaaatcaatcagccgccaaccgcagagaactgctgtgaaaattaaatgatgtaaagcacattatgcactcaaacatacctcaaacatagtaagtaaatgagaaatgtaagttgttaaatatataatatgggatatttttcattatacaattcaatatagcaattatctatgcctcccaccattttctccccacatgagaggtacagcagagagggagaagaaccaatgtttcctgggtggctagtatgattgcagcagagtgctaagcatttgctatatatcccatcttatttcattctccctagaaagaatgtgataggaattattaagctcttaggaaaggtgagtaaatgaagctcagatatgttgcctataattattgcttataattaggatctcagatctgtcaaattcctaagctaatgacttctccattattttatgtagatgggctacctgtccatattagataattttatttttatcacgttgaggggaattagagaaaaacttgctaaaagctaagcatctaacttagggcttgccacagaagagatagtcagtaactgctatatatgatgatgaggaggagcaggatgataatgattgtgatggtgatggtgatggtactggtgatggtgatggtgatggtgacaatgataattatggcagcggtgacaaatgatggtggtaatagtgatgataagaaccaccctactttaacctaggagcaaagaacttctgcaacagacacgaagaattccttaaataaggtttcagtatatagttgaagtagtggaactgataaatatttgttaatcctggtccctcaatccaagaagaagctttttcagagcaggctgtgtggtgcatggctgggccactatgaatttcggtttccctgtgtgtgaaacgcaataattatatatgtggtgcctagagctgatgtgaagaatgaaaggaatgcatttagaacacttggaacagcctggagcacagcgaacactaggtcaagatagccacttactgtcggggaggttagttccaacatggctgggctctcagcaagtcttcttttgaggaaaggacccagaagtggaaatggcccctctccttactagctgtgtcctcacccactccactcatctacacagtttagaatctgagggtgaaagaaggaagagcaggcaagggaaggcagcagtggaaaacagctcttgggtggtaagtagggagcaggaagagcagttaccaccatgcttaaaacaaggtttttaaaaaaaaaaaattgcctgaagtcacatttgaaaataaagagcttggtaaacatgctgatggcaaagagaacttgtaaaacagtttcacttgaaaaaggccaaggttaatggtataatttcaattttgaaccttcttttaatatggattagtgctctcaaatatgggatttgacattaagatgccaaaagaagactcagaaggtaacctcaagcagtattttttaaggaaatttcttccttttatcatttgaacgcagctgaacaaaaacgttattaaaaattattctgtcataaaaacagcaacatcaatgaccataacaaatgctaaaaagcaaaattatccatgaaattaaaaatatttcacgaatccaaggtgagaaatattttagggatgacacttggcacttgagatttatgtaatgagacattaccaacttttatgtataaaatttcctttctgaaaaaaaagtatgaaaaatcaaaagaaggcaccaaaaaagtcccccactgatttggaaaacatattcttttttttttttttttacaattaactgcatttggagaactgcatcacacttttaaataaaatatacataacacattttctctttatagaaaaacctttacaaacccttaagtttgctgaattactgctgaaaaagtatttttgaaataaaatatacagaatgaataaagcatctttactccattcttcggaaattatctagatacaaatatatacatggctaagttcaaaaacttacatagtagaaagtttaataatttgatctataatattaagctgttgatactttcgattggaaagaaggaggggaaatagtgaaagaaaaattaaccacagaatatattctttgcagtttgagatataaaatgttttatcatttacattaatgtgcataacattttaatattaattgttgcctctttcatcttgctgtcttattttttaaaagcttatcatagaaaagtctctatatgaaattgttcatccaaacagataaaaagttggaattataactgggccaatgaaatgttgttgttttgtattttattgctttgcttcttctttagtaatcatctttgcagtctgtctaaacaattctctgtgcactgacatttgcaataatgtgtttacatcacaaagttagaccctgtcattcgatggaacaagaggctgtattttgtagcccccagacactctgcataacttactccctctttggcctgagagtgtaatcgttttttcatctgccatgtttaattacctttacaggcattaacaacagtttactagaaatcgatggaggagcaataaattcattaggttcagtggaggtaagaagtttcatattctttttctcaggtgaatacctatttgagaactactaacttcatcttccataaacctaaaaaatataatatatgattttcatctgtctaccagttcttaatctcctaccaaagatggagtcacaacacaaaatcaggagtcaatagttacaatgctttctcactctgacacaaaattgtgtaacttgaaggaaacgtgggttcccttatgcatgcaaatgccctatgcgactacagaatgtgttccctacacttcagaagctgttgatgttccactcagatctctgtaggatcccttttaccagtttggtgtcccattcctccctacaggtgttgctgcccatcttctccaaagaattgcccttgagtgaccagagcaacacccagaggttctggggagatatatcactaaattcggcccccacccagggtccatagctaaagactgaatggtgggaagggaaggtacaaaagtctacactcctgtctcaaggcagaactgaccctgtagtatgtttcatgctcccaagactccccatgtgatcaggttaatttcacctgaaaccacaaccttggtagcttcttccacttccttatactaattccctcactcccttcctggtttctcccaagagccctctcttactaatcacctgcacacccatctccagttctagggaattcaaccaaagaccctgtagaagcaaacattacagaacagacaggcatacaaatggttttccagtttttgcaggtaatcaatatctcagccattttaaaaggtactgtccacagtgttttataagcacaagttggggatggaggggaatcacatgcctgttatgtaattgtgtgaaaagaagttcctaagatctacaaagtcacatcatttgcagaagtcactaactgattcctgctccagggaaggctgcagttggcaagggctgcccttcttggcaggtgtcaggcagggctctgcactacaattctccctgcattgggagaacaaaaggagtctggggctaggaagaaaaaaaaaaatgacaagcgaagcattaaactacaaacagctctttgaagcctccctgatagaggtggttgtgtttgtgcaacagttattgggttgagtctaataatgaaaggacagatcaccacttactctgtgatgtcagtaatgaaagctatcaaaactaagcctgagtgggcctgactgtcaccctgtaaatctaacgtggacagcttaatgagggagggacattatcttttctcacactccaattttactcacataagaaatgtggcccacattggcaattaacttgagagattaattaaatccaataacaagttcagttccctccatagtgcattctgatatcatgtgaaggcaccaacatgctatgggcacttagcacatgttaaaaaataatggaactaatttgggctttttgtgtgtgtgtgtgtgcggaaaactggcagctaaccgcctcagtaaattaattccacaaactgatacagctactcgatagttcacacagtcttatttccaaactctgctttattatcctgaaactcccaagaaacattgcccaataattgtgtttcttccctcagcaattttactcaccagtagtatttaacatattttattgggccctctgaagaataaggaggcagccattcagacaaaacataaactctgccccagcttaagaagcaatagactgggtcccattgtgtctctttcaaaacaacggctgacactgacaaggaacaggaagagcagcaggggtgcaggcatgagcttcacttagcgtcagaaggccacgtgatatatgttctggttctctttcttttgggttccctaattcgtccttagttcctgtttttgtgttttcttctctgaaacggtaaagtgctttcctccactaccatatatgaaatttgatcttaagaaataggagtcttcaaatttgaccaattggccaaatggttattaaactgatgccttagtgaaagtcaatgaaattgttttttaactggttgctgtaaaatcatattcctataatacagatcaaattcatatactagagttattatatagatactacataataataatgcctactcctgccccactgctcccaaatcaacctactcaaagaagtgcttcctaacaatctcactaccaaggactccttttattatgatttgagaatggagtacatgtttgaaaatatttcatctatccaagattaacgattaattcatttcctttttggtattattaagaaaaatacatatcctgtctgatggaacttctaataaataaataatgaaattacaacatgaaggtaacctaatctttgacaaaaatgggaaatataatatttgggtagcctttcatagttactgtggttacaaataccctttaggaaataacgaaaagagcttgaaggtttcttttctattttggagagaattctatgacaaggtgatattttagacctaccctaatagtcactagtgcagaagatttacattaacaatctttcatacagccagaagtttcatctacctaagtggcaccttgaaactagaaagagatggtaaataacaacaagcctcaatgttctaagaataatcacatcacctgaagcatggtatctctgcgcatatcttcaattattaccaaaaatgtctatgctataaatatacttgatgacaaagcattcctacacttgattaccaaaaaaaaaaaaagtaaatggtaaacaactgattgaatttattggatctggggtgatcttatatttgtatcaaactgtaaatacatttaactcaactgatccaatattagcccattagtccatattttccacttagggtattattgcagacctactgataatcataatggctaacaatattaagctcttacaaaatgctttacatgcattcattcatttatgtgactcaacaatcccatgtaataagtactattaccattgtcattttacagatgacaaaactaatgtttagaaaggttaagtaacatgcacagccacacagcatctgggtttatctgctgcttggtaaatctggactaaacaaccaacagggatcaggcttgatattctgttccacctgatggccaaggaagatactgtgcaaatgcctgcacatttgtccttagactacaagctttctttcagtcctgtcagcattgacactgccaatattttaagaaatgtatttaaagtcccttctgatatttcttatatcaccagctaaactgcacacaaaataagttaattggttctaaggtttacctaaatatttctcattgtagcagaattgtggaaggagaagtagataatatcaagagttgactgttccatgttttatagaaagtaagagtcagaaaaaatataacctaaataattccattgaactctcagtatatgtaggagtaatggcataatgatatattgttgttataattataggtaaaagataaattcttggaaaataattttaattcacattctctaacatgagaaatttctcttcacttaaggtaaacttcgaatgtttcctttctttccacaaggtggaaatcttgaagtaatgggctactgaaaaaccagagaaattatatgcactgacttacttattcattcttaattttagattataaaagttttcttgtgtagcttagagaattttccaaatcctttataactgtggttgtggaattccacaatgttgaacctgaatagattcctatttatgacaagttacaaatttcattgtagaaacgtaggtgcaaaagacatagattccaaagatttaccactttcagtatcaaataatttacctttcatttttagcttgctctcacataaaaattgatccaaaatgctgttttaggaagaaaccagccctcataaattcttgatgaatccagatcaccaatatgaatatcagttattgaaatcctcagaacatatatgaaggggattaacactaatcatcaacacactaaatggccctaacttaggctgttacgtaccttcattcttctgctttatacagtctataactgtataaagtcttccaactggagttcatggaatcagatattcttaaaagaatacatttcaagatcctcaacttttttcctaaaattgatatgtctgaaaatgtatctgcagtaagggtatcatggggatgacaatttctgtttaaagatctcgccttttcatctgcaaacaattgtcaaagaatacattgctcctgagaaaaaagtcccatgagagcaaagcaaaatgggaatctgtaaaaaatacaatggcgatggtgtcttatttctctcaggagcagactcactgcaaacctcctcaccatatcagccaatctatttcagactgagaactcagaagtgaaatgacaggcatgggaaggaccacaaggaagtttaattgaatgtgaaaacccaagttgaaagaaagtaggcctgacctagctgattgattcagcaaataagtttttcaaaataaactataaagtggacatttttcataaagctaatgagttaaatctgcagttccaaggcttggaggaaatacactactcaaagaatgtactaagcaagagaatcttgtccaaaaattaaaaatcatatttgcagaggtatactgaaatttggaatatttcagttttcccacctctgagtctatcagattcaatatggcacctctaagagaaagaggaataggtataattaatgggcatttgagaagctttggtaagcctttggtgtacttcccaggaaaaagagaaattgaatatcttgagtgactgagcaacaaattctttttcaagacagtttttctctcaataaaattgaagtagaactaattgagttgtcagaggatgaatcataaaaaaaaatttgatgagaaattactatatgatttttggcataaaactggcaagaagttttaaaaaattcaatgacataaaaatacctccaatctcatctgcttatgtatgtgagaaagatttctcaatgcttatatctagaaaactgaaaaattgggattgtgctaaatcctgttttgttttgaaacaaataatatttgacttgatataggaatgaattaaaaaatcaaaaaaagccctgacaatctcattattaggtgaggtttcaataattttaacttttatatttaataattgttaatatataaaaaatataagaaatacatattttttgttttgatcaatcttgtgctaataatagtgataaaagctcaatccagatgtaatttttgaaatgtagaggattataaattcaaaatttttttaaaaaatttaatgttctgagactatatgatgatgcataaaatatttcaagcatattacattgataaaattctgtgagacaaatgaatgaaatatgacttatagagaaaggaatggtgcacaattttcaatgaataaagaatttgtttttatattgttaaattgacaatagtgagactcaactcattatagtatttagattccaaacggatatacttaaaaaatatttaacaatttttaaatgtcaataataagccagaaattatattctttgcaactctttaaacttataacaaattggaagcctatagtttttccagaagtctttcaaggttcagggagcaaaaaaagaaagaagaaaaaaaggagctttctgctttgtttctcctgccttgttattatttctggaattagaagatatgctttcctggccccactttcagatttgctctttgatccactctccccttagaaattggatttctgaatagctaaggtctccagatcactgaattgtggatatgataaactttccaaacaaatatgattctaattatttgctttaccctaagactcattacagcgttctttcaaataacaatcttctccagtgcttttgaaatatggttctataattataaaaattcaccttgcattctatttacaggcttttcattttatttaggtccaaaatacaaatgcattgctttgattctgtagcagatttttgagagtaatccctttttaagtgtctttacaaatatgttatctagtccaacaaggcaaaaaaggaaaatagaaaagaagggagagagaaaaaagaggaggtgatgaaatgccatcatgatatcagagaaggaggtggataatttaaagcagcaaggccctttcaaatagaagatggctaaattttatcactaattcacaataggattagaacatgaattaaatttcatttgaaaacaaagatacctattgctttatatagtccctgcctcaacagcaataccagcctgatttctttcacagttttctttctgagacaagaaataccctaataaaacaaagggaaaaatatatttcccagtgtctaatgatctttataagtcctttgacctttccatggacctcagttttcttatctgtaaaataagaaagttgatttaaaccagttatttgaggaggggcaagagacggggcaaggagggcagatgagaagaatcacaggaagggatgaatttttcgacagaatacccacactctgcatgactttccagattcctactcaagctgcaccactatccctatggatgctgagaactccagctgtgggaatttgtgttctctccttggaagaggacaaatggccggaaacaccatgcataactttaaagatcccttccagcaatgagataccatgattcttcggctatgactagaaaacatattgttactcatgtatttcttctctcctttcctttgtctctggcaagcatcactatttgctccttgctgcctagaacagtatgaggtatatatgcctggggtgtgaaaggagagatggagggagggacatatttacagcagctatgatgctcaagagctatattaatctgtagctctgtattttcatgacttcacaactccctaagcttaaaaatatatatacgtacatccggctgggcgcagtggctcatgcctgcaatcccagcactttgggaggccgagacgggcagatcatgaggtcaggagattgagaccatcctggctaacatggagaaaccccgtctctactaaaaatacaaaaaaattagccaggcgtggtggtgggcacctgtagtcccagctacttgggaggctgaggcatgagaatggcgtgaacccaggaggcggagcttgcagtgagccaagatcgcaccactgcactccagcctgggtgacagagcgagactctgcctcaaaaaaaaaaaaaaaaaaaaaaaaaaaaatatatatatatatatatgtatacacatccttatatatgtatatatatgtatatatatgcatgtatatatgtgtatatctatacatacatccatatacatatatatatgtgtacacacacatccatatatatgacattttaaaagatcctcttttctctcatcttgaagtgtgttaaaaggtatgcgtaaaaaggagctacaaaacaatgaggttactagataaggtacttttcctgaatcaaagaagctcctagacaaaatggggcctgacttggtggtcagctgtcagagtgaaacttaatttaacagtaacaatagacaaagtatgtcagactaagtgcttcatcgacaatctgaacaattttcaataaaatggccttgatgtcagttagggcagacaaccccaggtagagaaagactactcgggaaaaaaaattaagaaaaccttctgcagattcgaagggggatttttttttatccctctgaccagcctctctgtatgtaactttcagtggttcttgccttcaagaggttttcccaccacagtgaggggctgagggagatgtttgtgtccctggatctagtgacttgttttcatggctctgaagcccacagtcactcccatttagaaaatattctatatccttttggattacgcttgatctctttttatctaattaattacatctcaggaaccaagaagtaattacattaagaacttggaggcatgccttcaggaatgtcactatggctttctgtttgtttgttttaaagcaaatcagcactctggaacttggttcagattagcaattttatgcattcagctggatacaatgcaactcctggttattagaataagaaataaggtgaagaacatgaaggaatgtggttcaatctctctctctctttcccttcctttctattccactttagtatagcaattacaggcctctgagtttgggtttagcatcgtgatggtaggcaggtatttacttttttacttgagggtcaagtgggatgaaaagcaaggaaaaaaagccaggacagtccaaggactggcacatgtcaaagcacagaggaacaatacagatcttcagaggaactttttttcttttacttcctttttaaaaaactttgtcagtgtagtaagtggtgaagactatttgctaaagtgttcaacaacataactgctctgagatttctccttcactaggctactctcttaggcctctgtgaacatctgtgccatgtgtacaggccacttcctaacaggcccaaagaggatgtgttttcataaaagttgtaaacacatttaagaaattatctgaagctcataagccacctgatttcctaggcaaggcctctcatcacattaaccatattttacgtaatgagcagatgggcagaataaaaccagagggaggagaagtggaggaaaaggacagtaatgagtgatgaaatggaaatcacgtgattaatggaacatagattttaaaaagtaatgaagagtttatccctagggtagaaaacagggaacaacaaaaataagtaccacgttgtcaaaacagtaaaataagagagtagaacaaagaaacagagcaagacaaagaaatgctggttttaggataggccttattttaaagacacaggggattttggaacttaccattttgcagctatttgtttaaacaaaaataaatttatgttgcctggtgtcctaaaagttacttatgacaacggtcattaatagataagagcctgcagctatccgggtacaccaacaccagcctttgtgtttgttcaacatttctttctgtgggaaatgtaatttgtagcataagagttcacaagaaccctcagctccatggctccatcactaatgaaacaagtcctggattttcatagcaaccatcaagcataaatttggctccccagagcatgtgaactttatgtgtgaattacttatgtgtgtgcacaaactaaaggcaaattcatgtgaagcatacaggcaatttacaaactctatctgttctgaaagtctgcacagtaacaggaacacagacagaaataacaaaatgggtgtatatgtccaggtttctccacaaaagatgacctgtatacttgcaagggcaaaatatcacaaaaacaaccctaatgcaagagtagtaatgagagcaactaaaaataaaatacagaggctgggcctggtggctcacacctgtaatcccagcactttgggaggccgaggtgagcagatcgcctgaggtcaggagttcaagaccagcctggccaaaatggtgaaacaccgtctctaacaaaaacacacaaaaaattagcaaggtatgctggcaggtgcctgtaatcccagctacttgggaagctaaagcaggagaatcacttgaacctaagaagtggaggtgcagcaagctgagattgcgccactgcactccagcctgggcgacaagagtggaacttcgtctcaaaataaacaaataatagaaataaaatagaagataatgactgtgtgtgtgcactttcattattttgaatgttagtgctcaaaggaaagcaaatttagttagaaaacaagctgatagaaaaacagtttcagagattcttaagagaacttcaggacacatttaagaaccatgaaggctggtaacacaagttttgaaaaaattaggccttgtttcaggacaattttgtttttcccatttctaggaatccgatgtatcattcacacaatttgtattcccattagccttgattagggacatatctgtgctcacattagactccctgaatacagggaccaaaattcattcaatgttgccacttgggtgtctaatatgctgcaaaaatctctaggaaagatataaatgaacaaataaatgatatgctgagataacattgtgaagaatttggcaatgaggaggggcattatcttcttccataaagacattgatttattctttaatatcactcagaatcacaagaaataatcagctgatacagaaatggaacagctgtctcacacagaagtggctaaagagaaaaaatttccacaaaatactggaaaagatggtaacaaatcaaatttcaaagttgggcagccctaccaaaaagagaaaaagaagatacgagaggagtcaatagtgacagcactactgaaattcaaaaataggacttgaggtctaagacaaactgataaaaattaaaataatggcaattactcattgaacatttactatgtgccaggtactatatatgcatgatctaatttaatctttataataatccatttaggtaagtacttctatcatccttattatacagatagtcaaacacgatgataaaaagtaagtaactttctcaaagtcacccacctagtaagtgatggaaccagtactttaaaacatgtctgtctgactccttaatcaatgcaacactaagatacatgtgactaatcaaggaaaaagaaagagttttgatttttgtttctttttccaatttagaaaagatgaaggagaattctagaaccttcacttctgagcaaatagcaaaccaacttgctgttgggaatttaagtgtcatgcacattaccatttacattagtttgaaaaagaagtaaatgtccaacttttagtttctctaaacagttattctagttttcctaagtttgaccccaaaagggatttgactgtgaaacaaaactctctgtagttctcagatatggttagacagtcagatgcccacaagtaacagcctgtgcagaacatcaacacagtatatcaccccagcaaggaaagttcaaaggaaagatttctaaggctactgagataaaatggaatagaatctttccagtatatttctctttgctatcaaaccaaattagaaaagactaatttatactaaattataaatcacagcatttctaatttaatcactgtctgtttttttaatttttgttcttgttttagttttgcatttctttcacccatgggatagatacacattctcacttaagcccctgttgaaactatttccattgtcccctagatcctcattctactttaatgtgtctatcttcagtaaaacacaactgataaacctgaaagataataaactggacagactagcactgagattctaaatgagataaaccggcagtcatcctgacagtaatggaataaataaagcatgaataattacattaaaagacaatttctgatttaaactttgcttttcctgtttttacacagtagaaaaaattaggctgtctggccttccttaggagaaatctttcttagaaggaatgtgtgcttatttttaaatctatcataacaactgatatatcagcaacaatgtacccatatttacctcatatttatatgtatgtcttctctattataagcaatatgttatgaaatatattagagattagttcaaagagttgagattggttataaagaattatattagtcgggtttaaaacgtatttggaaagttcccagtataaaatagtttagttgtgttattttcctcttgatgtcttgaatgttgcaaggtactattctatggctggtaggggcatgcaacaggtgggagtaaggaaggaaacagcaagccaataataagttttgaaaataagcccaatcattaagtatatgttgagtctcttcattaccgtgaataggaagtctaatagattgccatatgcagaaacagagaaaatgctgttttagtggcacctaatgaggttccaaaaatgcagtaacttgtagattctttcacattcatactctgtgtaatataacgctatatagcacacttagctctctttataccttgatattttaatgcaaacacagattcttttctctatggctttaaacattacacaggaacaagctcccatgaacctctttcacattcctactcagagctctctgtgaaaagctgtcatttcttgttctattcaagtcagactacctagtctccaggcacaatggtaaaaggaatgtcaaggtaacatcttcatttattcatatgattttctctttttttttaattatactttaagttctgggatacatgtgtagaacgtgcgggtttgttacataggtatacacatgccatagtggtttgctgcacccaccaacctgtcatctacattaggtatttctcctaatgctatccctcccctagccccacaaaccctgacaggccctttgggtataacctagtaatgggacggctgggtcaagtggtatttcttgttctagatctttgaggaattgccacacagtcttccacaatggttgaactattttacactcccaccaacagtgtaagagctttcctacttctccacatcctctccagcacctgttgtttcatgactttttaatgatcgccattctaactggtgtgagatggtatctcattgtagttctgatttgcatttctctaatgaccagtgatgatgagtttttcttcatatttttgttggccacataaatgtcttcttttgagaagtgtttgttcatatccttcacccactttttatggggttgtttgtttttttcttgtaaatttttttaaggtctttgtagattctggatcttagcactttgtctgatggatagattgcaaagattttctcccattctgtaggttgcctgttcactttgatttcttttcaaggaagcactaaatatgaaaaggaaaaactggtataccatccactgcaaaaacataacaaattataaagaccatcaacactatgaaaaaactgcatcacctaatgggaaaaataagtagctagcatcataatgacaggatcaaattcacacataacaatattaaccttaaatgtaaacaggctaaatgccccaattgaaagatgcagactggcaaattggataaacagtcatgacccgtgggtgtgctgtatcggtgcgctatattcaggagacccatcttatgtgcaaagacacacaaaggctcaaaataaagggatggtagaatatttaccaagtaaatgtaaagcaaaaaaagcaggagttgcaatactagtctctgataaaacagacttttaaccaacaaagatcaaaaaagacaaagtagggcattacataatggtaaagggatcaatgcaacaagaagagctaactatcctaaatatatatgcacccaatacaggagaatccagattcatatagcaagttcttagagacctacaaagagacttagactaccacagaataatactgggagactttaacaccccactgtcaatattagatcaacgagagagaaaactaacaagaatattcaggacttgaactcagctctggaccaagcagacctaacagacatctacagaactctccaccccaaatcaacagaatatacattcttctcagcaccacatcgcacttattctaaaattgaccacataagtggaagtaaaacactcctcagcaaatgaaaaagaacagaaatcaggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagcggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaacagaaatcataacaaactgtctctcagaccaaagtgcaatcaaattagaactcaggattaagaaactccctaaaaaccgcacaactacatggaaactgaacaatgggctcctgaatgactgctggttaaataatgaaattaaggcagaaataagtaagttttttgaaaccaataagaacaaagacacaatgtaccagaatctctgggacacagctaaagcagtatttagagggaaatgtatagcactaaatgctcacaagagaaagcaggaaagatctaaaatcgacaccctaacctcacaattaagagaactagaaaagcaagagcaaacaaattcaaaagctagcagaagacaagaaataactaagatcagggcaaatttgaaggagatagagacacgaaaaacccttaaaaaaatcaacgaatccagtagctgggtttttgaaaagattaacaaaatagatagactgctagccagactaataaagaagaaaagagagaagaatcaaatagacacaacaaaaaatgataaaggggatatcacaactgatcccacagaaataaaagcaccatcagagaatacataaacacctctacacaaataaactagaaaatatagaagaaatggataaattcctggacacatacaccctcccaagactaaaccaggaagaagtcgaatccctgaagagaccaataacaagttctgtaattgaggcagtaattaatagcctaccaaccaaacaaagcccaggaccagatggatccacagctgaattctaccagaggtaaaagaggagctggtaccattccttctgaaactattccaaacaataaatagaaaaagagggactcctccctgactcattttatgaggccagcatcatcctgataccaaaacctgacagagaaacaaaaaaagaaaatttcaggccaatatccctgatgaacatcaatgagaaaatcttcaataaaatactggcaaactgaatacagcagcacatcaaaaagcttatccaccacgatcaagttggcttaatccctgggatgcaaggatggttcaatatacacaaatcaataaacataatccctcacataaacagaaccaatgacaaaaaccacatgattaactcaatagatgcagaaaaggccttcaataaaattcaacactccttcatgctaaaaacgctcaataaactaggtattgatggaacagatctcaaaataataagagctatttatgacaaacctacagccaatatcccaccaaatgagcaaaagctggaagcattccctttgaaaaccagcacaagacaaggatgccctctcaccactgctattcaacatagtgttggaagttctggccagggcgatcaggcaagagaaagaaataaagcatattcaaataggaagagaggaagtcaaattgtctctgtttgcagatgaaatgagtgcatatctagaaaaccccatcgtctcagcccaaaatctccttaagctgataagcaacttcagcaaagtctcaggatacaaaatcaatgtgcaaaaatcacaagcattcctacacaccaataatagacaaacagagagccaaattatgagtgaactcccattcacaattgctacaaacagaataaaatacccaggaatacaacttacaagggatgtgaaggacctcttcaaggagaactacaaaccactgctcaaggaaataagagaggacacaaaaaaatggaaaagcattccatgctcatggataggaaaaatcaatattgtgaaaatggccatactgcccaaagtaatttatagattcaatgccatccccatcaagctaccattgactttattcagaattagaaaaaactacttcaaacttcaaatgaaaccaaaaaagagctcatatagtcaagataatcctaagcaaaaagaaggcatcacactacctgaggcatcccgctacctgatctcaaacgatactacaagattacagtaaccaaaacagcatgatactggtaccaaaacagatatatagaccaatgaaacagaacagaggcctgagaaataacaccagacatctacaaccatctgatctttgacaaacctgacaaaagcaagcaatggggaaaggagtccctatttaataaatggtgttgggaaaactggctagccaaatgcagaaaactgaaactggatcccttccttactccttatacaaaaattaactcaagatagattaaagacttaaacataagacctaaaaccataaaaaccctagaagaaaacctaggcaataccattcaggacataggcatgggcaaagacttcatgactaaaacaccaaaagcaatggcaacaaaagccaaaattgacaaatgggatctaattaaattattcatactattttcatgttggacagtattataaaagccaatcaaattggagaaataacatagtatattttacaaaatgtaaatttgtgatgcaagcagaagagcttctgctactcatgagagttatattcttgttacccaagaatataacttcgcatcttttcaaaacaacctacacagagtaactcttaaaaatctgctagtgagggggaaaaggagggagaaagcaaagcttcaaaggactttctaaagaaattataatactaagacttttatatgacattcaaccctgttttccccccttctcccccaacaaaataacctagccaaacaatagagaggcaacgtttaaatacaaactttcttccactcaacactagaaaactggtaagattaggtcttcaaagaggctgagctaagaattctcctaagctttaaatttcctgcaaaggctgagttttatttcttaagggaagagcttctgtttggcttttctttttctttttaagaaaaaaattctatataattataggtttattgttacatttgtatgtatgagcaaagtacaggcaaagaaagaaaaacattgtcaagaagctggttatgactaaatatataaagatggaatagtctaacaatgccagttgaataaatactgtaacaaaactgtaatttaaatgaagctaccaaaatatttcaaaagacaacgcattttatgattttaaagtttatcttcaaaatgaaatatgatcatagctattaacaatatgctgtaaaataaaatatgctaaacattgcttctgttagtaaccactagtttctcaggaaacattctttatagagcaactctgattaatgtacaagtgacagcttttttttttctgagcactaaccttacagtataccattgttttcaagacagtgtttataaaagctgtaaagatacgttttagacattaccttgtctatatctatgaactgtcagcaaaaaatatccctttttcaccttctctccactctccatttccagttagacattgtgttttcatccctatatagcttgcctaccttaaacagaaaaatgaccaacatattcttatgtgcaaaatctgaaaacatttctttcagaataatatgacctgttagacatccgaagatcaagacagggataaagatttattaggccaaaccacacaggacttatatgttatgggctgtaggacagagcgtattaaattatttccctgatcacacaactgaatgtaaaaggctaaacgtttcactgattgtggtcaaatatgattgttgctgcagtagagtaaaggccccaaaagtacccttagttaggtcagtgaccaaatgtcactctatatgattttgttcttcacgggcaatgtctccaaagtgctaaatgtgtgaaactccagcttgaaccaaggaatgaattttagtttgctcttaccctttgaatggataagcacattgaacatgaaaatcttctctcttccttatcaacaaggcactaacagaattcagatttacagatcagacacagaaatatggaaaatattcttaatgttagatcaaatacggaattatccaataaataaatattgagtttacaaaccatctaaactttgactctcctacttcccatctaccaaggaagggagaaaagtaagaaatggaagttaagctcaaattactcaggtactgtttgttaatatatctggtgactatcttatgtgagggaaaaactggaataataggaaaaggtttggtgattctacgtagcttttgtgactgtagttctagctcctaagttttactttccaaatagctaagggctgctgttctcaaaagagctaccctttctaaattcaggaaataacaatggaaagaaataattgttaaataaaagtatatgttgatgtttaccctattatatattattttcattttatatgttatatgcacaaaaatttattggtacatatttctaaatgttaaaatcttggttctctgggtgataggatcatacatcatttttatctttacatctatacttttgtgcattttctgctgttctgcaacaagcatgaaatgattttatgctcagggagaagaaaaaagccatctcccaccactacgcccacttcaagaagaagaatgaagagtaaaagaggagaaatatggtaaaggagtcagctttgtactctctgtctgctgttttttgcttcctctcatttctgctttccttagcagaagccaagagtgtttggggggcctaggtctgaggccagctccacctctgaccagtgtacctccaattctctccgagccttggtttcctcttctatagaacgacaataataatggtactcacaagaagtcaagaagaaacaggataatgcatgtaaagctgttaccatggcgcctggctcaaagagaatacccaccaacattgctgcactttttttcgccagccttacctgatcatagaaatcttaagatttataaaatactttaaagcaaacttgtccaacctgcagcccacaggctgcacacagctcaggacagcttagaatgcagcccaacacaaaatcctaaactctcttaaaacattatgagaccttttttttgcaatttttttttaagctcatcagttgccgttagtgtattttatgtgtggcccaagacaattcttccaatgtggcccagggaagccaaaagattggacgccgctgctaaagcttacaatgagctttaacaaacagtaatttaatttttaaactgatagtaaaaagcagagctagaattcaaacctcaccttcccacatcctagctctgataaccaaacaccacttttgagttggattgaaacagttgcctactggagctgcctccctgaggcttacctgcaattggtaaatttcagtaactttgcataccagctgttaaacacagacattattttaaattattatagaattatacaaattaaaatataaaagttacaattaaataaaaatattttaaataaataaatatatgaagctcgtcatgtccttatacttttttcttttttttgagatggagtctggctctgttgcccaggctacagtgcagtggcgcaatcttggctcacggcaacctctgcctcctgtgttcaagtgattctcctacctcagccttccaagtagctgggattacaggcgcctgccaccatacctggcaaatttttgtagttttagtagagacagggttttgccatgttggccaggctggtctcgaactcctgacctcaggtgatccacccacctcagcctcccaaagtgctgggattacaggcttgtgccagcgcacccggcccttatacttttattatctatactctttaagcttatttgcacctattgtatttgtagagtggaaacactacataatagagtgctacatgtatctcttcctaattcacttgcagtaaattcacattggtagcttgaaatcagccaaactggcaaatgccacaaatcaagactcaatatcatttcgttgacttgagagtgatggagaatatgcagattaacttaaagtgtgccatatctgtggctgttatattctgaataacacacacacacaaatggagaacccattcttccagtattataaactatcatacaatatgtatgacagaaagatgattattcatcagttgcaaacatagactggctatggatataagaatttggcaaaaatcaaccaaagcagtgtgtgagaatctactggctatccaggatttacaatcaagagtagtgattattttattcatatttataaattacatgttacatgtcctttatatcagtaaaattaataataaacacacatgcaagcatgcacattagggcatgcatgcacacacatacacatatttttccttgagagccagctgttaaacatttaccagcataccactaaattgaccattattttaaactaagaggaacctagaagctcttaagcagagccctaggctcatcttcaaatcactaaggttgggttataaatggttttagcttcaggtaaggctaccaaattagatcattgtatttaaatatactatgttggcaattcctatcctgcacaatgatgaagtaggctcatagcttcaagttccaccattattacagaaaaatttattctatggaaacgcaacttagggaaagtcaagatagctttctacaattcacaaaaactatggagacatacaaagaagtaagatatggctccttcctgcctccaagacagttgagcagggaggacaaacacataaacctataatataaaaggcacagcactgatagatacaacgtgctatgggatgacaagggagagatcccatgagtttacacttcaggtcctggttaatggcaccagtctcacctgcctcaaaagaagcaagggcaaggaggcaggttccagggagaaggagaaacctataaagtatggcataataggaagaaggattctagaatcaggcagcctgtgctcaaacccagactctttcactaactgtgtgaacacgtccaagttacttggcctctctaagcctctgcttcttaatctaaaaaaggagaatagtaactcctgacccagagcactgtagtgaggatcaaataagacaacatctgtgaaacacttaccccagtgccccataattcaaaagtgctcactcaatgaacattacctactactgtgatggttgttgatagccttgagagttgaaatggctgactttggggactaggagggtgcaggaactagacagagggattccaggcagaaggaagaaaataagcaccccccaccaacaaaaaaaaaaagaaaaaaaaaaacagagattacatacaggggcccacttagtagtcctgaggtagtagaatattcctggaggtctaggtcaggcacagctacagcaaataaagactgaggctagaccaaggctcttccagaatggttcaaatatacactcattcctcatgctcttctgagaaaaacgaaacaaaatcaggcttttaagatgataccctttttcttctgacaggtactgtaaattgtgtctctgatatattttgaagagcctataagggaatgataaatcaggcaatattacatatattcatcagtaccttaattgttgttaaatactaacaacacctaaaattgatctgtaccaagatttactgctctgacaaaaaaccacctggaaaagagcacatgataattaagaacgaccaagggtttgaagcaatctaacgcgtatgaacaagatttaaactcctccccgagggaataactaggtgatgtttattctgtagatgaacaatgtgattataacaatggaagattgatgagatttttttactgtgggaatctgatttagccggctagctcagataataggaggatgcaaaactaagccatccagtaccacttaaaaattctttgtgagggacacatcttcagtgacctgaaaaaaatggactgcaagtcaggcaggcatattaggcagctacaaactgtcatacaaaaaaacagcatttaccaaaaagtttctaaatgcaccacaactgagttcaaccaaattagagagaaaaggtaggaagagaattacattcttatcagaagcaaaggaatttttttttcttttggtggtcttttgggcctaccaactgttatttgagtctaacaggttattcttagtaatccctcttgtccaggaaaagaggaactgcttggtctattttaataaacacacaaactaaaagcaaggcaatattagtcttccagagccttgctatgaaaagtgtaaagagctatcacctaggagcttgttagaacctcaggctcttgggctccaccctagacctgaatcaaaatctacatttttgtttgtttgtttgtttgtttgagacagggactcactctgtggcccaggctggggtgcagtggtactatctcagctaactgcaacctttgcgtcccagactcaggtgatcctcctacctcagcctcccgattagctgggactacaggcatgtaccaccacgcctggctaatttttctatttttagtagagacagggtttcttcatgttgcctaggctggtcttgaactcctggcctcaagccatccacccacctcagcctcccaaattgctgggattacaggcgtgagccaccatgcctggccagaatctgcatttttaacaagaaccccaggtaattcctttaaagtattagaagcaatgctctaaagagacattcattcgttcattcaatacgtttgcgagatctgcagtgtcatttatggtatgtagccactagccaaatgtgactattaacatttcagttagttaaaattaaataaaattaaaattcaaggatttatttgcactaaccacatttaagttctcaattagcacatgtggctaatgtctgccatatacattttaatcatcacagaaacttctattggacacatcactgaacaaagaagacaaagatctttgtactcacaaagtttagattctagtggtgggaaagcagatacaataaacataagtgactcagttaaatggtatgttggacggacagttcaaggctaaggacaaaaattaaaaaacaaagcagccttagagggatcaggaggatggaaagacaggaattttaaatatggcaggtctggtagtttcaatgaaaaagttacattaaaggagaggcaggccgtgagctgcccgggatgggggcaggggggtagtttcaaagggtaaagcctgtgcaaaagccctagggcaggtctgtttccataacagcaagggtcccatgtggctgcaggagagtaaggggagaaggcaagtaaaatggtaggagaacagaggagtatggatcctgggtatggaaagggcttccttatccattgtcaaagatttgagcacttacatgaaacgaaataaggggtccttgcagtgttttgagcagacaggtaacatgcttcaacccgatctcaaaagttattctcgttcagcaaaaaatgactataagtaaaagttattattattttttaattcaaggtcatgttcagatgtagaaagatactatctgcagtggcaaaatgactttgtttacaagttttggtaaccatgagaagcttgttaatgatacacaaacaagttattaaaatttatcactgtaaaattcagatactttttcaaaatcctctatgaatatgcagagtcacaaggtcttacaggttaccacccagaaccagtagccatctttgctataaaacttttcagcaaatcctgaggaatgcaaaatcagagttgcccaattgcccaaaaggtggaactctgcttgagtgtctcaacctgaaaatttgttgattactttatagagagaaagagatgaaaatctgttaaatagtttcaattttttcttttttaccccaactcatgtaaattgaattcatctactctaacatcccagttaaatgtcaaagctttgggaatcaaggtagggatttttatttatttttcaaagttcagttcccagaaacaatgacacattttacccacaagtgagaatgttgttatcttgtaggtaatccagctactgttctatgaactgtaggtcactgtagcctgtctacaaaatgccatcatcagcttcaaggcctgtgttcactaagacagccacatggaagttatactgaacaggcaaccctaaaatgactgagcgccatcgcctgagatttattccctgaggaccaccaccaactgtgatccagccagaattctggcaggaaaataaagtaagttcaccttctgtaagttaaatcaaatgaacaataaatcaaggcatgttgggtcattgggaactaactgctcagatgctcatggccggtgagtgaatcaactggcatcattttaaagcatctgggcatagcatttttgagctatagaacataagaggagattttagcaaccaaattattaccaacgtcagtgattggagtccagaactggagctgctttgatagttcattcgtgtattccttcattcattcaacaaatatgtgttgaggaactcctacaggtaaataatattctgtctgctaaaaatacagaactttacatacagtaaacttgtccacatgaaacttaaagtttcagttttaacctcctcatggctccctcttggagccaggaaccttccagagctaggagacctcaagaggtctttcatggatgggaaggattcagagactgttttagagtgataaggaacataaggtgtactaccagaaggtgaatcttcacagggtaagaggtgtatgtaagcagtaagttttatattctctatcctgaagccagagcacctaagagcttctttcatttccctcatccacccacagaagtcacccctaagaactgaagcattcttcatcccacctcatttctggcacagcaaaaccagaaggagcagggaaaacacattcccagaggccagacatattaagatactggaagtaagcaaaggggctaatagacctaaacaatcagctttggggaaaagaagatcctctctgttgcaaacagagctaaaaggaacagcctagaacagagcctacaagccaaagacagtatattagccaggcttctccagagaagcagaaccaatgggataaatgtagatatacagaaagagatttattgtgagggattggcccatgccattatggaggctgagaagacccactatctgccatctgcaagctggaggcccaggaaagcaggaggtatagttccagcccaagcccaggggcctgtgaaccaggagagtcaatagtgtaagtccctttggatcaaaggcccaagatacaggagctctgatatctgaggacagaagaagatggatatacctgctcaaacagagacagtgaatttgccatttctgcacgttttgttctattcacgtcctcaagagattgggtgatgctcagtcgccttgatgagggtgacttttacttagtctgctgattcacatgctaatctcttccagaaacaccctcgcagacacacccaggaataatgagcatatctcttagcccagtcaagttgacacaaaattaaccatcacttgtgtcctgccacgtatttttgttaacaaagctttactggaacacagccagttatttgtttacatattgtctatggctgcttttgatataaattctactgtccaatatagtagccactggccacataaaatgtgccttatccaaattcagacatggtgtaagggtaaaatacacaccagacctcaaagactgagtaggaaaaaaactgtaaaatacctcatcaataattttttatattgattacagggaaaaaactaatatttttaatatttttggctaagtgaaatatattattagaattaatctcatctgtttctttttactccttgtaatgtggctactacaaaatgtaaaattacatatggggcttacatctgtggttcacagtatatttctattggacagcctggcacagaaggaaagactccagtatgtatacagaccctggagacaagttgaatagaaaaactctgttcttactctaccttccactttatgtctgtttttaatactccaaccccaggtctttcttttaataattatcctaaattaacaaacacacaaatctgaaattcttgcaggtcactattgctgaaaattcaacagaagaaaatctgtgtatatcagaatttcacacaaagatgggtcagtggctgggctgcatagtggatatttgctgcctaccaacattctttctactatagcaagactctaagcaaactccacaaaggagacactctgaagtttcatgatctacatagatgctcaactaaggtaccaagtcatttaatgaagaaataataatctcttcagcaaattgtgctggaacaactgaataaccacacatgccaagaataaagctggaccccttcctcacaccatatataaaaattaacccaaaatggagcaatgatctaaatataagtgctaaactgtaaaactctttgaagaaagcataggggtaaaatcattaccctcacatttggcaatgaattcttatatatgacaccaaaagcacaagcaacaaaagaaaaaatagataagtggtacctcctcaaaattagaaaccttggtacatcaaagacattatcaaaaaaatgaaaagacaatctacagagtgagagaacatatttgtaaatcatatatttgacaagggtctagtatccagaatatacagtataagaaattcttacaactcaacaacaataaaaacaaacaaacaaaaacaacaaaaaaaccaggtaatgggtagaggactttaacagacatttctccagaaaaaacatgcaaatagccaacaagcacctgaaaagatgctcatcattagtcattagggaaatgcaaatgaaaaccacaatgacatgctacttcacacctaataggatggctattattttctttaatggaaaataacaaatgttggtaaagatatagagaaactggaactctccaacaatgctggtgggaatatacagtgacttagccactgtggaaaatagttttgtagtttctcaaaaatttagatatggaattaccatgtaccccagaaatctcactggtaggtatatatccaaaaggattgaaaacaggttctaaaacaggtacctgtgcatacatgttcatagcagcactatacacaatagccaaaaggtggaaacagcccacttgtccatcaacacccatcaatgaatcaaaggataagcaaattgtaatatatccatacaatgcaatattattcagccctaagaaaggaataaacttctgatacatcttataacctgggtgaaccttgaaaacatgccaagtgaaagaaacaagacacaaaagatcatatattgtatcattccatttacataaaatatccagaataggtaaatccacatagatagaatacagattggtggctgacaagggtttggggaaatgaggagaagctgcattgaaatgaggagttttattttagaaggatggaaatgttttggaactggatagagatgatgattgcacggcactgtcagtgagttaaacgccactggattgctcactttaaaatggattttttgttatatgactcttatcttaataaatttttaaatcatatattttttgcatttcacatgtcacaattctgatcttttaaatgtaaaatacattttacattacttaactatttctagtcctcacttctcctccaaaaaaattacattacagttgacactagattttgttaaactacccaaaatttactttgcatatatccctcttgtgcacaagttagtcagaattagtttctgttgtttgcaatcacataactttaattgatatggtaccttagtatgtcagtcagggagcctgaggtctaattctaggtctgcatctaattagctggtaatctcgggagaaattatttaaattagcttggctttagctttctcatatgtaaactgaaaggattagactaaattattcctgagggtttaaaattccataaatgacataacatctccttttaaaatattatccaagaagaagtaattgtcagatagtgatgatgtgacattttttccagtaaaaagtaaatttggaaggtaggccctgcttttactctagttagtccctccacctcactcttctggctcctcagtaatgtttagcatgcatattccaatagataaaatccctcaaaggtgttcagtttcatttctctgatgtgaaagggcaaatcaaatgaaatggttagagacaatgctcaaaatttaaagctgtatctaagtttcccaactcgattaggccattcttacattgctatgaagaactacctgagactgggtaatttataaagaggtttaattggctcacagttctggaggctgtacgagcatggcactggcatctgctcggcttctggggaggcctcagggagctttgactcatggcagaaggcgaaatagtagcaggcacttcacatggggaaagcaggggcagaacagagtgtggtaggttccacacacctttgaacagccagatctccaaaactcactcactattgtggggatagcaccaagggactgatgctaagctattcatgagggatcagccccccctgatctaatcaccccctaccaggccccacctccaacactggggattaccattcaacatgagatttgaggagacaaaacatccaaactatatcactaaccgagtgttcagattgtagtatagaaactatccaagggcacttcaaatgttcctcttatcattgaaggggctgaacaataatttgacccaaaagcttggcattctgcttttactagactaggctggtattataatgacctttccttttgaaaaacaatagtggtttctatctgttgtcttgtaaagatgagttttatattattaagaataataaaagattaaaaaatgttttaagcatttcatccagaagctacaaagcattatgttggggaagtttgaggagtttattaggtcaatctaggctctaatatactcagattattgatttaaaccggtgagcacaataaatcacactggtcatggaggtggcaccagctgaaagtgagaacacagatcaattacccgagagttctgggctttctcactgacttgccattaaaaaattaccttcgtggtttcacctcaaagatcagtctgctttgttttttttttttgtttgtttgtttttttgagatggagtctcgctctttcgcctaggccggagtgcagtggcactatctccgctcactgcaagctccgcctcccgagttcacgccactctactgcctcagcctctcgagtacttgggactacaggcacccgccactgcacccggctaattttttgtatttttagtagagacagggtttcaccgtgttagccaggatggtctcgatctcctgacctcgtgatccatccgtctcggtctcccaaagtgctcggattacaggcgtgagccaccgtgcccggcccagtctgctttttttatgcaaactttgaccgcttagaaaagcgctacaagactggagtggttatgcttggctctggtgtcagagtgcttggattctagctaaaatccacccagggagtgtcgcttaaccttattttctctccgtttcctcaactgtaaagcaagaaaaataatagtgtttcccaaagcctggcacatataccactgggagtataccagatgatattagatggtacatgagtggttttcttcttctgttaacaattatgtgtttaattcccagcatattaaaatatatataattagcacatcaaatgctatggtttgaatgtgtcacccaaagtccatgtgttggaaacttaattcccagtgcaacagaggtgggtccttcaaggggcaattaggtcacgagggctctggcctcatgaatgaattaattatgttatcagagaagtgggttagttatcaccagaatggattcctgataaaacgaatgagttaggcctttttccctcactcatgtgtgcatgtcttttatccttctgccattggatgactcatcaagtaggcctttgccaaatgcagacccttgatcttagatgtcccagcctctaggaccatgagacaaatacatttctattcattataagttacccagtctcacatattctattatagcagcacaaaagggactaaaacaccacactaaaattattgcgtaggacaaatctaagtcaaggaaaagaagtgcgctccaaacagtcctagtcagtcagggaaagttctttacagaaaaagtctagttgacaaatggaaaataattaacagaattagaaatcatgatttttgcaattacttaatgacataattgatttaagtaacaatcatcaattgaagaaacaatcacatgaaaaattaatatggaactttaaaatggaatagtcagtctgttacctgccaaaaccaatgatgaatctcagcttcaataaaacaggttctgaatagtggatgcttcctaataaacgtagtaaagacaccctctgcaaagcattcttgccaaaaacatttacgttaaatcaaatttagagacagcatcccttaagaaaaaataagagtggtgaaggaacacattaaagaagagcatatgaaaccagaatgtgtgacttcctacagaacaaaagatcctgcttctataacaagtctacagtgggaatggaggcaggatttctctaggttaagagacttaaggaacatatgtaatataatgtttgaatttgtttgaatatgaaaataaggaaaaacagtaaatgacattttcaagtcagttggggaagtttcaatgtggagctggattagacaataccaaataattactgtttatattgcttgatataataatggcattgtgcttaagtacaaaaatgcccatatttgttacagctgcattctgaaatacatcagagtaaagtgaagtgatgtctgcaatttgctttaaaatacttcagaagagaaaaagaaaggaggggagggaaaaagacaatatgaagaaaatgtagtaaaaatcttgatgattattgaatctaggtatacaacctgcttgataatttgcaggacccagagcaaaataaaaatgcagggtctcttataactgcttaagaatttcaaaacagtgacagaagaaccaaataaccacattaaaccaaatgtgggccttcataagccatgggctctgaacaactctcaggctgcatgcacatgaagcctgctctatgtgttagataatatggaaattaattgcactattcactctacttggtgcatatttggaaaacttccataataatttaaaggggatcacttaaaaatatatatatataaagtaaagattatatgaggaaatagcaaaaatcaggaaggctacaattggccgcaatttccaagatactgatgtaatcatgaaagacactcaatgtggtgcctgacacacagcaaatgctcaggttagctcctactactgttgctaccaccagcactaccattttgacaaagactacccttgtatctagtaagaaacatgaacgttttatagagattactacaacaacattttacagaaaggttactttagacatcgtgaaatccttactgggagatctacttatatacagaaagtcttacaattcttaccaatatttctgattgtattttgctcccttgtgccctatattctttaaaacttgcgagggatttccatcaatgacagactggataaagaaaatgtggcacatatacaccatagaatactacacagccataaaaaaggatgacttcatgtcctttgcagggacatggatgaagctggaaaccatcattctcagcaaactaacacaagaacagaaaaccaaacaccacatgttctctctcataagtgggagttgaacaatgagaacacatggacacagggaggggaacatcacataccggggcctatttgaggggtaggagtctgcgggggttagcattaggagaaatacctaatgcagatgacgggttgatgggtgtagcacccaccatggcacatgtatacctatgtaacaaacctgcacattctgcacacatatcctggaacttaaagtataaaaaaacaaacaaacaaaaaaacttgtaagggatatcaactgtgggccacaacagcacttagaacagaatattattactaacttgaagattcttctgaaagccagactcctctttgtaattcaagtgacatcacttacagtagcaaagaaagagcatcagaatgaaataagtccttgtgggtctcaatcatggtgaataatactgtggtttttcttgaatgagaaagggcatttgcaaacctcaaaggggtttaacgaaaccttactctcccctttaaatgtccaaattaagcttctttggaataaaaccttctcaaaagaaagcaaatgtaaaagttagattattgtatatgacctaaaacatttgctgaatcacaataaacacataccagcatctactatagcctgttacctaaatcaagtttcacagacccagagaattcctccgccttattttgttttttaaacattggattgaaagtactattgaggatcagcatgatcagtgcaaaccttattttgcacaaagagcaatttaggaaaaatggataaggtgataggccaccaatttatttgtctatccagaatgataatggttttattaaatcccttaaagaaagatgaatttttataagctagactatctaatttgttaaatagcacatcaatctgaatattgtcactgttttttaaaatactctaatgttaatattttggcatgtttgaattgaggcaacacagagttttctaatcgttaatctttaacttgatgaagggatctacacagaatgaagcagactacacacggcccaagggtagtggagatgtgtgtggtatctgttgcttctattaaacatttgcacatgaagcatgggtatatgctagcagaagaacactttcagacatcccatccctattcagttatccttcaaatcatatggcaacaacacaataagagccacttataccttattcccccgatggaaactctttgcctcttcagagagcccataaccagctgagggcccaggcctgactggtaacccctcagggagggagcatgtccataaatcagcaatatagcagagatggggcttcttatccttggcagccattttccctgcctccccttcctcccctaggacatcccctctctgccctggtatgcatcttggacactggatgtctcaactcagtttagaacttactaaaacaaggtttaataacctcatattaaaattttcaagactggctgggcacggtggctcacacctgtaatcccagcactttaggaggctgaggcaggcagatcacgaggtcaagagatcgaccccatcctggccaacatgcggaaaccctgcctctactaaaaatacaaaaattagctaggtgtggtggcacgcctctagtcccagctactcaggaggctgaggcaggacaatcacttgaacctgggaggcagaagttgcggtgagctgagatcacgccactgcactgcagcctggtgacagagcctggctccatctaaaaaaaaaaaaaaatttacaagactaccgagaatccgcacctcctaagaaatggagatcaagtctgtgcgagtcatcattcctcttgggtctcttgatttatctatcaattagcaacactatttgaccttctacctatgtgtgatcatggatattaatcagcccttctttttactgatataattcctactttttcagaaatctgacaaactcacaattgctgatatctaccctttcctccttacgaagatagaaatgcccatctataatttatagacaggtatgattccacaatttaaaaaataaagcaaaaaaaaaaaaaatccgctcaactcaaggcttatacatcactgattccctcaatgcccttacttggaaagcagtaattcttttgagctaataaaatgcatgttatgaaccagaacaataccttaaagatataacaaaagtaattatgataataatgaaaaaagtgagaatttcaaaatctttgtgtagttcttgaaagtatagtgcagtataatgtgagaactgaaggctgtttaccaaaaattcatatatctctccttctaaatatttattatttttgaacagacccgcttgtgtggccaggtgactttagccagtggcatatgtgccaattctgttaagtattttaagaaatggttttaccttctttctctttctctcccttccaccgtctggatgtagatagcactacggacctagggaaaggcagaaacacaagatgggagacatatgaaatatcccaggaagaaaactcttttgcagaagcactgataccagactcttacgtaaatgaaaaaaaacttccatttagtttaagccattattacattttggagtctataatgctaaagcagctagtatcaccctggttaattaatgaagtaaattaaatggttaaaagcatataacctacctgggacatcttgtagggcagtaagatggaagttaaaggacaacaggattgaaacttaaagtgttcaaagatgaaatcataagcagtatggaacctcggaggtaagttggggtataaaagaaacaaaactggccatgagctgattatttttaaaacagaatatgggtatatgagaattgatcacatattctctctagttctgtatatatttgacattttacacaataaaaatttaaacaggcagggtgcagtggctcacacctgtgatcccagcattttgggaagctgaggtgggcggatcactcgaggtcagccgttcgagaccagcctggccaacatggtgaaaccctgtctctactaaaaatacaaaaaattagctaggtgtggtcgtgggtacctgtaatgccagctacttgggaggctgaggcaggagaattgcttgaactcaggaggcagaggttgcagtgagccaagatggtgccactgcactccagcctgggtgacaaagtgagcatctgactcaaaaaaaaaaaaaattaaacacttttttttaaaaagtaaggatacctggagttcccactggcctaggaagggaatatctgagcatcaaaaaggttaagaacagaaacaaattaaaacatacaaaattttttttagaacaacagggagaggttccaagatggccgaataggaacaactcctgtctacagctcccagcttgagtgacgcagaagacaggtgatttctgcatttccaactgaggtaccgggttcatctcactggggcttgttggacagtgggtgcaccccatggagtgtgagccaaagcagggcaggcattgcctcacccaggcagtgcaaggggtcagggaattccgtttcctagccaagggaagctgtgacaaatggtacctggaaaatcataacaaccccaccctaatacagcacttttccaactgtcttagcaaatggcacaccaggagattatatcccgcgcctagctcggagggtcccacgcctagctcggagggtcccacgcccacggagccttgctctctgttagcacagcagtctgagatcgaactgcaaagcagcagtgaggctgggggaggggcatccatcattgctgaggcttgagtaggaaaacaaagaggcccagaaactcaaactgggtggagcccaccgcagctcaaggaggcctgcctgcctgcctctgtagtctccacctctgggggcagggcacagctgaacaaaaggcagcagaaacttctgcagacttaaacgtccctgtctgacagctttgaagagagcagtggttctcccaccatggagtttgacatctgagaatggacagactgcctcttcaagtgggtccctgagacccaagtagcctaactgggagatacctcccagtaggggccgactgacacctcacacagccaagtacccctctgagacaaagctttcagaggaaggatcaggcagcaacatttgccattctgcaatatttgctgttctgcagcctccacaggtgatacccaggcaaacagggtctggagtggacctccagcaaactccaaaagacctgcagctgaggatcctaactgttggaaggaaaactaacaaacagaaaggacatccacaccaaaaccccatctggacgtcaccatcatcaaagaccaaaggtacataaaaccacaaagatggggagaaaccagagtagaaaagctgaaaattctaaaaatcagagcgcctcttctcctcgaaaggaacgcagctgctcgccagcaagggaacaaagctggatggagaatgaatttgacgagttgagagaaggcttcagacgattgttagtaacaaacttctccaagctaaaggaggatgttcgaacccatcacaaagaagctaaaaaccttgaaaaaagattacatgaatggctaactagaataaccagtgtagagaagtccttaaatgacctggtggagctgaaaaccatggctcaagaactacatgacacatgcacaagtttcggtagccaattcgatcaagtggaagaaagggtatcactgattgaagaccaaatgaatgaaatgaagtgagaagagaagtttagagaaaaaagagtaaaaagagatgaacaaagcctccaagtaatacgggactatgtgaaaagaccaaatctacatctgattggtgtacctgaaagtgatgaggagaatggaaccaagttggaaaacactctgcaggatattatccaggagaacttccccaatctagcaatgcaggccaaaattcaaattcaggaaatacagagacgccacaaagatactcctcgagaagagcaaatccaagacacataattgtcagattcaccaaagttgaaatgaaggaaaaaatattaagggcagccagagagaaaggtccggttacccacaaagggaagcacatcagactaacagcggatctctcagcagaaactctagaagccagaagagagtggaggccaatatccagcattcttaaagaaaagaattttcaacccagaatttcataactagccaaactaatcttcacaagtgaaggagaaataaaatcctttacagacaagccaatactgagagatttagccaccaccaggcctgccttacaagagctcctgaaggaagcactaaacatggaaaggaacaaccagtaccagccactgcaaaaacatgccacactataaagaccatcaatactaggaagaaactgcatcaactaagaagccaaataaccagctaacatcaaaatgacaggattaaatacacacataacaatattaaccttaaatgtaaatgggctaaatgctccaattaaaagacacagactggcaaattgggtaaagagtcaagactcatcagtgtgctctattcaggagacccatctaacatgcagagacacacacaggctcaaaataaagggatggaggaagatctaccaagcaaaaggaaaacaaacaaacaaaaaaggcagggcttgcaatcctagtctctgataaaacagactttaaaccaacaaagatcaaagagacaaagaaggccgttacataatggtaaagggatcaattcaacaagaagagctaactatcctaaatatatatgcacccaatataggagcacccagattcataaagcaagaccttagagacttaaaaagagacttagactcccacacaataataatgggaggctttaataccccactgtcaacattagacagatcaacaaggcagaaagttaacaaggatatccaggaatagaactcagctctgaaccaagtggacctaatagacatctacagaactctccaccccaaatcaacaaaatatactttcttctcagcaccacatcgtacttattccaaaactgaccacatagttggaagtaaagcactcctcagcaaatgtaaaagaacagaaattataacaaactgtctctcagaccacagtgcaagcaaactagaaatcataatcaagaaactcactcaaaaccactcaactacatggaaactgaacaacctgctcctaaatgactactgggcacataacgaaatgaaggcagaaataaagatgttctttgaaaccaacgagaacaaagacgcaacatactagaatctctgggacacattcaaagtagtgtgtagagggaaatttatagcactaaatgcccacaagagaaaacaggaaaaacctaaagttgacaccctaacattacaattaaaagaactagagaagcaagggcaaagaaattcaaaagccaacagaaggcaagaaatgactaagatcagagcagaactgaaggagatagagacgcaaaaaacccttcaaaaaatcaatgaatccaggagatggtttttagaaaagatcaacaaaattgatagactgctagcaagactggtaaagaagaaaagagagaagaatcaaatagacacaataaaaaatgataaaagggatatcaccaccgatcccacagaaatacaaactaccatcagagagtactataaacacctctatgcaaataaactagaaactctagaagaaatggataaattcctagacacatacaccctcccaagactaaaccaaaaagaagttgaatctctgaatagaccaataacaggctctgaaattgaggcaataattcatagcctagcaaccaaaaaaagtccaggacccagatggattcacagccgaattctaccagaggtacaaagaggacctggtaccgttgcttctgaaactattccaatcaatagagaaagagggaatcatccctaactcattttatgaggccagcatcatcctgatagcaaagcctggcagagacacaacacaaaaaagagacttttagaccaatacccctgatgaacttcgatgcaaaaatccttcataaaatactggcaaactgaatccagcagcacatcaaaaagcttatccaccacgatcaagttggcttcatccctgggatgcaaggatggttcaacatatgcaaatcaaaaaacgtaatccatcatataaacagaaccaaagacaaaaaccacatgattatctgactagacgcagaaaaagccttcgaaaaaatttgacaggccttcatgctaaaaactctcaataaactaggtattgatgggatgtatctcaaaataataagagctatttatgacaaacccacagccaatatcataccgaatgggcaaaagctagaagcattccctttgaaacctggcacaagacagggatgccctctttcaccaatcctgttggaagttctggccagggcaatcagacaatagaaagaaataaagggtattcaattaggaaaagagtaagtccaattgttgctgttggcagatgacatgattgtatatttagaaaaccccatcgtctcagcccaaaatctccttaagctgataggcaacttcagcaaagtctcaggatacaaaatcaatgtgcaaaaatcacaagcattcctatacagcaataacagacaaacagagagccaaatcatgagtgaactcccattctcaattgcttcaaagagaataaaatgcctaggaatgcaacttacaaaagatgtgaagaacctcttcaaggagaactacaaaccactgctcaacgaaataaaagaggacacaaccaaatggaagaacattctatgctcatggataggaagaatcaatatcatgaaaatggttatactgcccaaggtaatttatagattcaatgccatccccatcaagctaccaatgactttcttcataggattggaaaaaactactttaaagttcatatggaaccaaaaaagagcccacattgctaagtcaatcctaagccaaaagaacaaagctggagccatcacgctacctgacttcaaactataccacaaggctacccaaacagcatgatactggtaccaaaacagagatatagaccaatggaacagaacagagccctcagaaataataccacacatctacaaccatctgatctttgacaaacatgaaaaaacaagcaatggggaaaggattccctatttaataaatggtgctgggaaaactggctagccatatgtagaaagctgaaactggatcccttccttacaccttatacaaaagttaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactcaagagcttctgcacagcaaaagaaaccaccatcagagtgaacaggcaacctacagaatgggagaaaatttttgcaatctacccatctgacaaagggcaaatatccagaaatcttccaagaacttaaacaaatttacaagaaaaaaatcaaacaaccccatcaaaaagtgggtgaaggatatgaacagacagttctcaaaagaagacatttatgcagccaacagacacatgaaaaaatgctcatcatcactggccatcagagaaatgcaaatcaaaaccacaatgagataccatctcacatcagttagaatgacaatcattaaaaagtcaggaaacaacaggtgctggagaggatgtggagaaataggaacacttttacactgctggtgggactgtaaactagtgcaaccattgtggaagacagtgtggcaattcctcaaggatctagaactagaaataccatttgacccagccatcctattactgggtatatacccaaaggattataaatcatgctgctacaaagacacatgcatacgtatgtttattgcggcacgattcacaatagcaaagacctggaagcaacccaaatgtccaacaatagactggattaagaaaatgtggcacatatacaccatggaatactatgcagccataaaaaatgatgagttcatgtcctttgtagggacatggatgaagctggaaacaatcattttcagcaaactatcacaaggacagaaaaccaaaaaccgcatgttctcactcataggtaggaattgaacaatgtgatcacttggacacaaggcaggggacatcacacaccagggcctgttgtggggttgggggagtggggagggataccattaggagatatacctaatgctaaatgatgagttaatgggtgcagcacatcaacatggtacatgtatacatatgtaacaaacctgcacattgggcacatgtaccgtagaacttaaagcataattaaaatatatgtatatatatttttaaaatccataacttcataatgacacatgcatgaaaactcattagacgttaatgaatgaatgcctaataacttctagttggtaaccaatgttaccaaatagaagttattaggcattcattcattaattaaaaattaaaatatgataaacaattaatttcctgcctatgtgaactgtatatcagagtaaccaaatggttgataagaaaaagtttttttatagatctccatgaataaatgcaggagaaatgacacaactagaaaactgctattttgcatcccctaatgatataagacctatatccagatataggaaactactatgagtggacataaaaccatcagtgtaagcatgatagggaacttggtaacagaacagtctgacaatacctgaatgaactaactcatgttatcttcactaaaaggacatatatcattatttccttcatgctgtgatgaaataggacatacatagcaccatctatgaagtattcttgcctaaaaaatctctataaaatctagccaagactccagactaaataccaggttatagtggtgattgggttcaggacatgctttcctaaaatatgacaccttggtatttaagaaaacagcagaagcgggaaggtcactctcaccttctgccgttctctcctgaagcaggtcatgaaccaatggaaggatttttttgagcgtcccctggagcaggtcataagaccattttagaggtgccctccttatacatggaggaaaggaacatccttacctctgaagacacagggacacagagaagaagctgaacaaacaggccttgctaagttccctcccccagtttattaccattagatcacactcccaatcatatgtccaatcatacttcacctcttcccactcttcatcaaacctagcataaaaagtacacggtttaaccatttctttgggccttcatttccttatgaaggctcccatgtcacatgaaacttatattaaataaatcggtttgcttttctcttgtaaatctatcttttgttatagcggcttccatcataaaactaggatgggaataaaaggtatttcttttcccatacagagaaataaattaaacactgccacaaaaaagcgaacagccatcttcaaaatatagagcaaatgatccagtttctctcacaaatcaaagttattgagaggaaggggataagaggactaattaaaaaaaaggagacaagcaacataacaattcaatgcaatgtgtgaatctcttttagattctgacttgaacaaaaccatcaacaaaagaacaattagggaaatgcaaatatggactggatattagaaaatattaaggaattattattaatttcattaaatgtgatgatggcatggaatttaaataaaggaggtaaggcccttatcagttagagatatctactgaagaattttcaggtgacaagatatgatatccagcatatgctttaatgcgctcaagcaaaagaaaagaaagaacgaaaaaataaaatggggacagaggaagtaagattggcaagatattgataattattaaagctggatgatgcacgcatgggtgttcattatgctattagttctacatttgtgtatatttgaaattttccaagatacagttttttaaggcacaagataggagtcagacattggttggaccagccctttcacttccagctgggagaaactgggcagatcactacagcctgcacattgccctcctttgtgtcatcaagtgcacagatatttcttctaagaatgctccaatactattccttggattttcttccgagccatagacacctattttgtgagttttgatgcttccctttcaatactcatacacgtgcagacaaacaacagttgtcccaactgctacctatctgaagtgattataagtgactatcaattatgacatatatcccaatttcaaagattaaaatgtgaaaaaaatgtgcgttaaaaaaatctatgaagaaagagacctggagatgaagttataataaaaatgtctatgacaatgagattttctgaatacctacaaggcatctcctgctttggctccataagtaccactatctctgtttgtttgtttgtttgtttgtttgtttgtttgtttttgagacagggtctcaatccctcgtccagactggagtgcagtggcaggcactccccaggctcagatgatccttccacctcagcctcccaaatagctgggactacaggcatgcgccaccacacctggctaatttttgtatttttggtacagacgaggcttcaccatgttgcccaggctgatctcgaactctagcctcaagccatctgctcacctcagcctcccaaagttctgggattacaggcctgagacaccacccctggcttcttgggttattttgactgacatatctcactggctaaaatacttccatttttctagaagctacggcaactaccactgggttggcaaatgacaggccctggaaatgtttctgatagatgtttgttgcatgaataataaatatgcaaattttaagccaaaaaagaaatataacacatgcaaagagatgtggggagtctcgtgcccttctgtataaagttctggaagctaattttggaaactctatcaagaagttgtgtgtgactatttttccaaagtagagtcaaaattcatgaggcagggcaaaagttacactgcatctaatgatgagtaagaatgcacatctgttccctggagctgctctctatacacatattctagtaatttccacacaccatcagaagatagaagatggagaaaaccagtaaagatataatctttgagaaaagacttttgttggagcctaaacataaacttttccttcaagtccatgtcctgagagaggtttgtaaatgtgtgacctaaatgaggctaccactgaattttgtttcccaatatccctcagagaggctataaggcatatacaaattctacttaaaagcaaatcatggtaaacatttattaaattttattacgcaccaagtaccacactcgtgttcttcccaggactgccaaagttggctgaaccctgatgcagtaactctgcagatgtacctataacatctcaactaatcctagcagcaaccctgcaaagaacagtaccaccttacttatattttcaggatagagagtatgacctttagaaagacttgctaactggcccaagttcgacagccggtaaatagcatatccaggactcacacccacggctatgaaaaatcggtgcttgcggcttgtgtttttcacctaaatacacaagtgttacatgaatgaactgtgatggaggatcagcattgttcctgccaaccacacccacctgcagtctagcgcagatcaatacttttacaaagtgcaatgaaaatgaatcactggggaataaaggcattcaaagtaaaagtcaaaagttgttattggagtcaacagacaaatttatgctgttattgcccacgagtttctaaatccttactctcaatttatatgcttattttgttgcatactggcaccaggacaaggaccaccctttgagtagtgctgcactacactttattgttagatccatgcttagaatgaacacatttataataaggttccaagatccctccacctattgagaggctggtaattcttttagatgttaattaatctatttttttttaaatgaagatgacttttagcattttcttctttcctataaagattcatcaagatatcagacataggttccaaagtcaacaaaaataaagaacttgtgaaattttctgctgctgtatgatacaactgctgtggtattttgataaatattaacagaaaatgtgaaactttgaaatatgtttccttaccaagggaacaatgaataataatgaaaccagggaatgaggactagaagcaccaggtgcccccgcctcccatccactgcagggaaggactctcttccaaatccaccctgaaaagtgagtggctgttgggaaactaaaaaatgtacttaagagatctcaaatatatggtgacacatggaattcttcaacctgccatgcctcttgagaagttctcaggtaaataacaagaatgatgcccacaatacattcacatacataaaaaaaatgtcctggaaagaaaaagaggatgggagaagaagttaatgattcttggggctttttaaaaaaattgtgttcggctgggtgtggtggctcacacctgtaatcccaacactttgggaggccgaggcaggtggatcacctgaggtcaggaatttgagaccagcctgaccaccatggagaaaccccatctctaccaaaaatacaaaattagccgggtgtggtggcgcatggctgtaatcccagctactcaagaggctgaggcaggagaatcacttgaacccaggaggcagaggttgcagtgagcctagatcgtgccattgcattccagcaacctgggcaacaagagcaaaactccgtctcaagaaaaaaaaaattgtgtttaaagtttcaagttaattttttttaagtcaccatagctcatatggccttggtatgagttgatgggtcaaacccatagcttctctggctactcaggaaattagtaaaggagggcaaggaaaggcacaatatggaagagagaaattactagacaagaatcagcaatctggagcgaacccaatctaaaggaaacaattagaaactggcacaggtcccaaatcaataagcagaggtgactgtgggcagtgagcataatggctgggtaatgaaaactaaaatgcaggtaagcaagcgctgggaaaggagcagctgatgacagggtcatctgtccagaggcttgaagagacctgtctgaacaggctctcacagcccagctagtccctgatgtcacagcctgtgtgaataaacagcactggtgtggtatccccaaacttcataagaaatgaagtcttcatggctcaccttgtcaaggccagagaacaatcccaacaggaaaaacacttcttacagattatgcagtggattcaaagagcactggaactgtatttcccattagctctaatggaggttgtgctaataaattccccagctctgggctgaacaggtgtaattcagtaatgtagctataattgagtgatgtcaactcaatataatttgtaatgtttttgtaacaaattatctctttttttttccagaaaaaaaggcatctgtgattccatatgataaattactttaaaagggtgacatacagtgctaatgataaagatctttaattgatagaaatgttaatagtagcatcagctaagaattatctttgctgattctttatacacagtaacattttaaacataacaagctttcgtttttgaccaaccaatgtttttgatttgtgactcatggttttcagatatttctgtatttcatcaatataactattctactagagaggttctgtataaaccctgcaatttagccattcccttccctgcacagttcccaagccagatctagacatttctacctctgtgcctaagagaacactggtctcctggtctggatggacagctgtctcctcctcttccatgtacctaagaatgacctgttggcccagtcaaaaccctccttctatgaagctttccagacctatagccaggattactctttcacaccctatacccctgggacactttggggtccctctattacattcttacttttcagacccccttgtacatgctattcctctgctgctctccctggttagggcccactcatccttggggtttcagttcaacgttatacctcaaggagaaccttccctgctttggaacagggcacattacacgtgcatttgcatacctctgcattcctttcctttgttgcactaaccacagttgttgttagtatcttttgtttgtttgtttgtttgtttttcaggaaaaaaaggcatctgtgatgcgtctcttttccactagggctaggctttagacaaggtctgtgttgagttttcctaaatctagtagcaaggacatgatgctccatatctgaagaaagaatgcatggatgaatgaatgaacaaacactatctctgtctgtctctccctacctctatctgtcctctccactaaacttgaactcaaaggtaatacagtgctcattgtagccacaataatgcctaattagggtctcgtccataatagagatgagaaaaactcagttgaaataaatttaatttctcctactgtagtgttaacatcaggttagtcatagagaattcagttcccaaagcttatagtgtttttcaccatatgctatccactgaccctcatcaagctccaaccacgtgctagcccctctgcaagatactgtggaagagaagtgaatgatatttagaaccaagtactctacagtttctgggtgattcccatgtataaccacatttctgcattcatgccagatactgggggaattcaaggttaatcaaacacagatggtgtcctcaaggagctcaggatctgggagaagagataaaagtgaagaaaaaatatcatgaggtggaatccatgagtgacataaaaggagtcccaatacagattctaggtgttctaatgagggacagagagaatgtaggcttaagtgggggtattttttttaagttttatttttaatttttgtggatacatagtgtatatatttatgggttgcatgagatattttgatataggcatgcaatgtgtaataatcacatcagggtacggtctccatcatctcaagcatttatcctttgtgttacaaataattaaactcttttagttattatcctaaaatgcacagataaattgtttttcactctagtcaccctgttgtgttagaaaatactaagtcttatttattctttcttactattttttgtatccattaatctttcagtggggacagtttttaaaatgagtctttacctgttgggtgggatggctcacgcctgtaatcccagctctcagggaggcagaggcgggaggatagcttgagcccaggagtttcagacctgcctgggcaatatagcaagacaccatgctccacaaaaagggaaaaaaatgagtctttacccaggtgaagattgggattagggacccagccaaaaggaagcgaggttgaagagcaagagtgtttattccttggttcaatagatctttgtcacctactgtgtgaggcataaataaacctaagtccattctcaatgcagcttacattctaattgtggagacaggtgaaagcaaacaaacaacaatgccaggttataatgagtgctctgaaaaaacagggcagagtaagaagcgaagctgatgagagtgctaccccagacaaggtggtcaggggaggccttcccatgtcaatgacactgaacaatgacttgaatgaagcgaaagagtgagccatgtaacacgccttgggaagtgcattcccaacagagaacagcaatcctctccacagaggaaggacagatgacccacacctttttcaaactggggtctctgagcatgttcttagggatctgaatgttcttgatgagactttttatttttggttttatttagataatactcacttaaaatagttcaagtgtattctgcatcagctacatagcacctaaaatacgggtaccagcacaaaagttttgtgactcctttatgtttgcatttataattgtggtggtatcaggtattgctgttttagctgtcacaagcaaaagataaaaaaaacaaacttactacttaaataatgtgtttgtgcctcatgatctcagagtaggggtggagtacatatgaattgtcccagtaatagcagctggaagtgttagggaaattgagtcatcacacagcctaggctaacacaaacatgacaagctgtgtagaacctttgacataacagacatcccgtattgatgtttccagagatgattctgtttaaacaaataatatcattcatcttgttaatgcaatattcctcatttgaatttagttttgtcattttgattgcatgtaatttgtaaacgtgttatggtttcatatttgtctaagaaccacacaaagaaattcatacctacttttgtattttcatgtggttcaataatccaataacaaaaacattaagttaacattgggggttcataagacttttttttcccttggaatggcatccatatgttactcaaggttggtcacagtgaaagctggtggtggaaaaggcctttgttttccagaaccatgaccaggtgatagctctggatggtttccaatgaaacacacagtaagtacaggaaagaagggagatgaatatctttggtaggaaaaaaaaaatcacaaatcagatatacctaatgactgtaacttttattattctctgaacaccaaggaacgtaaaggccataaattatgttacatgttggttaattctccttcagaacacccaggccattggaacattaaatgtggaaagtatgtggcgggggagagagggtgaagaagctataatgaaaggttcactgcactcgggtggcagattaaacacagagccagatgaggagtcaagcgtcactaaaaatgcaaaacaaatccagctaaattatttcacctgcaaggaaaagtttttctcacaacacaacactgttctatgccaacaaatgtaaacaagagctaagacgactatctgaaaagctcaggcagttggtgaggaaggctccttgggtcacagaaccctccaaaacttctcactgtagcagctgagagctggcatctgaaatcaaactgggtagagttcaagaatcacctctaacagagattagctctgagacctagcaagttctttaatatcacagaaaaaaaaaagacaaaacaacacctacattacaaagttgttgaaaggattcactgagataatcctcatagaccacttagaacactgcctggcacgtaataagttctccataaacgtgagccatgagttttatgatgctataggtctatgattatataagcatgagtctccacatatggcacaacaaactgctctactcaactctacagccctggatgatgtctccacattttacatattccatgatagtttccaataatttatatacatgtaaagtatatttgagatggtcggtaagataacatcattctcattcattcccctccccaatatagttcctaaggaggaaagatatgaatagtgctatggtttggatttgtgtccacgcctaaatctcatgtcaaattgtaatcttcagtgttggaggaggggcctggtgggatgtgactgaatcatggaggcagacttcctccttgctgttctcgcaataatgagtgagatctggttgtttaaaagtgtgcagcacttccccctttagtctctttctcctgctcccaccatgtaagaggtgcctccttcctcttcaccttctacctgaggcctctccagccatgcttcctctacagcctgtggaatgtgagtcaattaaacctcttttctttataaatttctcagtttcaggtagttctttatagcaatgcaagaacggactaatgcagatgggtctacagaaagagcataacccaacaaccttacatggtaggtaccattattgtccctattttacaaataaacaatgtccagagaagaggatggacttgctcaaggtcatacagctcataaatgatgcagccaggatttgaggtcaagtagtcccagtctagaatctaccttcttaatcaccacaagactctactcctccaaacaagtgtccttcctctgtgtccagtaaagaggaactctgggaactgctggtcacataattgtttattcctccaggttccccaatgtctggccctagaaaatgaggatgtttcactcccaactaagcatttccctaagctactatttgttatgctgttagctaagatagaaagtcaattttaaaatcgtccatttgaacagttatagtaactttcgtaaatggtaaatgaaacaatttgaaaacactgtccaacattttacacagtatcccatcgaccacagctaactaaagtaattcacatgtgaattttattctcaaaaaaagtgtatgctttgcttttgacagataatgaaagccatttaattcaatgtggctttttttctttgctttttcctttttttttttttttttttttttgccagaaagcagtgagataaattgaatacccataaactgaagaaaatctgttaatttggggtgtctggttacacctattcttgtgcttttttaaaagagagtctgccaaagtttattctcttcttaaattacctcatctgagcagtattttcatttgtaaataatggccacatattctctttaaagtaggaggaaatggagaccttaagtgtttcaaggaaacttcaggtccctcaaacctccttcaaagaaaacaactgatgattgtctttgaggcaaggagacactagtcatcaggccatcaagggcagggaacaacctgaacactttgcagctctgcactacaggtcctcaacgtcgttcttgcattagcccattcttgcattgctataaagttcattcaatgccatctggttataacaccgacagaaaataaattgattcccagtggggcccctgtctatgtagggtctgaacattctccccatgcttgcatgagttttctctgggcagtcaagttttctcccacatcccaaagatgagcatggtaggtgaaccggcatgtctacatggtccccatcttagtgagtatgagtgtgtgtgtgtaggtgtgtaggtgagtgggtcctgcaatgggatgatgtcctgtccagggtgagttcccaccttgcaccctgagctgctgggacatgctgcagccatccgagaccctcaactggaatataaataattatcttacctgtttttattactctttcttaaatgtgtatatagttcgcatagatttcaatgtaaaatattcaaagtgttttggtctatttagaagtttgatggtatagttgtgaccagaaatatgccataggaacttaactcttatttatatcaattagtctatggtgaaattggttatatgttgctttgctttatgtcccagtttccaggaacctatcaatgacattaagtaaggacttactgtactttactatagctgaacaggctgccacccaaaaccataatgagctactatgacgacagtcaatcaggagacatatctgtgtttcagagaagaaagccagcagctttctgggaaaaagcacagagggaaactcccctaagctggagctatttcctagcagtaacttgctgctgcagtttagccctgtcatctgtgtgtactcctcattaagtaccacattatgggccatcatatcttctccagctgcaagtaaaggcaatgtcctggaattgccctatggcccaaatgtgtgactaatgactgagactttggcttcttgcttgatgtttggccttcagtattacatgaacctgctctgaaagacacaacactgtcacagatgtatgcggacagattaagctccagatggaaggctgtcaatgtcaatcagtcactgttcttacagcctggctggcttttcatctaagcaaccacagagcatgatcctgcagcactcagttccttagctcaattaagtcttaggattggaggtcaagttaccctggtttcctaagcattctctaccaaatgattgtttttgcctcactcctactgattcatttatagtagcttcttttgatgcattcatccttgagcatgtcttcccatttccaagtgacttgtttcactattctgcagaatgttccagccctttgatgaactatatataattgtcgaatcagctgtcccacaaagagataaaatctgaattaaatacaggacttgttgtcaggagagaacagataaggtgaagaattagaagactagctgggaagaagtgagatgattgaagtttatgaaacattttcccccctcctttgagtctcccaatctgctagtttcagtcggttggttttgtgttcctgttgtgatatatgtttagttcaaggctgtggactttgtgccttggttacaggtaagtgcctctgtgtttctcatctttatctatccagtcacttgtctcctctcaaagtttcactttttaaatatatatatgttatttaatatcaaaagaatatcttcacctttcataaattgctaaccctagactctggatgcctagggtaaatttttaattctattttatttattttaattaaatttaaattaaaatttgttttaattaaatttaaattaaatatctaattctacttttatttatttatttaattctatttttaagtctatggacttgcttgaacacacagctcagcaatgatgcaggcaggattcaagtccaggcaaatcatggctctagagcttgtgttcttaacttccacatgacattgtccctcgggaggaatattgtaactccctacgtttccattccaaactctcaaatataaaatgataattacaaggtacacgttattgcaaaacatgtataaaagcatataaatcaaagattacattttgcctcctcttctttttcccatccctctaccctcatatccacacaatttcattccctgagggagcctatattaataatttggcatgtacatttttgcatacagacatatatttttctaagtttctataatacatactgttctgtcacatgtttgacatcttttcatgtcaattcatagagatgcttgttaatggctgcagagtaatttcaatgtatagacatataatactatatataatactatattgaacctctttagctacttggtcaaatatatctacagaatacgttactagacatttcaaggaatttctatgtcaaaatatttcaaatagttaatagttccaaacttcccaatccaagtataatatttttatttatatccacaacagggtatccccctgattttgcccatagtgcttattatcctaaccaactgattgatatttttagtttaattatttaaaaaatgaggttataatgaggtccctaagagtcccttaacctaatttactaggatctactttatctggagagtaaaataaagcaactacccaatctcaaaatatccttttgcccctcccaaatgactcttctggaatcatttatatgctgacctccatataatttattggatttatacgatcttatatctctagattgagttacaaatggatgaatctcttgaaacctagaccaaaaaataagaatagaataaaaaaagagtttttggtatggaaactgtgactctccaacgtcagtagagacattgagaatggtttcccatgtccccaggcataaactaaaatatccactgcttttggacagtataaatgcagaatatgcccccagatgaatagaaatgagcaaatcttgagtgcagaactgaatttcttggagctgtattggttacctggagccatgaattaagtggatctgattctatctcttaaaggaacagaaaaaaaattattccaggtgattactgctcctcaagcatgtggtcactcaaaggaccttcttctagctccacgggatacatagttgctattcatcagctctgctcactgaagatgctgtgctacgcattccaaatggcgccttggaggactaactgatatcattaacacagactcgtagagatgtcatcattttcttcttcatcatcttcgtcaagattagttttaagtgttgggagtccgaggtgggtggatcacgaggtcaggagatcgagaccatcctggctaatatggtgaaacctggtctctactaaaaatacaaaaaattagccgggtgtggtgggtgcctgtagtcccagctactcgggaggctgaggcaggagaatggtgtaaacccgggaggcagagcttgcaatgagctgagaccgcgccactgcactccagcctgagcgacagagcgagactctgtctcaaaaaaaaaaaagattagttttaagtgaaccatgtactagttctcaaatcaaccacatcgggtaggttccattattatttaattctgcagatgtgaatacaaggccacaagttcgtaagtgatactgccggggctcaaaccacttatgtattatgtcaaaagccatgctcttaaccattgcactatactcccttctacaggcataaaattttaaaaatatataccagaagagcaaaacaatcccaagtatgggaaggatgaaagagaagggtggcagttggcacagtggagcataatgggccagtctgactgtaagactcctgtttcataatgtctgcatgtcactaaaaaggatctagaccaaggttcacaaacacaaatgaatatgggggccaggacgttaacatacatgagtaaagaggaccaagtgcatgacagaaagagtggtgaagaacgtggtaaactgaaacacatgcctcaagggaagaaggcaatactctcatgtgtgtatgtggttcaaatgttgccaaatctatgaatttttttaacagaagaaaaaaaatccaattttaatgcaaaatgtttctatttccaaattatgatttcaatgtcatgtttaaaaacactttgacgatgacttagttccctctgacctccacacataagcattaacatggacagaagtatagcagcagtgtgaggtgcttttccagcagccatcagtccttcatccttgctaacataccttgatctttctcaggtacctgcaggtggtagtgtgtccagggaagataggccttactctcagcataagaggctgaaacgtactggtctcagccagtgaaggtaactgaatacttcattgacattgactggtctgggatgggatgcatgtgtgactcagttctagccaaagagaaatcgaaagatatctgctaagagactttaaggaaagattttctttcctgaaatggaaagagagagagaggcccaccacgagatggccctttttgctcccttccctcctatcctgtgttgaatgctaatccaggacactgtggtgttgaaagctctggcagccattttgtggcatgaggtaacaagtctaaggattaaggccaatacaccgccaatggtggaatgaaagcatgaaaggagcttggatccttgtttagcagccaaatcaacactgagactacttaatttgaggtttcttatataggaaacagtaaatctccttgtgatttatggtactattagttgggtgttctgttacttcatactgaatacattctaatgaaggatctcactttcaaccttacttcagagttctagctttttgtttacagcatccttcatgcaggaaaacttcaagtttacacagagtgtgcaactagatgtgagataaggctctgccacttgagaacgcccacacgctgcttcaaaaatttaaattatgctgttagcttttcaagatggatgaaatccttcataggatcatatagcaaggactaaattgctctcacagttgccaggcaactgtgtatatgctgcctagagacaaaaattcatgacccttgactccccaaaggagagtctttacccacaactgatatgcatgtgcccaagtctaacacttccatccagcaaaggtcatggtgtacatctgggctatccaacatcccaagctcattatactgccaacttatatcattcttgatcacaccataaattatgatttctgcatgcaaatccaaatgacagagcagagagtgtcctggggcataattccctgtcctttggcctgtcttattatatagactgattgggtaccatccaggcaaacaaaaaaaagacacatgaagattcctattagcctgaagaatcactgtcaggtaaacagagttttgtaaacagcttccaatattcaaggaaagtttgagttttcacagtgagtaatgtgatcaactttaataatgtctcaaggggcttctatctcacgagtcattttcaacacacacacacacacacacacacacatacacacacaggctaagatgtgctcatcattctattagaaaggaaatctcaaaatgcaaatatagatggtgtgttcacatttacatttcataatgatctaagtgttttgtttttgcatgtgaatttcataatactttaaatcatagaatcatggaatataaaaatcaaaagtgaccctgagatcaagaaggtccaatccaagagaaattaaatggcacagctgcttaggggtgaacactgaatccaagttgctggactctcagtctactgcgcttccccaaaactaacatgcttgtccctcaggcagtcaacccttaatcattgtgatgataaacatcagggacaacttaatttcaacttgacaataaatcaaactctccatgtagccattagttgctgtactagtcagaaaaaggttaagttgaatgtgaaccactctttcactacctcccacctcaaaaaaaaaaaaaaatgaacggaagcttgaatatacaagcttttattctctcatttaacaagtttggagatcagtagtctagtgctgacatggcagttctacagacccattacagacctagatgccttcaacttactgtatctccattcctagagggtgactgtcttagtctgctttgtgccgctataacaggacctgagactaggtaatttataaacaacagagatttattagcttacaattctggagtctgggaagcccaagatcaagggcccacatcttgtgaaagacttcttgctgtgttacacatgtaataaggcaccacatgatgagaaacagcacgcaaaggagcaagaagtgactaaactcacttggataacaaacccactcttgcaatagtgaacccattaacataataatgacattaatttattcacgggggtagatcccccatgccctaatcacctcttaaacaacccacttctcaacactgttgcattgaggaattaagtttccaaaacataaactctgggggacacattcaaaacacagcattcatcttcttaacatagccaaaaaggccgggcatggtggctcacacctataacctcagcactttgggaggccaaggtgggtggatcatctgaggtcaggagtttgaaaccagtctgaccaacatagtgaaaccccatctctactaaaaatacaaaaaattagccttgcgtagtgacatacacctgtagtcccagctactcaggaagctgaggcaggagaattgcttgaacctaggaggcaaaggttgcagtgagcagagattgtgccatttgactccagcctgggcaagaagagcaaagctctgtctcaaaaaaacaaaaacaaacaaacaagaaaacagcaaaaagtattaatgagccgttatgtctgcaccccagttggcagcaaggaggaagctgtaatgcatcttctctttaagaattctcctagttagtgtacccctgaaagcaaagcctaagacaaggaccaagggcataggtttgggtagattatttggatggtgatctcagaaaatttgaaagaaagagatgagacagtaaacactggaaggaaaaaggaaacagcatgtgttatcaacacctggggtgctatgtgaggagctgtgtggaatgtacccacaactgtccatctgatagaaggctgtggcaacccaccaattggttaagcattgcctgtagtgctgttacttccccggctatgcttgtgcgtgggctgggaagccttcttttggttttgagtaaggcctaaaccagaatagtagatgtacagcacagcagaacttgaggaccctggcagcacatgacagcatctgccacagctgcaatgaaattaggtggggatagggaatgtggcactgtgcacctgctacaagaaaatgtccagaaagttgctcataaagtttcttattatctctatgcatcaggagtccccaagacaatccttagactcaatgattcactaaaagactcccagaacccagaaaaactatgtactcatggtgatggtttgttacagagaaaggacacagattaaaatcagcaaagtaaaaaggtatataggaaagaatccaggagaaaacaggcacaagtttacagtgtcctctaccagtaaaatcacacagctggttcttaattgtcccagcaactatgtatgacaacatgtataaagtattgccaacccaagaagctcacctgagccttggtgtccatgatttttattgggggtcagccacatagacatggacttcccacacgaatgaccttaattacccagtctccagtccccccagaggtcaaattgatacaacatagcccagggcttcaggtgaacagaaacagcattcaccaacaatcacattgtcagtataaactatctggcaagacccacagtttcaggtattcaaaggcacttttctcagttagggtgcttcaaaagctccaaggttatctctttggagatggtcaagggccagtcttttatttggtatctgcagaatttgaacaccccaagccttgagttaaccctttactgaacaacctgtttggtcagaacttagtcaaatggccataaccacctgcaacaaaagtaagaaatgcagtctttgttctgggcagctatattcctactcaatatttgggaattctattattgtataatggtggttctcaaacttcagcacatcagaatcacctggagaattcattaaaatagactgcacaaccccctcctcagagtttctgattaagtaagtgtagggtgaggcctgagaatttgcatttcagtaatttaccaggtgtattactatccgaataaagccagaacaaatttacacaaactttgggcttaaaacaacacaaattcattatcttactattctgtgggtcagaagtctgacacaactcgcaccaagctcaaatcaaggtgtaagcagactcctttctgcagtctctaaggaagaatgtttccttgctcattccggttgttggcagaatgcagttctgaagtcctgtttccttattgcctgtcagctgaagatcattctgaatttctaaaggccttccacatttgttaggaggttgacccctccttccatcatcaagtcagcaatgaggggttgggttcttttcatgctttgaatctcacctgcctcctctatcgccatatctttctgattgcagcctgaaaaggttctctgatttttagagctcatttgactagactgggcccacccaggtattcaggagaatccccccatctcatggtctgtaatcttagtcacatatgcaaagtctgttttgccaggtaagatagtatattcacaggttctggagattagggtgtagatatctttggggggagggcgcatgattctacctaccacaccagtcagttcactctgattctgtggttagggaacacactttgagaaccaccaatatagaaaataagagaaccagaagactcttccacaatgtagccttattttacattgttggaaagtcaatgaaagcttttaacaaactggttgactgcagctttacctcttcagtgggcccctttcctactcaaaaagtaatgagaaaaaggcagcaagggggaccagagaatagagaaacaaaaactgaaatcactccctgactagattaatcagctcttgcatactctggccatttatcagatatattcagtgaaattcttggttgagagaaagagggagaaaacacaagccaatcctgaatcaaaattaatagagaattctactagaattcaacaggtttttcttttttattttttaatggcaagatccctgaaggcctttaaaatacgaatgtctgctttaaatctccaagaaggagggcagagttcttgaaaatgatagccatggtttttttcgtggcacatataatggaattgggctgcctggaaaaatgcttgagtaaaggttgctccacaaggggaaaggtggtaactcaatgcaccttcactttctaggttggtgcttctcaatttggctgcatattgaaatcatcttaggagctttaaaaagcgctgatgtctaggtcacacaccccagtgattctgaagcaattgctctggggcatgtcttgggcattgtgcttttcccccaacatctcgcagatgattctaacgtgtagccatgattaaggactgttatggtaggtgataaccctgttttcctgagtctattagcatatgtagttactaaccagagtcagtaaactaggtattgttctctgtattttaattcctgcccaaccaaattaaggaagtaatttcaaaaattaaaagagaagagataatctagagtggcaggcagtactaaccaactccacattcaagaatagcatcctttcttaaccagcattgcgtgattttaaactcttcgtatccccagaatttagcacagtgccccacacatagtatatgttcaggaagaactgtggtaaatgataaagaattatgaacaaagtcctcttcaaaatgaagattgcaggagaatcaagcttcagtcagatctaagtgcacactactctagtgagataagccaatcagataagcaggatggggaaccaccattttggttttgttgttgttgtcattgttgtttttgagacagagtctcacctaggctggaatgcagtggtgcgatctcggctcactgcaatctccgcctgcaggttcagctgattctcctgcttcagccttctgagtagcacgcctggctggctaatttgtgtatatttttagtagagacggggtttcaccatgttggccaggctggtctcaaactcctgacctcaaatgatccactcaactcggcttcccaaagtgctgagattacaggcatgagccgtcgttcctgaccaggaaccaccattttgattggcatggtaccaggtacacagaatttagccaataaactatttgatgtgtgaaagaatgaataaattttggcattaaaaggcaggcttcggtatgtcagagcaagaggtaattggatgaggaccagaggatggagcccagagcaggaaatgaagctcagagaagaggtagatgttcaacgtactgtgtctcctcctccagttttgagtaggtcactgaaaacacttggcatggcagtgaaaatcactcaaaagacccccgtggaaatggacagacttgtgtggaaatttgcagatcttggctgcttctaattcatttgtctttctaacctattagaatccaattcagtctctttggctctacccaggataatgcaaaactgaattgtacacataagcttcctgccttctgctccttctcttcataaccaatatgttgctaaacaacaatttctaattgccccttcccaggacaccttttgagagcatctctctttgtaccccctgaaatacataatactaattttctttgacatgctatatattttgaggatccatgcatccctaacaagtgcccagtcttacgatggtgcagcccctcatccagtgttctatcatttaattcatgatgctgtttatcttggctgcaagagagtgaattattggcatattcagacagtctcataccacctctcgtcctctccattatcataaaagttaaaattatttatttatgaaccaaataacttgtctgaatattttaacaatgcacgagcacttatggaggtttttatttcaatttgggtagagatacaaagtcaaatatgatttcagtacaagttgtgatggtttttctcaatatcttatatggggttccatttttgccttgtacaattaatacaagaagcataatgaactcagcaatccccttgagaaataacaaataggtataagcaataatttatctgtggaatgcagggccttgatacataacttccatatctactccaaaagaaaaagaaaagaaaaaaaattcctagctaagagccatgaagaaagagtccaaacactctcacacattgttgttggaaaggtagactatacaacatacttggattgcaatctggcaatatgctttgaatgttcacaattttaaaacatatatttcctgacccattatttcaaagactgtatcctgatcctgatgaaataataaaagatgtgcctaaagatatatcatgtgtggatgctcatttacagtgttacttcccataaagagaaatagggagaaacaaataagaaacctttctaatatattttgttatctataaaatggattgctatgcagtcattaaaaataatgttcctaaaaattagtttataggaaaatgtataaaaatgtacatgacataaagttaagtggaacagcaagatataaaacagtctatgcagcctatttccaatatgtttataataagtatttccatatatatttctacgttggcatattattctacacagaaaatgatcagtacatatttttgagtgtataagcagggtgtgtgtgtttacaaagacaaagatgaaataccccaaaatattaatagtggttatggctagatagtgaagttatgggggatatttattctttgccttatgttatcctacattttctaaatagtctcaatgcaaatgttgtttttataacttattactgatttgtgagctaaacagacccattgacattttccctggaatattctagtgacacaatcactctcctgttagatagtcccacccctcatgccccctcatttggtctcttccaagatccaggactttagagccagaaacatttggattcaaatcccagctctttactttctagctctatgaccatgggtaaggtcattctctctgggtgttctggacctttgggatagagttgttgggagagttaaatgaggagtgttgcattcctatccgatagttatttctccctccccttcctttctaataggatctgactttgtgattttattcaggtattgactgcccacaacctatacccagggacaagaggctggggcctactcagacctaaggcttgaagcttaactagactaggacaagcatggtaacttcattccccttgcaagggatcacttcagggtatggtttgaaattctggccaatcaccaagtgggacaattgttggaggccagggtcgttctgaaaaagttttcttcacatttaagaaaacaaaggacacccagaaggatgagtattcattgccgtttctggccttcagacactgaggatttctggatgcactatagccaaacttggaccattagaggacaagcctgcaaagaaaagtaacacctgaaagaggggagaaataaaagacagaaaaaaaccttgatacttgataatgttgttgctgaattctggcatggccctattttttttatttatatttaaaatttttgtttaaatcagttgaactaggatttctattacttttatctgaaaggatcgtaagtgatacaaaaagcaaaagtgccaagctcatgacagagagcagagttcaacaaataaaaaataaaaaaaagtcttttctttctctcaccttccaaatacatatttagtatacacagtatatacttgtttatggcttgtaaatgtagttaatagagaaagtaacaagaaagaaaggggtaaatgcaccttttcctcctcttaaaacatgcacaacaggacccaatttctctaatttttttataaaggcccccaaaaactatggacaaagacaaagttttccaaggaaagacatgtgctgtaatggattatatcttgctaaaaattcgaggccttctaaaaaaaacaaaatcttgaacaacaaagacctcttccaatccctcctccctgtaggtcttgaacaactagccagaggccctgcttttgtaagaggttccctagatagatcaggatggatggagtgtatgctgttagatcaaaagaaatcatttgctacttgtatgcatggactaccttaactgtgagtcttaatcaagtaatggagactgacaggcttcttggcctataggggccctatagtaataaagtgtgcacttttctaaaaatggtattcataagagtcaagtgactggacaattactttgtttgattccacatcccaggctgaacaacctcctcttcccatattcttctgcgtctgatcctgatggagaagaataagccagcctgagctatgcttagatattttaaattttagtgaaaaataaaatatatgttttaaagcctggaatattatttgtgatttgggtctaaggtctaaaaaatatggacaagtgggaattcaaaaatcaccctaccagcactgcaaagaattcgtgagtattcaagctttaggagttgggtttgtgcattttccttttataactattgctagccatcccagaatgttgcactcagtaagaagggctaacagtgtcctgctggccctattcctatgtgtcatcttgcggcatttccagttaatggcatgactgtaatgactagcaatttaaataatagaggctgaagcagaggcagctataaggacacaatgcagaaattgccacagtttatcaacatcactggcacccagctcttcattacctccttgaatagggtcaaagtagttaaaatgatgctgtaaatacatgactaaaacaaagcagcggtttattcttgatttggcattgggtatttataacaaacaagttgcatttcccaggcatgggttattagacacgagaatgtaattgatattaaccaactttcaggctccagtaactttttccactgcatgtcagtttaattttttttaaagcataagcagcacatgccaaatggaaaacaagaggaagaacacaaaaaaccccttaagccttcagtactaagtgaaaaacaactaacccatttatcttatagaatccttcagagttttgctataaactcactcggaagagaatatcacagtcttctctttttgagagggtattcgagtgatttttagaaatgagacatctctaactgtaatcttgttttttgttcagaactaaaagagtatgcaagaatatctaaaaatacaaattgtgcacctactgcattacggcagaggttgaacactggtgacccatgagccaaatctgacccattgctctgtttcatttggaccatacagtaatggttgactttgtgttttaacattttaaaattattttcaacatttgtaaatcgagagatttcacagaaaatgctggaagctctgaccctaccggcaccacactcctacaagataacaaatggctggggctgagttgaggctgctcttatcctttgcctcaattgtatcactcctacagtctccttgtctctgaggcctaatgtcaattacctctcttcttcttaatagtattgttatttttcctaagtaatgatcaaagacaaatattcattttggtgagccttgatcataaatggggaaaataaagatgggttaagaggactgagtgttttagaaaatgaaaaggctgtaattccttatagaagtaaataatttcttacttaaccccctttaccccataacagaatcctcccagctggcatccaagagcattgagtgtgtgaacctttgtgaaaagcatcaagttaaacgttctgtgtaaaggataccagacacatggaaaagccaagctaggttcagtctcagacaaaagctgtcaagctgagaaagggaaaagaaagcactgcacttgtaagaaaaacaacaaatggcaagcacggaattgacggctagaaagaacaaagcaggtttcaatgttctaccaaaaaatgtcttagcccctggctaaactccttttgggaaaaataggcacaacaggaagatgccttcacttcccaaagtcatccagacattctcagtgggagcttctgcatcaaccttgtgtcgcatctggagctgcagaccctcactgcccattggtttaacaatctctctcctcctgcaagaagagggtggtggcaggggggagtactataagggatgtttgttttattaaaaagaataaacatacatgcacatacacacctacccagaaaatactatttcatggcatctacacttatagggaattcactcagaaacagctttttagtaacacaaagaattaaaatcattagcacccaacaagtcagaaatgatggaagattaggaagaccattgcatagaaacaaaattaaaaaaagataaaaccctttatagaaccagaaaaggtgaggagaacacaaacaatccttttcactgagattgagaacccagaaaaaccttttgatataactagggaaagttaagtagagtcaggaaaggaataagtgtgtattaatttcccactgtgtagaaagcactccatatacattttaatacattttgataataaataataaataatactttatatttttgttcatttatccattaaataagtattcgttcactgccttctatgtgtcagacatctctagggatataaacatttaaagacatggttttcctattaccaagttttgagtctaacaaggaactagacaaacactctaatgaaaataataatgattataaatacaaacagcaataatacaatagcttaataacagctgtcctttactgagtgcttccaatgtggtaagaattgtgttgagcactttacattattattcgtttaatccctcataagtgccctatgaccaagttactaatatcttcattttacagagaagggaagtaagctatagactaaatgattacctaaggttataaaggtagcagatgaaagatctgagatttaaacactacctgttctctgcacaccaggccaacagataatctgcgatatcaacccctaccagctacgatggaggcatgccaaaaacaagcgatgcagaggggagacccttaaacccttttgaatttgcaaagcacttccccatagagaaaataagcctccagaattcatcagccccaagaggtggtactggtagaaaatataatagtctttcataatagcttaggtcagggtgtgaaagacagagctataagggctggtaaaagaacgaaagctttccaatccagagacaaaaggaaaagtgagatccatccatgacatgtctcttgaggactcttttaggaccaagatggtgaatgctgaacggaccatgcatgcctcagtctgtcaaattgtatgtttctaaggacaaataggctacaaaactttcaccctatttttatatgggaagtctgttgaaaagaatacaatacataaaagatgaattacttattgagtctttaatatgtctctagcacagaaataaacatcttgtgtatattgtttctaatttccacaataccatgagctagaaatatacagaatagaagaacagtgggatcagagaggttaagtgatttatccaagaccacacaggtgttaagaggtagaggaatggtttgaacttgcaacaatgtgactccaaaatcaatacattttccttacactgaaatacaaagtatcaggccaaatctctctgcaaatattcatcctgtttcttttggttcttcattcatttaattaaaaacaagtttattatgcacatacaaggaacatagtattcatccttgtgcatctgacaagtaagtcaaggagacaggtgtgtaaatacctaaccaaacttacaggcaggatgaatgaggctaaatgtgtttattatttaaataaactccatgaagtcagatacttcagtttgttgatcattgccacatacctgaaacacaatcttgaaccaacaaacatttgtttgatggaaggataaatgaagaaaatcccacttaaggaagtacaaacttaaggtagaattaattctgcctaagataaatcaacgaaagcccccaagtgcagtgtcattgaattggacttggaagaatgtatgaagtatatactagtgagaaatgaagtgacaggagctatggctcagggtaaacacaggaatggaagcatagaagcccacaaaatatttgggtaatagagttcaagcatacttagagcacaggaaaggcgagaaattagagtgagaactaaagtcaaaaaggtaatttggcaccactttgcacaaagccttcaagtcaattattaaaaaaaacaaacaaacaaacaaacaaaaaaaaacagccatgccagtagaatgcagtaatctgacagcttttagcaaagtgggaatgtatcacccctacttcctccccactgatcttagaagaatcctaagtgtttacacctagtttgtaagatcccaagaaactctccagtggtctaattcccaccactcagctaagaactctcagctcaaaagatactggcatctggaaagcctttttcaaagtccctaagtctgagttccttacatcccacacttcacccatctcatagtgtgtttttcttatctctctccaccatcactggcttccatgtgagcaggcactatctttgttgattcctagcatgttgcaaacagcccggcacatagcaactactcaataaatatcctggaaataattattacattagtgaattgaatgattgatgcactgactgactgttgaagaaatagagtcaaggagagccataggaggctgccacaatagcccacggaaaacacctctttataaaggtccagatgtatttctttaagtaggcactttgctaactggggagagcggtggttagttaaagcagacagcaaagcagaaaaaggcagggccagcgggcagttgctggggagaccacaattccatgggactatagccattagcatgcaacactgggtaatctgattttcatgacagacagatttattatgacttctaaatatataaatcccaggttatgctttccagctaacctaacaacttgatatatgtgtctgacatcccgtcttaaaatcagattccagcttctaattaatttttattcacccatcgctctaacaagagaggcaggaagtctcagggggataaacaatagacagggtattagtcgttcctactctgtggcacattttccactgagtctctggagttttctttttctttgctaccaaaaaaggggggccttacccattctctctgtggcttctaggaagaacgagtggaaaacattacacaggcacccgatagtcattatttctattaagcaaccaatgcttcatccatcacttccacctccccattccctgctttcatctacccatgcagaaattggaatgacatcatggtctagtcagtttaaagactgatcattgcttatgtattactatacatcttgctttctccaataatattatcagcaaatagttcttgaagctgaattgcaagtgccacaatgacctgactttaaaccaataatagtgatcataaaggctaaaagtaccacctaccgctttttatataatctgaacaatattaataattcactcacattcagatactttattaacaatgaaaagtgatacagctgtacccaggaaaagttttgtaatccactgatttctttaatgagcattctatgaatctgtgttttttaaatataattttcatatatgaatacaatttaaagaacattttcttctatgtcctttttccaaaacatgaaagtcaatatgggtaccacagaccaggttagaaaaaaaaagatggtcacattcaactttttaagttttttaatatttagttctcactatgtgctagagattgttctcaaaatgttaaatgcattaaatcctcctcaaaactctatcaggtatcataatttatccttgtgacatgtttaaaaagttgtttgcagtcacaaaagctagcaagttgtacaactgagatttcaattgaggctgatggctgaggctttaccaccttggtcttaatatactgcctggagatttaattactaaataactaatagtataagtagccagttgtgtttgccaaacccataaagccaaactacacaatcatcttcactttgaggacactatagtgtttctggctttttgcaagcagatttaaaaaatttggataccagtctgtttacctgccataatatggaatataaactaggaggagaaacacattcagcaaagaactttgtttgatggacttcacgaatcaaaaaaaatgtcatttttctgttcataataaataaatagtaaaaataggataataccaaaaaatatgcaaaatcttctcctccctatttattacaagtatatactttctaaatctctagtgtctatgtaatttatttgatggtatgaaagatgtatttcacatgtacatgcacaggcacacatgcgtgtgcacacacacacatacacatgcaacctatgtataccagaattactctgtgctcaatttatcttcagttaagcactgaaaacaaaatagaaccaaaaaaatggattcataaagtgacaaaaagaagttcattcacttgcccttcaggtacataccatactcatatgaacaaacttatatattctccctacaaaatcacacttaaatatgtgatttaaagtattttttgctaagtatttttatttctttccccaaaattatttgtgaaaatggaacatgtcctatatatcaataaatgtcatttaaaataaataaatttttaaattaaaattatcatcaaactcttaaagtatttcattttttaaaaataaatttacactggaatagaagtcaaacaaacatttaaaagcacacagaaagcattcatattacaactaatctaaatggctgatttggtaagttttagagccttttaataaaaccatatttttactcaagtactatttagttagagctttatcaaaatacttaattacaaaataagatctaagatgttcaggtaaaactatgcacaatataatcaaatccttagcatgaagccattcaagttgtcatttagagatctgttttctgagcctactccagttttaaaatagtttcctcagtaacatcaaatctgcccttcctcccctttgccctcagaattattagagcataatgtaattcttttaccagccttaggaaaacactattggaatgcatgagccaaaatgcagagatgaaacggaactgaaaaaaaaagttttttaaaaatggaaaatcaattactatttttaataagtagaaatagcttttgtgctaagaaaagaaaaattgcccagagacaaaatagatgttcgatattatagtgcactaatgagtacatttacatgtaattttctgaaatttatgtccaagactaactgcaaatagaatttagtatcaataggagtttacaaaacccattcatttttcctctaatcatattgaatatttaaggtgcttgattagactcaattatttttctttcggtgccaaaaaagagccctgacagctttgaaagagatggattagtggggcatttcccaccaatggggaaacattcctggctcccacagcaggaaaaaaaaaaacaatgagaaagttcatgccaattcacatgcatgccactgaatgaaatctgcagagaactcagagaaggtcagcttgtcaaaggatcacggcaaaaagcggaagaggcagatacccaaacttagtaggactttgtggcctcccagctcacaagcctgcttcttcatttcaaggcggcctggagagaagcatctgacaaagatctatctcccactgcccagaaaagattaaaagaatatgggccctagcaaatctcctagtacttggaattgagaaatagaaagggaaatgtagctaatttgcagtagccctgcttccttgttcagatttcccgaagcataataaaatagagaggctgtgtctccagggttccacttccagctgtgccccacaacttggaaaaaacaagaagggacatgttacctactcacaccaacctgcctctcctgctgcccctcctgctgccattctttcaattcattctaagggaggttgtcagccctctctgaaatgctttaaaaagaagctatattcctaactggtcaaggagatttaggtgaattcctggctgaaagcagaatgaggaaaaaactgttccctcaaagtgcccaatctttgatgcattatgttctactgtctgctaaaaccatcatcgtagccttttaattaaattttcaaattctggtttgatggtccatgttaaactcaatttggtcaattcagggcaccatccacccagatattcctccctctgagacttctggtagaatccttccttgcctcttcctaatttccagtctctgcctctgtcatcatgtgacgttctcccctcatctgtctgtatcactgtgtcttttctcctcttctatgaggacaccattcacattgcattaaggttccatcttaactccagtatgacctcatcttaactaattacatctgtaatgacagtatttccaaataaggtcacattctgaggcaatgagagttcaaacttcaaatatctttttgggggcacacaagtaaacctattctgtgcagggcacacaattcgacctactaacactcccatattaaatcaatcaccaagtcgtgagcagacacctaatacctctcaaatctgtcaacttctttctatacccaccactaccctgaatcccatacaattgtctcacctgggtaattgtaacagcttcctttaggaagctcccctcatttttgcattgctccaatagattctccaaaaaaaaaaagtgcttattgaaatgtaactgatatagagaaaagtgcataaatcagaatgaatttttacagggcacacatacccacttaaacactacccaaatcaagaaatataatattatcatcatcctagaagcacatttcatatcccttcccaattaatttcctcctgctccagcccaaaggaaaccattatcctgacctctaacaacattgattagttttacatggtttgggattttatatgaatggtaacattcagcacatgcttttgtatctgtcttctgctgttagaatgatccttgctgttgcaactagaagtaattgattcattttctttactttataaatatttcattatgtgaatatacccttttacttattcattctaatgttgatgaccattcagattgagttccatttggaaaagctattaaaaataatggagctacgaacattctcacatttttagcgtatatctagtagaagtgaaaggtcacagggcctacaattgtttttcactaaatattgccagttttctaaagtaattatattaattttcaatcccacaccactgtatgatagttccagttgcttcatacccttgccaacacttagtattatcaatcttctttcattttagtcattcagatgagtgtccaatggtagctcattgtctctaataactaattatgataagagctttgtaatatgctgtgtagccatgtgactatcctcttttgtaaagggcttgttcaaattcattgcccttttttccaatgggctatttttctcccatccaagtactaatcaggcccatccctacttagctcccaagatcagacaagattggatgcattcagggtggtatggccgtagactacctctttttcttactgatgtgtagatgatatttatatgatctgaatactagtcctttgccagagatattgtaattatcatctcccattctgtggcttgccttttctctcagctagtgatgtctttagttcataaactttccattttgatgtactctaatatatttatcttttcattttttgctattgttttaaaaatagttttattgagatataactcacataccatccaattcaccaatcaagtgtatgtgactcaaagttttttagtatatccacagagttgtgtaacaatcactacaatccaattttagaacattctaatcaccccagaaagaaacgttggcccggcgcgttggctcacgcctataatcccagcactttgggaggccgaggcgggcggatcacgaggtcaggagatcgagaccatcctggctaccacggtgaaaccccgtctctactaaaaatacaaaaaattagccgggcgaagtggcgggcgcctgtagtcccagctactcgggaggctgaggcaggagaatggcgtgaacctgggaggaggagcttgcagtgagccgagatcgcgccactgcactccagcctgggcgacagcgagactccgtctcaaaaacaaaaagaaaaagaaaccttatacctactagctgccactccctattcctcccaacaccttcaccctcactaaactctaaccaaccactcatccactctctgtctttattgatttgccttttctgggtatttcttatcaatggaattatatgatatgtgttttttttattttgtttttgtgactggcttctttcactttgcatgatgttttcaaggttcatccatgttgcagcatatatgagtacttctctacttgtttgtctaataatattccattgtacggatataccacatttatttatccattcatcagttgatggtcatttgggttgtttccactttggggctattagatgaaatgatgcttggatagtgttttttcatgtcctgtttaagaaatatttggctatcccaaaatcatgaagacattctatgatgttatattctagatgctttattgatttagctctcacactcagatcagcaatccaactggaatttatttctgtttatgatgtgaggttcatttttccctgccctgatacccaaatgattcagcactatttaatgaaaagatcgccctttcttcattgctccacagtgtcatctttctcaaaattcaagtgtccctacatgagtggctctatttctgtacactccattctgttccattaatctattgctatttgcttatccttgtgcaataccacattatagtaattattgtagatttataatgaatttatgaagagctgatagatagtatatgtcctccaactttgttctgattccccttcagaattatcttgcctattctttgccttttgcataatggtgttttgattagaattgcatgaaatttagagatcaatttggagagaatagacctcttgaccctattgagtcaccaattcatggatatattgtgtcctttcatatattaggtcatctttaatttctttcagtaatattctgtacctttctctgtagaggtctaatacatcttttgttagatatattcctatgtttttaatatttcaagctattttaagtggtaactttttaaatacatttattgaggtaaaatttacatagcatgaaattcatctatttagatgtacagtttgatgagttttgaatacatttatatagttatacaaccatcacctctacatagttttagaacacttctatcaatccaaactgttacctcatgccctttgcagttaatccccactccccacaccaggcagcaactgatttgctttccatctctgtagttttgccctttctaaaaattgaatcatacactatagattcttttgtgtctggattctttcacttcacataatacttttgaagcatatccaggttatttcaggtatgggctgttcattcctttacaatgttgagtagtattcccttgtataaatatactaattattgcttacccatttaccaattgatagatacctagattgcttctataatagcttgggaccattacaaacaacattgctataaatgtagacatacatttcatttctccacaagttttcatttcaagaccttgaagtggaattgctaagtcttatggtaagtacatgtttaaccttttcaaaaagtgccaaattgttttccaaagtagctgtaccattcacattcctaatagctttatttaaaggttacagtttctccatatcttcaccagcacttcttattgccttttttactttagccatcctagtgggtataaattggtatttcaatgtggtatataataatatttcatactattcctctcctttaaatttgcattttcctggtgatgataagcatttttcatgtgattatttgccattaatgtatatgctttggtttgttttcttattaccgacataagaattctttatatattcttgatattaaatgctttatcagatatgatttgcaaatatctcatcccattctgtggtttgtctttttattttcttaatagtgtccttaaataactcacgttttaaaatgttatgaagttcaatttatcagtgtttttttcttttaggaaatcttgattttggtgttatatctaagaaatatttgactaatataaagtcataaaacctttcctgtatgttttcatctagaagttttatagttttaaagcttatattttggtctgtaatccattccaagttaactttgtatacagtacaggctaatttttggataaagacatgcaattgttccacctcaccttctttggaaaaacaatttgttcatagtttataaccctttttatatgttgctggattcattttaaatggtatctttttaaaatttcattttgtaattctttgttctggtacgtagaaatacaattgatgttttatactgactttgtatctagcatccttgctaaattcatttgttaaatttacataattatatgttctgcaaataaaagaattttattgtttcctttcaaatgctcatatcttttttttctgtctctctacattcaccaggacttccagtacaatgctgaacagcagtggtgagaacagtcacccttttctcagacctaatcttagggcaaggctctcaatgtttcacttaagtatgatatttgctgtagtttttaaaaaatatatagagagtctttattaaggatgtttacttatagtcctagtttgttaaaagttcttatcaggattagatgttgaattttatcatatggcttttctccttttctgttattacatcatttgatttttgaacattaccttaccactcatatctataataaatacaactttgtcatgacatatattgtttttctatattgttcagtctgctattgctttgtttaggatttttgcattcttgagacctccaaaatctcttccccatctctttagctgctgctttctattggacttttaagcttttcaggtctttgtcatttacaaatcaacaaatgcttcaaaaagaaaaagaatgagaatgttgaagtcacttcaatgcacctcctccctccagggttctgacccctcaagtcctggatgccttggtagcccttcaataccttcaaacaaatatcttctctttattttggctggcttttctagttattctcttggtggattattagctaccctatcattaccagaagcagaaattcatcctataactaaataaagtcatcatataaactaaatcatattattcttcctccttgaatttgctaatgtgctgataaaaactccatattctgtactatgtcctataagattctagtgatacagacatagcctttccctccatcatctcctaccactcactcccttgttcactcctctcccaccatatgtatctactttctgttcttctaatcccattgggttaattcccaaatcagtgcttttgcatttgttcttccctctccctggaacaccctgtccctgatcttcacatgcctgcctcacttttgtcaatccatctcagtttcaatgtcacctcttcaaagaggccttctcaagacaatttatctaatcttgtgtctctcctgcctgattccccacaaacaatattctatacatgaaagaaatgataatgaaattaagccaacagaaatagagtttgaactttccaaaagccacaatgttatctctatcccacttccacatccaacataaagagaacaacaaactaagaatatgtaacacctttggggaccacttttgtatattattatacagatcttaagagtatataatctttctctggagtgtgacaaacctaaatcaccgctacatcactttccagatgtataacttccagcaaggttctcagcctcaacttcctaaactataaaatggggataatggtagaatccattcgataatattgttgtaattataaaataaatgttattttgtatgcaaagtgcttaatacagtgctgagtcataaaaagtgttccataaacaagagctattgtgatgactgacaatgatgctcatgatgataatgatgacaaaaacaataaggctctggagcatctggtaaaatgctaagtaattcaatcaaacacacacagatgtacacacacacatacgcacaaaattacatgttgtaattcatttccaccaagtagatacagcctttatcacttgcattggtagatttggtagagacttcatttctttgatttctgtactaggtaagtttggtggcaagaaatataggccagccctagcaagtctattcaaaaataagaaaaatgaaaagaatactacagtatctcacaaaattgaaaggagaatgaaaacccaagctttgtgaagaaggaaatcaaggtagcttcagagaactgagaggccggatcttagagacctccctctagagcactgctatttgaatgactaaaataccattaataactactttttgctttcaattcaaaattcaaaattcttagaagagagaatctgattggcataatcagatacctagccctagatcactcatctctgccctcaagttaaaaagtcaaacattatggtctcagctgctgggagcccacctctgtggatcaggggacactgcccagaaaagagttttgttttagaactggaaggtcatcccaagaaatattactataatagaagggactctgtctaagatgggctctctctaaaagaagtcattttgttctactatttgcccatccagaatagcagtgaccaagttatgcaccattagctgcttgggagggagctaattacaaattaaatataattgaatcagtgagtctgctttcaagtcctctaaatagaataacaacatgctaccttgtacagccaatttagcaaatcgaagctgaatcccttgctttctatgaagataaagagcctttgtgaaatttttaaagtatagatgtaaacttcaaaaaattttgcaaggcaagtcatcaaaatctgggagaaaatatattggaaactgtgctccaacaggagccaatgaaggaaccttatgagggagtataaaatattaatattcaccaatgccaagaaaattttcatattatgcaggtatccaaaatgggactactatctttgatttcacaattcctttctacttctctaacacgaatttttagtgacccaaaatgctgggaagaactacaaaatacagtgaatgcattctacttgaacattatcttatgctgttgtacctaccaaaaagacaccatgaaaactgcaagtatggctgcgctggaaaaaaccgaaataagtagtcatctgtgaagtactgcaagtgtgggaaatggttgagagtcatggacattggggaatatcaacaaaagaggaagaaaaagaagattaggatggaggtagaaatgattcccatggaattactgacatcagtatatattcccttagcctattattacatcagtgtctcctactgggaatatttactgaaccagtggtactcagactttttttgagcagggaaaaaaatttattcaacatttggaaaactggcatagggcatccaaagtggggtgagaaggctcttgtgtcagactaccaggtccattcccagctcaatatatacatactgtggtaagatatccgtaacgtaaaatttactattttaaccatttttaagtgtacagttttgtggcattaagtacattcacaatgttgtggaacaactacctgtatctaggtctaaaacatttcatcacctccaagggaaatcctatacccattaagcatacattccccgattccttcttcctccagtgcctggcagctactcatctgctttcaatctctatggatttgcccattcaggcatttcatataaatggaatcttctaataggtgaccttttttgtaatggcttattgtacttagcatgtttttaatgctcatccatgttgtagcatgtatacttcagtaaaaaaaaattgaatacaattgtaaatatttgtttgaaacacataaaagaaatagttaaagggattgagcctatttacagaagacttgaactctggggcaaggagagatgaaaagggggactaggatagcagttgtcatttcaaagactcattgtgtgtaaagagactaagttttattctattcagccccaaattatccccccataaccaaagagtagaaactataagaagagagatttcaatttgacataagaaaaatctttcaacagtgttatccaaagacagaatagactgtttttataaataatgagttccacttatctgtaggtattcaagtataaatggaatattcccttcgcagaaatctttagagaagcaagcatcagataagattgatctgaatcagtggttcctaaaagccaatcaacaagcgcatgccaatacatgatgaagttttcattcactcgtggtgaaatgccaaaatcaaagaggtttttataaagctaaatatatatttaattattttaattccaagattatgcctttcatccttttagtatcaaaatagccccccaaaatagtgaatgatagttttcttcattcatgcccttttttggggcaaaacttcaaggtgacaaagtaaagtcagccctttgttttaggggggaaattgtaccagtctcaaagtgtgagaatcatttgaataggtgattcttaagacattttcaaaattccaagaacccatgtttatgaccaaggattgttatgaaagttgcttttgttgttcattttatccatatttcaactgtgtatgcaaggagtggagcacctcccaagaggattttccccaaggcttctgcctttgtagggatggtctgaaatgatatagaatttgaacggatttctagtctcacagggatttatattacatgaaaaaagagagagctttgctttagagatgtttatccaaattcaccacggagtcaatgggccaaattccaaatgccatgggcctcccagtgggtgtcaattttactgggcggctgtgtttgggagaaaaagtacatatgcatgtgtggctgtgaatgtgtgtgtgtagagataaagagagaaggatatgaacaaatagatagaggcatcaacaatcacaagagggaaagggatgatatatgtttagaattatatctaaggactgtctaaagataaacaaaaataacgtttttccccttttttgtcacccttgttaaaatcaataggaaaaatttgaaggtaccaagttattttattgtcaggcaccaaaagagtaaaaattgatgacatcactccatacaaaacccccagagctttctgattctgctgtttatgctttctcctgcaacatctccatttggatcctgctggaaacacttttctttctgtcactcacaatctgtcaagacagcattatcttctgtggtttaaaaacagaaactccatttaacttcgtggttgataaagacatctcgttcacatcccttaactaacaataattattctaatttaccacataaagacaagaaaaaatatgcacttaacattttgcagctggttttgtatcaaggaacacatggaagagaaatggtcccactcttgcgataaaaaaataaggtattaagtaaaaaatagacctaacatgaatgtatgcttttggtacatcctccctacatgccaatcagtgaagcaattaggagtttgggctctcaaaacatacttggattccaatcctggatttgcctcttattaatctaagaaggcaagacacgtaaccttcctaagtcttcttcatctgtaaaatgggagcatatatcaatatctacctcataagattaaattagataatcaatctatgtcagctgctgttactattgttgtcctcctcctactcgtcctcatcatcaccactattaacatcaaatcaacgtattagttaaggttctttggggtcaagcaacgcagatcatcctgcctaacgttagcaaaatagaaaagagatctactgcaagtatacagaatagtgcctaaaaatcaaagtaaaactaaatgaagcttagaaccaacaggaggctgggggcagtggttcacacctgtaatcttagcactttgggaggccgaggcagagggatcacttgagcccaggagtttgagacgagcctggacaccatggcaaaacccagtctctacaaaaatttagctgggcgtagtggcacccacctgtagtcccagttactagggaggttgagatgggagaattgtttgagtctgggaggttgaggctacagtgacccatgatcatgccactgtgctccagcctgggcaacagagagaccttgtctaaaaaaaaaaaaaaaaaaaaaaaaaaagaagcaacaggagtcaggctcccaggaattcatggtcagttagttcttcaggctactatcagcaggaagaatcagcaacaaccattttccatccttgggtcaatgtactcaagattcagaatctctgaaaaaaaaagagtggtggggtgggggtaggggggtggggtttgggacttgggcactgccttggtcacatgaccactgcttggcctggggaaggcaaggtgtttgacagctccaataatactgtgtttggtggagaaggctattccccaagggaaaaatctactttataactcaaagaagaggagtacagatactgagcaggtacatataccaagaactatttttcttacaccattacatcccaacgacccactacgtcaagctcaattaagcctgcaccctcttctccatcatccttcctatttggtaattactcttttaatacatgtttttaattttgaagttgttgttaaaactcaatttgagaaaagcaaaaaggccccagagctctaaagtatatatgtcccttaaaaatatatatatatatatactgcttgctgacaataaattattttgttaaaaaacttccgtattagaatttccagaaaatttattgtctttatgttcaagttatttagtagtaatctgtgctattaagaagcacataaagcacccattgaaaaagttatctgaagatgatttagagaaatagtttgttctcttagaaagaaatctcttttatgttttaagttcaataagatgatatttatgctcataaattagggtcaaaggcaacattttgttttggtaatttttttgtggatgatgatgttttagtgagaaaggattgacaataaaagcaagaatgtaagaataataaaaataaataataacgaaatacatgacctacaatttcattaaaattttcttccagcttactagctgaacaaatcccaaacaatgaaaatatacagagtctgattaatttgaagccctaaacaactctgtagctcagtgaaaacatttctcataaagcccagggccctgagggcacacagagctaagacaaatcccagtgtggtccacccttagcagctgtgtgactctaagcaacttactaatctgccaaaatacccaggtctcgcctcatctgtaaatgaagtaaacaacgtggtgggatgttttgaggacttgatataatgcatggaagggtcttgacactttttctggcaaacaatgagcacacaacgataaacgtttataattctatgtatggagagagagagagagagactgagaaagcatacaaaagagcaagaaagcagtagttctcaacagggagtgatttttgctcaccagaggacatttggcaaggtctggagacatctgtgattgtcaaaacctggagggtagagggtgcttctggcatccagtgggtagaggccaggcatgctgcttacagggaagctcttacaatacagatgacaagcccccacaacagaattatccaagccaaaatgccaataatgccaaggttgagaaacagaaagagattgagaaagagaaagcaatgtgatgtaatgcagaacctgtaacagatttggaaggaaaggtacattcaaagccgggataggaaagtagatcagagcagatttgaaattagattgacaggcatctgccacatgtaagctattgaggaagtgctctgagcctgaggattctcatttgaacaacgggcataatatgtaacatcacctacctcaaaaagttgttagcaggcatgatattcacccctgaccaaatcattacagatgcccactgcgtataaccagtaggacttcaccagtgtgtatacccactgtcaaccctaagagttaggtacacgtaataaataaatggttactagtcttgttatatattagaccaacagccaggtttgaagtttgactctgctacactggaaatacttgaaagggtttgttaatatcagcaagaattagtgccctcataaggaagtaaacagcaactagactccaagttcaaatgagttttccctgtaggttaggtgtcctcaacttgggatccttaaaacctctgaaattaaaaagaaaaaattacacatatgcacatatatacatgtatgaatgcaaccaagtgtgtgtgtgtgtgtgtgtgtatttttctctgaagaggggtccaaaaatggtgacgcatcactgggttagaggtatacagttttcaatataaagtaataaccaggatgcagtagagtttctgaagatatcattgtaatgtgaaggagacagtatttggaaatagttatgaactcagatctgggagtttgaattctgcctctgccacttactgtctgtgcaaccttgcataactgacagaacaataacttctttgcatctcacatgcaaaggtggaatgctcataatatccacctaagaagaatcttagagcaataaaattagacaattcccatatggtattcagcacagtactcaacacatagtatagaagtccctggttatccgcaggacagatgcttcaagatccccagtggatgcctgaaaccaaacagtactatgtttctcctacacatgcatacctatgaaaaagtttaatttataaattaggcagagtaagatattgacaatgatagctaatgataaaatagagcaattataacactatgccagcattactactcttgtgctggggccattattaagtaaaacaagggttccttgaacacaagcaccatgataccatgacagttgatctgataactgagataatgattaagtgatgaatggacagggagcatctacagtgcatatgctggacaaagggatgattcacttcctcacaatggagcgagacagcatgagattccatcatgctacttaggacggtgtgcaatttaaaatttatacattgtttatttctggaattttatagttaatatttttggaccacagttgaccatggttaactgaaaccacagaaagcaaaaccgtgaataaggggagaccactgtatgtgaggactaagaattagatactgcaatggaagtatttgcaaagactattatattcagatggtggtgaaggtttgagccttctctaactacgtatggcacacactatcagaaaaatggcagggattcatcaattaatctatccatttactactagttcagccagaggatccactaattctgagacatgccttgtataataatatctatacaatgttgaaaagtggacagaagtagctgtgaatctggtcacaaaacctctttttatacaagaaagcctcattcaaactttctcctctgacacatttcccagggccccctctgggatttccacaaacatgatgttgtgcttgactgtgcattactatggaacaattctaagcctgtctcacctacatataagatacagactccgcaagggccttttcaatctccttcattcctctcagaacctgtgcaaacaggattttatgcacaggtaacccaaataaagcagggttgccttgagacttgcatctgcccaataacatatccacgaagaatgactctgtaggcatttgccagtgcattgcacagcagcacagcctaaaattcttcctcacccatccattgccccaaccttaaagcatctgttttaaaaaaaaaaattcatctttccctatctctcattctaacctatccccacccaggatgccctcagtgccattctgctttttcgctgccaccacatttactgtgctcatgacacctgtcccctctcttcagggtatcactcctgcaaggcagagagcctggcctgaatacctttcttctggaagcagccctctagaattctgggtaacagatttgctatcttgttctatagagaagttcattacaagaaatgcctccattcctggctcaacgctcacttaaccttcttctagaggccacaggcagatgatcttccaagtttctcttaccctagaatagtagtgaagaaaaaaggacctcatctgcactctacctgacttgcagggcaaagtcagtattaatcagaggtgccctttttgctactgacagacaaagtagatgcactcataaccaagagcttttcaccaaaccctcagggctttaaatctttctcaaacaaactgcaatttgcaaagaaacaccctaaatgatgctgtgcaaggaagttacagcaggcacagaaggatggagtaacatttcaccatctgcttgtgataataataatgcctctaccttgcaaagtgtctaattgattgtgtgacacaggcacaaagttcctgccacaatttcaccaacaaaagttattcctaaattgtaccctcacagagggagagtgctaaggtcagtggtcctaaggaccaattttgagcatatgaactttctggtggcagaatgataagagtcctgggacacagttaggcaagattgaaccaactcaccctataatagttgtttcaagcaatgtccagccggggacacagagaacagagaggtaggggatggatctagggcagtgttttccacttgtggaatggaaaatgccttaaggtaatatggatgaacaactgtctgggtttcctgtggaggaagcctgggctgctttactctctagggtgttgagccagaaggctttattctggtacagccacctcattgatagtgaggtagcaatgcctgacaaaagtagatgttcatgctttgtgctagaagagcatagacttagccagatgccatctttttctaaattggcagcactcaggcctcaactgaaggggttgggaaaagtgagctggaaaaaagaggccgggagcggcagctcacacctgtaatcccagcactttgggaggccaaggcaggtgcaacacctgaggtcaggagttcaagaccagcctggccaacatggtgaaaccccgtctctactacaaaaattacagccagctacgccgaaggctgaggcaggagaatcgatcaaacctgggagggggaggctgctgtgaactgagattgcaccaatgcacttcagcctaggcaacagagtgagactcaatctcaaaaaaaaaaaaaaaaaaaaagacgggggcgattccaagatggccgaataggaacagctccagtctgtacctcccagcgtgagcgatgcagaagatggatgatttctgcatttccaactgaggtatcgggttcatctcactggggcatgtcagacagtgggtgcaggacagtgggtgcagtccactgagcgagagccgaagcagggcaaggcatcgcctcacccgggaagcgcaaacatgtaccacatgttctttatccagtctatcattgatggacatttagattgattccatgtctttgctattgtaaatactgctgcaatgaatatacacatgcatgtgtctttataatagaatgatttatattcctttgggtatataaatacccagtaatgggattgctgggttgaatggtagttctgcttttaggtctttaaggaatcgtcacactgtcttccacaatggttgaactaatttacactcccaccaacagtgcataagcattcctttttttccacaccctgaccagcatctgctactttttgactttttaataatagccattttgactggtgtgagactgtatctcattgtggttttgatttgcatttctctaatgatcagtgatgttgagcttttttttcagatttttgttggccacatgtatgtcttcttttgaaaagtgtttgttcatgtcctttgcccactttttaatggggttgtttttctcttgtaaatttgtttaagttccttatatatgctggatattagatctttgttagatgcatagtttgcaaaaattttctcccattctgtaggttgtctattcactctgttggtagtttcctttactgtgcagaagctccttagtttaattagatctcatttgtcaatttttgcttttgttgcaattacttttagcatgtttgtcattaaatctttgcctgttcctatgtccttaatggtattgcctagttgatttccagggtttttatagtttggggttttacatttaagtctttaagctatctcgagttaatttttgtatatgatataaggaaggggttcagttttaatcttctgcatatggctagcagcttaacccagtaccatttattgaatagggaatcctttccccattgcttgtttttgtcaggtttatcgaagatcagatggttgtaggtgtacagccttatttctgggttctctaatctgttccattgggctatgtgtttgtctttgtaccagagccatgctgttttggtcactgtagcctcgtagtacagtttgaaattgggtagcatgatgcctccagttttgttcttttagcttgggattgccttggctcttgggctcttttctgcttccatatgaattttaaaatagtttgtttctagttccgtgaagaatctcaatggtagattaataggaataacactgaatttctataaactgttaagggccatatggccatttgcatgatatttattcttcctatccatgagcatggaatgtttttccatttgtctgtgtcatctctgatttctttgagcagaattttgtagttccccttgtggagatctttcacctccctagtttgctggattcctaggtattttattcttctgtggcaattatgaatgtgactatgttactgatttggctctcggcttgactattgttggtatataggaatgtttgtgatttttgcacatggattttgcatcctgagactttgctgaagttgtttataagcttaagaagcttttaggctgagacgatggggttttctagatataagattatgtcacctgcatttgaatgcactttatttctttatcttgcctgattgccctggccaggacttctaacactatgttgaatggatgtggtgagagagggcatcgttgtcttatgctgattttcagtgggaatgcttccagctttgcccatttagtatgatgttggctgtctgtttgccataggtggctcttattattttgaggtatgttcctccaataaggagtttagtgagagttttttaacataaatgggtattaaattttatcaaaagccttttctacatctattgagataatcatgcagtttttgtctttagttatgtttatgtgatgaataacatttatggatttgcatatgttgaactaactttgcatcccagggataaaggttacttaatcacagggagtaagctttttgatgtgttgctggattcggtttgctagcattaggtcaaagatttttgcatcaatattcatcaaggatattggcctgcagtttttttttgttgtatctctgtcaggttttgatatcaggatgctgctggcctcatagaatgagttagggaggagtccctcctcaattttttggaatagcttcagcaggaatgctaccagctcttctctgtacatctggtaaaatttagctgtgaatccatctggtcctgggctttttttggttggtaggctatttattattgtctaaatttcagagctccctattggtctgttctaggtttcagtttcttcctgattcagtcttgggtgggtgaacgtgtctaggaatttattcatttcttctagattttctagcttatctgcatagaggtgtttataatatactctgatagttatttgtatttcggtggggtcagtgataatatcctccttgtgatttctgattgtgcttatttgaatcttctctcttttcttctttattagtctagctagtggtctattttattattaataattctttcaaaaaacagctctggattccttgatctttttttatccaagtaattgaacaattctacaagtattaaattttacaccaggaatgtatgaaggttcccgaatccttgctgatgcttgttattgttgtctggtttagtgggtgtgaagtggtgtcatattgtggttttgatttctatttccctaatgacagataacgctgagcatcttttcttttttttattatattttaagttctagggtacatgtgcacaatgtgcaggtttgatacataggtatacatgtgccatgttggtttgctgcacccatcaactcatcatgtacattaggtatttctcctaatgctatccctctcccagccccacaccccccgacaggacccagtgtgtgatgttccctgccctgtgtccaaatgatctcattgttcaattcccacctatgagtgagaacatgcggtgtccggttttctgtccttgtaatagtttgctgagaatgacggtttccagcttcatccatgtccctacaaaggacatgaaattatccttttttatggctgcatagtattccatggtgtatatgtgccacattttccttatccagtctatcattgatgggcatttgggttggttcgaagtctttgctattgtgaatagtgctgcaatacacatacatgtgcatatgtctttatagtagcatgatttataatcctttgggtatatacccagtaatgggattgctgggtcaaatggtaattctagttctagataattgaggaattgccacactgtcttccacattggttgaactaatttacactcccaccaatagtgtaaaagcatttctatttctccacatcctttccagcatctgttgttcctgactttttaataattgccattctaactggcataagatcgtatctcatcgtggttttgatttgcatttttctaacgaccagtgatgatgagcattttttcatgtgtctgctgactgcatagatgtcttcttttgagaagtgtctgttcatatcctttgcccactttttgatgggtttgtttggcttttcctgtaaatttgtttgagttctttgtagattctggatattagccctttgtcagatgaatagattgcaaaaaatttcccccattctacaggttgctggtttactctgaaggtagtttcttttgctgtgcagaagcactttagtttaattagatcgcatttgtcagttttggcttttgttgccattgcttttggtgttttagtcatgaaactctttgcccatgcctatgacctgaatactatcgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgattttgtcaggtgtgtcaaagatcagatggttgtagatgtgtggtgttatttctggggctctgttctattccgttggtctatctctctgttttggtgccagtaccgtgatgttttggttactgcagtcttgtagtatagtttgaagtcaggtagcaggatgcctccagctttgttcttttgcttaggattgtcttggcaatgcaggctcttttttggttccatatgaactttagttttttccaattctatgaagaaagtcactggtagcttgatggggatggcattgaatctataaattactttgggcaggatgggcattttaatggtattgattcttcctatccatgagcatggaatattcttccatttgtttgtgtcctcttttattttgttgagcagtggttggtagttctccttgaagaggtaattcacatcccttgtaagttggattcctaggtattttattctcttcatagcaattgtgaatgggagttcacttatgatttagctctctgtttgtctgataatggtgtgtaggaatgcttgtgatttttgcgcattgattttctatcctgagactttgctgaagttgcttatcagcttaaggagattttgagctgagacaatggggttttctaaacatacaatcatgtcatctgcaaacagggacaactggacttcctcatttcctaatcaaataccctttatttctttatcttgccttattgccctggccagaacttccaacactatattgaataggagtggtgagagagggcatccttgtcttgtgccagttttcaaagggaatgcttccagtttttatccattcagtatgatattggctgcgggtttgtcataaatagttcttattattttgagatacgttccattaatacctagtttattcagagtttttagcatgaagggctgttgaattttgtcaaagaccttttctgcatctactgagataatcatgtggtttttgtctttggttctgtttatgtgatggattacgtttattgatttgcgtatgttgaaccagccttacatcctagggtgaagccgacttgatcatggtggataggctttttgatgtgttgatggatttggtttgccagtattttattgaggatttctgcatcgatgttcattagggatattggtctaaaattctctttttttgttgtgtctcttccaggctttggtatcaggatgatgttggcctcataaaatgagttagggaggattccctctttttctattgaatggaatagttgcagaaggaatggtaccagctcctctttgtatctctggtagaatttggctgtgaatctttctagtcctggacttttttggttggtaggctattcattattgccttaatttcagagcctgttattggtgtatttggagattcaactttttcctggtttagtcttgggagggtgtatgtgtccaggaatttatccatttcttctagattttctagtttatttgcatagaggtgtttatagtactctctgatggtagtttgtatttctgtgggatcagtggtgatatcccctttatcattttttattgcatctatttgattctcctctcttttcttctttattagtcttgctagtggtctatcaattttgttgatcttttcaaaaaaccagctcctggattcattgattttttgaagggctttttgtgtctctatctctttcagttctgctctgatcttcgttatttcttgccttctgccagcttttgaatgtgtttgctcttgcttctctagttcttttaattgtgatgttagagtgtcaattttatatctttcctgctttgtgttgtgggcatttagtgctataaatttcactctacacactgctttaaatgtgtcccagagattctgctacattgtgtctttgttctcattggtttcaaagaacatctttatttctgccttcatttcattatttacccagtagtcattcaggagctggttgttcagtttccatgtggttgtgcggctttcagtgagtttcttaatcctgagttctaatttgattgcactgtggtctgagagacagtttgctgtgattccttttcttttacctttgctgaggagtgctttacttccaactttgtggtcaattttagaatacatgcaatgtggtgctgagaagaatgtatattctgttgatttggagtggagagttctgtagatgtctattaggtctgcttgttgcagagctgagttcaggtcctggatatccttgttaaccttccatctcattgatctgtctaatattgacagtggggtgttaaagtctcccagtcttattgtgtgggagtctatgtctctttgtaggtctctgaggacttgctttatgaatctgggtgctcctgtattgggtgcatatatatttaggagagttagctcttcttgttgaattgattcctttgccattatgtaatggctttctttgtctcttttgatctttgttggtttaaagtctgttttatcagagactaggatttcaacccctgcttttttttcttttttttttttctttccatttgtttggtagatcttcctccatccctttattttaagcctatgtgtgtctttgcacatgagatgggtctcctgaatacagcacactgatgagtcttggctctttatccaattttcccgtctgtgtcttttaattggggcatttagtccatttacatttaaggttagtattgataattgtggatttgatcctgtcatcatgatgttagctggttattttgcagacttgtttatgtggttgttttatagtgtcactggtctgtatacttcaccatgtttttgtagtggctggtagccatccattcttcccgtatttagtgcttccttcaggagatcttgtaaggcaggtctgctggtagtgaattctctcagcatttgcttgtctgaaaaggatcttatttctccttcgtttatgaagcttagtttggctggatatgaaattctggattagaatttcttttctttaaaactgttgaacattggcccccagtctcttctggcttgtagggtttctgctaagaggtctgctgttactctgatgaacttccctttgtaggtgagctgacctttctctctagctgcctttaacattttttctgtcatttcaaccatggagaatctgacgattatgtgttttggggatgatcttcttgtgaagtatcttactggggttctctgtatttcctaaatttcaatgttggcctgtctagctaagttggggacattctcatgaatgatatcctgaaatatgttttccaaattggttccattctccccatctctttcagagataccaaagaatcacagatttggtctcttcacataatcccatatttctcagaggttttgttcattctttctcattcttttttctctattatctgactgtcttgtttcagaaagccagtcttcaaactctgaaattgtttcctctgcttggtctattctactattaatacttgtgattgcattatgaaattactatagtgtatttttcagctctatgaggtcaattacattcttttctatattgactattttttctgtcacctactgaattgttttatcatgatttttagcttccttgtattgagtttcaatgtactcctgtagctcaatgattttcattcctatccgtattttgaactctgtttctgttatttcagccatctcaacctggttcagaacccttactggagaagtgatgtgattgtctggagaaaagaaggcactctggttttttgagttttcaggattcttgtgctgattctctctcatctttgtgggcttatctacctttaatctttgaggttgctgacctttggatgctttttttttcttttaacctctttgatgaccttgagggtttcattgtggtacaagatggatttgccccactggcttcgtttctggaaaattttagggggccaacactcagcttccaactcatggactgtgtgctgtaactctggggtacttgtattgttttaattttaaaacaggaaatggcattgctttattttcactaagtctattattactttctatttatggtcagtaatgctgctcttacattcatggtgagagtctgcaaattctgtttgatatgtgaatataagtaaataaaagtgagtgacttttttaaattaaaataataataataaaaaaaaagtggtctgcatatttggcccaaagcaaaaaagtctgggatcaactctccctgaaccccagctcttcccatcccaaccacctatttttcctcaaaagcctggatttgggtgtgaaggtttttagattctcctttcttctttacccttatactcacttgggatccttcacaaccagcctatcaacataatttgggaaaagttatttgtgcagaaaaggtctggttctttcctactggagaattgcagaataaacaaaacaaatgaatcaattcaaagacgctttcagcctccagcaactgttgcatttttacaatggtaaaaggcagccaaacctctcatttgcccagaagttctttctttttccaatggttttaaatggctctaaagagaatgatccaacttagcagataaaaggccaagcctcctgtatagagaggtcttaatgttttcttttcagctttggaaccccctgattattagcattgtatccttggacaagtcactgagagcctgaatttctacacttgacaaacaaggacctacttcacaagggagataatgagcatcaggcacttagttgagggtcaggcacatataagggctttaaagagctattacaattattattattttgtttgtttgttttaatatatgtatacattgtgaaatgattgccacaatcaaattaattatcatgtccattactgcccagttatgatttgtgtgtgtggtgagaacacttaagatctattctcttagcaatttcaagtgtacaatgcattattattattaactgtagttaccatgctataaaatagatctccagaacttcctccgctctaattaaaactgtatgttttaccagcatctccctattcccccacctcctcccagcccttggcaacaaccatcattctactctctgcttctatgagcttggcttttttaattaattaattttttaatagacaaataaaaattgtatatatttatcaggtacaacatattttaaaatatgtatgcattgttaaatggctacattgagtgaattaacatatgcattcatcacatctttttgtttgtttgtttgtttgttttttgagatggagtctcgctctgtcgcccaggctggagtgaagtggcgcatgtcagctcactgcaacctccacctcctgggtccaagtgattcttctgcctcagccttctgaatagctgggactaccggcatgagccaccacgcctggctaatttttgtatttttagtagagatagggtttcatcatatcggacaggctggtctcaaactcctgaccttgtgatctgcccacctcggcctcccaaagtgctgggattacaggcatgaaccaccatgcctggcccatcacatcattttttatagtgagaacacttaaaatttattctgtagtgcttttcaagaaaataatacatggttattaaccatagtcattatgttgtacaatagatctctttaattcattcctcccataactgaaattttgtatcctttgaccaacaattctccaactgcccaccctccgcgccaactcctggtaaccaccattttattctctgcctctatgagtttgactgtttaaaatttcgcatgtaagtgagatcatgcagtatttgtctttctgtgcctggcttatttcacttagtataatgtcctccagtttcaccagtttgtctccaataacaggattcccttcttttattaaggctgaataattttccagggtgtatgtatatcacattttctttatccatcatatattgatggacacttaggttgattctgaatcttagctattatgaataatgctacaataaacatgggagtgcagatatccttagaagacttattttatttcctttggataactacacactagtgggattctggaatcatatggtggttctaattttttgaggaagttcatactgttttctataatggctgtactaatgtacattctcaccaacagtgtacatgggttgctttttctctacagctcagcaacacttattatcttttgtctttctgataatagcctgataaagaaaaacttcagccaaattaaatttaaaggagtttaattgagcaatgaacagtttgtgaatcgggcagccttctgagccagagcaggctcagagactccagtgcagctgcgtggtagaagaagatttatggacagaaaaaggaaagtgatgtacagaaaatggaagtaaaatacagaaacagctggattggttgcagctgggcgcttgccttatttgaacagagttcaaacagttggctacatttgattggccaaaagtcagtgattggcacaagggtaggctatggtttgtttatacctccgcttgttatagttcacgatgtacggaaaaacctttaggctgaacttaaaatatgtaaggaggcagcttaggctaaacttgatctaacaaaccattctaacaagtgtgaggtgacattttattgtgacttgaatttatagtcccctgataattagggatattaagcatttttttcatatacttggccattcatatctcttcttttgagaaatctcttattattatcatcttcattatcactctaattattaataatgttcactaacccatacagctacagtgatttttgttacaacaggagctttctgctttcaaaaaaaagtgctgctaccttaagtaatcatttatcctaactctaggctgcaacttactattattattattcattcaacattcactcaacacttacttcctagagccactgtttgggcactggggaaatagcactgaacaacacagagcaaagtctttgccctgtggctcacattctggtgaagcagagaaacagtacacataataaatgaatgttaattacagtatgtttggcagtgatgaatgctagagaaaaaatagcctatgacctggcaaaggcattacccattaaggtaaaggacctatctcctagagcacttgagttttgtatcacataattcatcaaggcctttagatattacagtctgatctttgggccagtggtctccctgtgtcacaaggcaagcgggcctcaagaaagtaaaaaaggaaaatatttcctctatttgctattgccaaaacttcctccaagagggaaaggataggacaaaaagtattttgtgtgggtgtggcagccatagctaggctatcaaatactatgcacatatgatatgccactctcagtccctataatggcagatatgattaaggtttcctctttcctgctgagcccagaaccagcttcacaaactttttcagcacagttctctgggcaagcaactttagtgattaaagttagcctaaaagactaaatctatgtgccatcatagagtgcaaagttaggtttaaatgtaaatatatctagcaaaggtatcatactgacttaaaatcacactaagtcctaaatgactggtcttcttccaagtgaacattttattggaggtagggaatggctaagaagaaatgctgttaagtgtatagaggggaggggcagaaggcatgtatgaagaaaaggacaggttttataatcccacccacatttgtatctgaacatgtgtgtatggcaaacacacctgatagcaataacttaagcataccctaagaataaccctgtatggcagatgcacttgaatgtggttaggtgtcccaagctaagaatccaagaatggccaacccagagagttgttcctaatctataaggaacatctgagcccctggcctgtccaatggaacatggctgtatagggaatcaaggccctttgtttggggttaagtgaaggttgccaggtagagactgtcacagggagagtgctaagtaaatatgccatataaactgcatgttttttgcaagttgcctggttctcctgtccagcccactgccactggactctctcccctgtatgtaagcccccagtaaaagcccatgtcacgtttcctgtctctgggtctcttcttcagcctcttgaacctggtgccatccccactgaagttgataggtgttcagcacaacagtgtcattaggaatttctacaatgtcataagcaatgtcataaggcatttctacacactctcacttgaaggaaccacctccattagtgtaccttagtctttcacacaaacacatacctgagcccacaaataaagtgctcaaaaatagtggctctcttcttctagttgttcaggccaaacaccttggagtccaccaccaaatccttttaggacaaccttcaaaagattaacagccacttcttgccatccaaccataccatccatgataatccaaccatttcttgccagctctaccctgacctccaaaatcaagccaccaccaagtcttggcaagaagggctacaataattccccaacagtctcagcttctgcctgtgatcctggactgtctatctctacttaggagcctgctaaaacctaagtcaggtaacatccctcctctggccaaaaacctctagtaccttcctatctcacccagagtaaagtcccacaaggtccctcacgctcttgttcccaactgtctctcaggccgcttttctcttgccctgctttgtactcttccttccagcccacaggcctccatgctttcctcaaacaggcctgctatgtttccatcccaagaccttttcccttgctgctgcctttgcctgggagacttttactccaaggtgccatatggcttcttccttactccagtcacatcttcaatgtggccatgagaggccctgctagatcacttgatctaaggcagcacacaagccagcccccacctccaccctctccctctaattctccttaccttgtttgataattcctcatggcatttatcactttctaacccaatatccttccttcctttcctccctccattccttttttccttcttttcgtcactatctgtcttccaatagaaaataagctccatttgcataggggcatggtctgttctactcattcttctgcctagaataggatctggcccagagcaggctgaccaactctttactaaaaactcatccgtcactgagaactagcaccacaccacagaaggaagaaggctctgcatctacaaaatacagctgctttgtttgagtgctttgagctctgtctcctgtaactgggtgacaaaggtctaaacacataatgatagtgctggtgtgatagaaagtgaaagttctttactcttgaaaaaaagctagattttatcaagtgctggatttgctcagtggcatttaggttttaccgctataaaacaatattcctatttcttaagttcttgctaggaaaacaagtaactttgatttttcagtctgaaactctccagcgccccttaactatggcccccgaaacaaacattttatactgaatttttgataacacacaatttattaaaatgcagctattacattagtgcagaataagctatatacattctaagatttagcatgctgtcaaaaggtttcctcattggaactgatagctacccctaaagcagagatggtcttgagcatatcatttacccactttaagcctcggtgcctttaatctgtaaaatgaatggctacaccaggctctctctagcatttattccaaatgatacattcaggcaggcaggcatgggatccagtggaaaagacttgggatttggagcttgagatctggctctgtcacttacaagccacactgaatctcattttttttcatctataaaacattaatcactggaaataactaccttgtctataccaccttttggtatcttaggacatacatttggaggatcaccaagacagggctgtgaggacatctatttggtttcccaggatgagcagagtacctgacacatcacaggcactcacgtgcatttgctgcgtggaggaaagaatatatggacaaataaaaaaacacttccacacctccccagctgttgtaaggacttactaaagcaatgcatgttgaaagagctttttaaattctaaagtaatacaaatgataataattactgtgatagatctatttcacatttgcccagttcagccttggttgtcatactaatttaataccaacatgactggaactggaaagaaactaatattgattgaggtcttactatatcctaagcagatacatatgtacgtatgtgcacgtatataatttgagtcttctacctttttaaccaggtgggtgtcttaatgtagttataagttctagccagcagaagtcagaaactgagtcaaaactgaactcacaaatcagtcaacagttacttagcactcagtacttgccagcctctatgcgtggtgctttgcaggcatgggcacattcagtttttcaacagcctttgaggtaaccacagatacccctttttatagatcaggaaacacagactcagagcagttaagtaacttgcttcaagttaacagctaggaggtggcggggccaaaatttcactgtctgacttcaaagtccatgcccttaagcagtatatattatgcagtacattcatgtaagcttatcactgaaggtatgcggaataattcgggtgcttttatttttgttcaataaaaagctgctttagcactctatcaccactgccttaatttttttttttttttctaaaatgaaaatctgtgcctgggaatatgggtataactaaaaatgggacaggagaccacccccagaaagacaggcggccccagtttcaagttcttatttctcacattggcccttctggtgtgtcccagctgtattgtcataacctatagggaagttccgcagtcaggaaggccaatgacaatatatttcccctgacaacaccctggtccctttctgagttattcaatgacaattgaaatgtcttttcaatattttcttttccttttcagggcaaacatgtccacttgagtcattatgatcatcagctgttctgatttgcaagcagttcctaattgagtaggactagtgaatgctgtgagatatgaaatatcttgctgctaaattgcacacaggctgaaggcaataagaatttgtttagctatgcatagcgctttatattcagggaccagtggttatggagacactaaaaccagtcatcattaggacaatcctatcttggctaccagagaatgaagatccccacacagagctacctgaacagactaacggtcaagaggctgatgaggcattaatgagaccatgaatcaaaatttaccaaacaaacagtgcctccaaggcttctagttgtttctgtttgactttatcttggaactaactatggaacaagatggctgtgtttagatgtcttcattcatggcctatctttgaacactgtgtgtgtttatttgtttgtttgtttgtttgagacagagtctttctctcttatctgggctggagtgcagtggtatgatcatggcttactgctgccttgacttcccaagctcaagagatcctcccatctcagcaccccaagtaactgggactacaggcgtgcaccaccaagactgactaatgtttttatttttaatttttgtagagatggggtctcactgtgttgcccaggctgctctcaaactcctgggctcaagtgatcttgccacctgggcatcccaaagtgctggaattataggtatgagccaccatgtctggcatctttgaacaattcttccaagcaactattttgacttcatttctttctaggaaaaataaataaacaagatcatagagttatattatacaatataaaatccaaatactgacaaaagtcaaccatattagtcactttccactaaataaagttgtgtctatggttctttctctgggaaaatttaccatgtagtaactatcatttacttagtatgtgctaagcaccatgctgagagctttgttcctaactcttagttaggttaccttagaaagccccccacacctgggttatttcctagttctatgttctaggtacctctctgtcattaagcttaccacaaactcatttgtttatttgacatctctcttgaattgaactgtaagagtcactagagccaggaccatgtctatctttgcccccattgtaaccccagcctctaacataacacatgatatacagcggatgctcgataaacatttgaggaataaatgaaggaagcaagtcgaagaaacatccctgggttgctatcgctgtaagcagtagaagttgcatttgaattcagactccaaagcctgtgttcctcacctgcagcacacggtctctgtctgagctgaatagtctgttgcatcaaaacacatcaaacaggaaataaacaagagcaactattattaccacggtcccatacagccactagagagcaaaaggggtttctctatgactattgaggtatattaaggactcattacagaataaacactactgggcacaaaagcatatgagaaaagttttaggagtacaatgaaatcatgcccaatctttcctcagggtccctttccattctctatttatattgtttccagtttattattattataactgaacatttaggacccaagggatgttggccagtggagctacagaattctcagtcctctgaggaacctagcaactagtgttttcttacctggctcttaggagcaaaaggagaaaacaaatgtgcatccctgagctgttgtctagcatataaaaaagatgctattattaataacattttgtcttattaacatttgtcctactgtgatttattggcagccagaagcccaagctttaggattagtcagacctgaattgagccacttagttcttgtagggcctccaccaagttatgtaacctcaacctctttcttcatgcataaaataggattagtaatactatctacttcacataagtgcttggcatagaatctggcacagaggggaaaaaaaaacaatcattggtgcttattttcatcagcttcctcctaattattatttagtcagctgtgagtaaaaagaacctagcgttggccatggaacctggaaatatgacctttgaccctgtcctgttaatgcaattgtagtgagtgaatttttttttacgtgttcccatccccgagcagtccctccctctctcaaggacccggtggacttcctggtcttggcaaagtatgcaacacacatttacctttatcctgccagggaagtgaaggtttgagaccattaagctgggggcttcccacctacagtagctccccaatgcttccagtacaaagtttaaactccttagcttgccactcaatacccaacatcatttgatccaagcaactttgagcttgacatcagggccaaaagatgctttttccacttaagaacagaaattcagtccagtagactagtggaggatatgctaatattttacttccctttccatccggaacagataatatggtaaatcatctgttcatttagtcagaaataactgttgttctaggtgttggggctataactgtgaaaaagaagacttgattttatggaatccacagcctagtgaaagaaagagacaataattaaatggtgccattgtgtataatcagtggataattataattggaaataagtgaaaagcaagataaccatccttggactggaagagaaaatgccaaaagcccagaggagggctaagagttcaccatgtgaaggaggtatcactgtgtctagagagagcctggcatagaatggatctgaaagcctgataagaggcaggagcgccaagagtaaaggccaagcacaaggaggctggagcaataggtagagcccaactgtccagtgggaggaaggggaggaaatgatgggagataggcaaggaggggtgacagcaggaaggaaggaaaatgaacaaatgccagatatattcagcagataaaatagaaataagctgctgataaaatggatgacagggaagggaagtcctgagggtgtggcaggtagccagaatgactctgagatttgtggagtgtggaaataaaaggatggaagtgccatttattaattttattcttaaagataccttgagacagttgagaggatatgatgagacaactgcatgtatacagttgtgcataaggttcagagaaacactccggctggccattgcagcttgtaggaaagtatagggcctgggaagaagagtattgaaaaaagaaaaaggtgacacgctgttcatatgagagatgcaagaatgaagcaatagtggcattccacaagccaggactgagaccgtctcccaaacagccagatgactctgaacctcaaaccaacttgcagtcaccttagaattttattagctgcaccagatggcttacataatatcattaactcctccaccctcactacctaaaaatgctagaagataaaagggacggctgaggaaaatcctggaattttcttacagaaacaacatttacaacaggtaactagcccatcagtttctctagtatttctcagacatttccagttaagtctctagaatgacaaaagcaaatgatcctcgggtcttggtggtgccatcttaagtttccctctgtaaatgtaaatgatttttaaagcctcgtctagtactttaaaaattcatgcaaattttgcatgttactgcataatatcattatgctgcttttaatacgtacacacacttttaattctcccaaatactgaagcaaaaatgatgtgccacaaatgtgcctccattattagcctgtgactttgggaatgcccttgtccacagctttgcatgcagggttgaactcattaactaagttgagaaccatgaaattaatcagaaatggactagggaagtttttccttagagcagaagactagagtcatgacctctaaaaatcactcttcgttcctacaaattctaaaataagtggtaataataacattaatattaaaatcacactaagtggattttaaattcattctctcacactagaggtagttactatggtacatagtatgagagaggtatcaatttaaagataaagatgaggatacaaacacagaaagttaaagtatctttcaaagcaccataatttgaagccagacagttctagtccaagccaaactactattgtcctctctgctacatattagcagcaaactcatcttactactcttgctgatggcttatatttggtgataatcaagaacaatactgaaaagcatgcttcaaaaatagaaaaaaagcttcatcttccccaaacataattttatttaactgaaaaatatcagtgtgcaaattgaacatttttggtacataaagtcaagtgttactaattaagtaaatgagtgatgaatcataatatcaacccagtcattaaacaaaattataatgaaattacatttaccaactagtttacagtacaaaaaatataatgagccaactttaaagaaagcttccaataattttattaaggccttccaataattttatttagttaaggattctgttgtattatcttaaaagattaatacaaatagaaaatggaagagtaaactgtgcaatgacttctgtccctctcaacctttctctagagtcacatcttttaagcaacatgagacatgatttaattcacccaagagaggtcaccttgcttgccgggcaggtgccttctgtttaaattcagtttactcaatcaaatgtaccacggaatagaaaatggggcatattcctgtcctgaaattcttcctatgttaactaaaatcaccttacttttgtagcaaatgagccatgagatacggtgccagaaattgatttggaagagtaagtacacagtctgaaaacagtgtctgtatgttttgtaataaaaaggctctggatggccctagatgccaaagagaggctataaaaggacaaaggaatgcaaacaggggcagaactatacaaaaagattaaatgcatcaccactaaaagcgatacttactcttctataaacatatacatttactgattgctaatttttatctgacgagtggttttgaggtggcctcagtgcaatgtcatctcccctgagcttgtgtcttggacctagctagagtagatcattactccccaatacagctcccattattttcttcctagcactttaaaaaggctctaattattttctctttagttttccacttgctaattgcctatgttccctttgtcattaccagtgcctagctcagtgtctggcccatagtgagaagatactataatatatttaccgaacgaatgaacaaagctgcgagtggcaaacaggatggggcactcttttgagttcatttatacaaatcagattctatttcattttattaaatacttttatttactcattgtcttctgaaattactctgggttctcattaataaggagaaactgattctatcttcaggaaggaggggaaaaaacactttcagtcacttgttccaaaggtctttcaaaataatgttgtagtataatttggtttgaaagcaaggtccaacattttattacctccaaatttattcagaaaagctgaaggcccgtgataaggctcattaagtcgctgaaaggcctatcttcacgtgcctttcacacaaaaggtctcaacttaatgccaggtaattactgttcattttcccctggttatctctatttcctgaagattcccagagtagttggcctcagtggacactacccgcagtctgagatgtgagcagagcaagaaggacccatgttcactggaggatctttttggagctgtaacgaaagacaatcctaacactggggtctagaatttaaacttagatcatctacaagttaccctctatccagaattaaagccaagagggaaaagtttctggcatacaaactggtttgtatttccatttcaaagacatcatttttcatagcacctggacctcattccacacctgtagggttacagatgtgggccctggctccagattacctgggctcaaccctcaacttcatcactttccactttgtaactttgagcatgtaacttagattgtcagtgtgtcagttcccttatttgtgaaatagggctcattgtacctactggagtgttgttgtaagaattgaatgtaaagtagaaggaactttatctcacacatggtaagttctccataaagttatttatttattaatattaattagcattatcatgatcgtctctgatatcccatttgcaagcaggacttatccctgttatttataactttgatcctagtcccactggacccatcatggcattgagggagatcaaatttcactatttgtgaaacaagccaacagaaggtgaatgatgatcagggaagacattttactgggcaccatcatttcagttttgcacggaagagtggtatagccccttagaggtcactgaagtcaccatccccaagcatacacctgtttttatatttaatcaattgatggctgcaatttactaatctgcactgcagtgatcctacaatagccttccctcacagtgggctctcctcacttcagccaggtcattcataagagcttagcttcatagatactgtgatagtaattttttttttttcgagatggagtctagctctgtcgcccaggctggagtgcactggtgtgatctcagctcactgcaacctccacctcccagggtcaagcgattccctgcttcagcctcctgagcagctgggattacagccaccatgcccagctaattttttttgtatttttagtagagacggggtttcaacatgttggccaggcttgtcttgaactcctaacctcaagtgatctgcccacattagtctcccaaagtgctgggattacaggcacaagccaccgtgcccagcctgttatagttaattttactgtcaacttgactgagctaagagattcccaggtagctggtaaaacattgcttctgggtgtgtctgtgaaacaccctgtgagggtgtttttggaagagattagtatttgaacctcagtagattgagtaaagataactgtcctcacaaatgcatgtggccatcatccaatccactgagggcgcaaataaaacaaaaggcagaggaagggtgaatttgctctctcttatggagcagggacatcagccttctcccgcccttgggctgggacttacaccttcagttctctggttttcaggctttcagactttaactagaactcacatcatcaggtctcctggttttcagcccttcagactcaggctgagactataccgccagcttttctgaatctccagcttgcagacggcagatcatgggacttctccacctccataatcaaatgagttaattcctcataataaatctctttttattgattctttttctctggataaccttgattaacacaacctctgagttacaagagataattaaatatagcagctgagagcatgagctcaaaacttgaatgacctgggttcaattcttcactgtcactagtgaaccagggcatgttactttatacactaaggctaagttcaccatctagatatagggttaatagagtggtaacaaatccaaaggactaaggactatgataaggattatataagatcactatgggtgactctgtaaaactcttagcatgttgtcacttatataacaaacattcaataaacattagctactatatttagacatgtcttgggcatgtatgttccagaaatctttttatattagatggtcactacagaaaggcaatctatatgccaagcttttcaatgaagcaaacattatatttgaatactgagtcttaacctcaaaaggttacagaacaattttcattcaagaacaaatcagaaatcacaggttggagtgtacatcatcccttggcagtctcagcaagctaaccctacctaaagtgtcagaagacttttctcgtttacagaaatgcctttagaaatccccaaccaaccactggtaggtccccaagcttcagtcttcaaaggtggcacttttgcaggctaaaaaatccaaaaaccagaatgtctcttctcctccaaaggatcacaactcctccccagcaagggaacaaaactggaccaagaatgagtttgacgaattgacagaagtaggcttcagaaggtgggtaatgacaaactcctctgagctaaaggagcatgttctaatccaatgcaaggaagctaagaaacttgaaaaaaggttagaggaattgctaactagaataaccagtttagagaaaaacataaatgacctgatggagctgaaaaacacagcatgagaacttcgtaaagcatacacaagtatcatagtcaaatcaatcaagcagaagaaagggtatcagagattgaagatcaacttaatgaaataaagtgtgaagacaagattagagaaaaaagaatgaaaagggaggaacaaagcctccaaggaatatggaactatgtgaaaagaccaaacctacaactgattggtgtacctgaaagtgacaggagaatggaaccaagttgaaaaacactcttcaggatattatccaggagaacttcctcaacctagcaaggcaggtcaacattcaaattcaggaaatacagagaacgccacaaatatattcctcgagaagagcaaacccaagacacataatcgtcagattcaccaaagttgaaatgaaagaaaaatgttaagggcagtcagagagaaaggtcgggttatccacaaagggaagcccatcagaccaacagcagatctttctgcagaaaccctacaagccagaagagaatgggggccaacatttaacattcttaaagaattttctacccagaatttcatatccagccaaactatgtttcataagcacaggagaaataaaatcctttatggacaagcaaatgctgagaaatgttgtcaccaccaggcctaccttacaagagctcctgaaggaagcactaaatatggaaaggaaaaactgttaccaggagctactgcaaaaacataccaaattgtaaagaccattgacactatgaagaatccgcatcaactaacgggcaaaataaccagcttgcatcataaagacaggatcaaattcacacacaacaatattaaacttaactgtaaacaggctaaatgccacaattaaaagacacagactggcaaattggaaaaacagttaagactcagaggtgtgagacccatctcacatgcaaagagacacataggctcaaaataaacgtatggaggaatatttaccaagcaaatggaaagcaaaaaaaagcaggggttgcaatcctagtctctgataaaacagactttaaaccaacaaagattaaaaaagacaaagaagggcattacataatggtaaagggatcgatgcaacaagaaaagctaactatgacactgaccaagacaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataataccacacatctacaaccatcagatctttgacaaccctgacaaaaacaagcaatggggaaaggattctctatttaataaatggtgttggaaaaactggctagccatatgcagcaaactgaaactggaccccttccttacaccttatacaaaaattaactcaagatggattacagacttaaatgttagacctaaaaccatagaaaccctagaagaaaacctaggcaataccattcaggacataaacatgggcaaagacttcatgactaaaacactaaaagcaatggcaacaaaagccaaaattgacaattgggatccaattaaactaaagagcttctgcacagcaaaagaaactacgatcagagtgaacaggcaacctacagaatgggagaaagtttttgcaatctatccatctgacaatgggctaatatccagaatctacaaagaacttaaacaaatttacaagaagaaaacaaccccatcaaaaagtgggcgaaggatatgaacagtcacttctcaaaagaagacatttatgtggacaacaaacatatgaaaaaaaacctcatcatcactcgtcattagaaaaatgcaaaccaaaaccacaatgagataccatctcacaccagttagaatggctatcattaaaaagtcaggaaacaacaaatgctggagaggatgtggagaaataggaatgcttttacactgttcgtgggagtgtaaattagttcaaccattgtggaagacagtgtggcgattcctcaaggatctagaaccagaaataccatctgacccagcaatcccattactgggtatatacccaaaggattataaatcattctactataaagacatatgcacatgtatgttcaattgcagctgttcacaatagcaagacttggaaccaacccaaacgcccattaatgatagactggataaagaaaatgtggcacatatacaccatggaatacgatgcagccataaaaaaggatgagtttatgtcctttgcagggacatggatgaagctaaaaaccatcattctcagcaaactaacacaggaacagaaaaccaaacactgcaaattttcactcataagtgggaattgaacaatgagaacacatggacacagggaggggaacatcacacactggggcctttcagtggctggggcgctagggtaaggatagcattaggagaaatacctaatgtagatgacaggttgatgggtgcagcaaaccaccatggcacatgtatacctatgtaacaaacctgcacattctgcacatgtatcccagagcttaaagtataataaaaaaaaaggagaagaacaaaaaaaggtggcattttttcaaaaattgtattaagtgataagatgttaacataaaaattattaagatgaccaaaatacattagaagaagcagaaatcaaaggtaggcatgcagtagggtctctttaacctacttcttcttgttctatcccccacattatgcttgctctgttaatggcaacatttactcccttagtgtagtaataaatgttcagcaactgggtggtgggggtgttctaattgtagtgtttgccaattttcatggtgtaaatacatactctcaccatggctggcttcaagataccaacatgatatcactgaaaagggagttgggaagagaagcttataatcagctcttacaaatacgtacaacatggatactcttgagcccaggaaaagaaaaggtatgtgaataacatagtatcaaaagcatctagtctcttcttgagccatcagcccattcttgtcaggttcactattgggagcatggagaaatatatgaactgaaagcaaaagttatgaaggcaggggatagaaaatagtatcattaccactgaagagaaagaattgtattttttcctgtacgataggcaacatggcacacagacataacaagtctgggttgaggacggctattagagcaaaacgtgttttagaatcagaattttatattttaaaaccaattggcatgattcttgcatatgtatcatgagtgtatgattgcctatgcatgagttcagtattaagaaatagccaaaactctctgtggtgtaggacttccatcacaccaaccaggcagagaggctttctttgaatgcccgaactctgctcattctccatcatcctccattaacggagggcagttaatgcacatatctgcctgtgtggtggtaaatgcttaacaacggctggtggtgggatgggggtgttctaattgtagtgtttgtcagttttcatggtgtaaatattaatacatattctcatggtggctggtttcaggctaccaacatgatatcactgattagggagttgggaagagaagcttataatcagctcttaaaaataagtacaagctagctccaaaaatgtctatactatgtttccaagagatgaaaacctcatggacaaatactctttcgcgatatatatggttgctgtaaagtaatttttatatggttcattgtgagagtttaagtattacttcttttaagtactagaaatggaaatataatctctaatcccttttctaactgaatgaaatgttaacttcgatcatccatctgtgcagttactcttctagtaaatgtgattttttaaactttctctcctcttttcagggctacatctgctagtgttttccatttgccagctcccaacatgtccccaattacttcttttttattttatagcctccatgctgatgtttcatcagttacaactgctgggttccactgagcattaacagtctgcagtgcctctaggaggttacataattcactaagtataccaaatcattttttctccaaagaatattatttaatgtaaatacagtgtgaggttaatgtagtacaaaagaaaggtttttcccttagaatcatcaaaaaactgaaaaaaatgattcacggaagaatggtttacacgcaggaacaagaaatcacttgtatttaaggattatttcaactggcacttttttactaaacacaaagcaaaaaattaatacatttgagtacatgaacaagtttgtgttttacctattgaatcaaaatatttttaccacaagagaaggaagctaaaactaccttatgttaggcatatgcatacttgaaaacttatgatagaatagatatttgaaatcattttagtcaatagcaaagcaaaaggaaggatcaagaaaaagttctttgttttgtttttaactcaatttttcttataaatacctaattgttctccataaaaagttcataaataacctgatggatgatctgaaaatttccaggcaggtagcaggaactctctagaagtaaatgtcccagaaactttgcaaatcaaatcactcaattcttaatagatggcttaaaactgggtattacattgcaaagttttatgaaaatcatctggcaaacaactgtcttttcttcaagatgtaaacaatgaaacaattaggtttaaactgtctaaaactatgtgctcaagtgtccccttttacatcagagtctaagtgggacaatgatggagcagttagaattttctcaggtagtcagatggggaaacaggaaaaggatgggaggaggagtaatcattcaaggaaatttttttaaatgacagtatcaatattgaatatttctggagtatcaatcattatagtatgcccttgacatatagaatcttctccagtccatatacactgtgaagtaggtattacctatccaattttatagataggtaacaggatggtgagttgctgctcagggtattaagtaagtgaccaagatccagtgcttagctaagtcttgtcttcaacagtgtggagctggggctgggttgggacctctgtggtccaaagccccagccacttgacttcatactgcagcttctggttggtatctatggcatctatgagtctgacagctatattttcactcattttcagtcaaatatttatcaggcatctacttgagccagacaccatcctaggcagcagggcccaataggaaacaagacagaaaacaaaagtaaaaaaaaaacttgtcttcatgcctttggggtcttctttgtagttgagagagaaagacaattgtattagtccattttcatactgctataaataaatgcctgacactgggtaatttataaagaaaagaggtttaattgactcacagttccacatggttggggaggcctcaggaaaattacagtcatggcggaaggggaagaggcacatcttacatggtggcaggctagagagagcaggtaagggcagggaaaactgccttataaaaccatcagatcttgtgagaactcactccctatcaggaaaatggcatgggggaaccactcccatgatccaatcccctcccaactggtatctccctcaacacatggggattataaggattacaattcaagatcagatttaggtgggaacacagagccgaaccatatcaacaataaaacaaaataaactagtaaagtatttagcatgttagctggtgataggtgctgtagagaaaacaaagcccggaaggagcgtggggagagtaccagggtgggtggtggaggaggttccaacttgaatggtgtgggcctcatggaaatcttgtaaaaaccccaagaagatgagagagcaagccctactgtacaagttcctggaagtaaagcacatagggctgagggaaatgaagggcagagcaaccctaaaaggctagaagaaaagtagagagcctggagtggaatgaccaagaaaaaagcaggaggaagggaggtcagagaaccacaagcgcggtggcagatgatgcagggccttgtaagccaccatcatagttgccatctcttctccaaggcaagtgagcaggttgtgaaccaaggagggatctctccccaacttacgctgtaacagaatcatttgacttcggtactgagaatcaaccaaaagatgtgaagaaagaccccttatgagcctgccacaataatccaagtgacaggtgacagtagcttgggcccaagccatagtggtggaggtgatgaggcatggttggatgctggatgtaagactagacactgccatggctatgcagtttgttctgccactcagttgtttggcatgacacaaactcacaggaggaattttatataaaagatcgatacaggtgagataagatctccaattcttaaacagcagagaaaatcaaatgttaattggcaaataaaatgccaagaagatgtgcttgaaataattaaaataggcaaaggattgatcacctaaaaatagaagcagaaaacaaaccccccctgacagttttcatctctcacagttaaatattaagctttcctcttaagagtaacttggccaggtgtgatggctcacacctgtaatcccagcactttgggaggccgaggtgggtagatcacctgaggtcaggagttcgagaccagcctgaccaatatggtgaaaccccatctctactaaagatacaaaaaatatttttttttgtattacagggtgtggcctgtaatcccagatactcaggaggctgagacaggagaatcacttgaaaccaggaggcggagactgcagtgagtcgagatcatgccactgcactccagtctgggcaacagagcaagactctgtctgaaaaaaaaagaagaagaagaactttgtatttcctactttgctctacacatctacacatagaaggtattttaaatatttatggtttgttgattttaaaagaggctttgttaaaacgaaagtattaaacgggtaaaaaatagaaccaagtctgtgtgacaatacactagatttcaaattctcttttgcaagtatttattgaacactttctacagacaaggtacaatgccagatattagggatctgaagagaaaaatcagtaaacaaagttatttagtgcaaggacaacataaacaataatgaaaaaagaaagagataaactccagctgaaaacataaagaccacataggacctgtttgttaaatataagattcacagaatacagtgcaaggccagggaataaatgaaaaacctacaactttgatgacttattgtaggaccaggcatattacttaacatccccgatcctctatttcttcaattacaaatgaaatataaaagtatctcttaaaacatgtcagcagggtcaaattatataacttagaagataatagggattcaatatagcttagcattcttccctaattttttttaatctaacctgcaattacaatataggcgacaacattttcagagctgaaatgcgcttccgtcagctacacagtcttcatgatgatgtcccatccacaggggttatatgtgggcccgtcctagtttggtgttctctttgtgtgccaaagaaatgattatcccccaaaagcagcagccatcatttgagacctctctagttcgttgatttcaaactctgttactactgggatttaaactaaagctttaagattgaaaagaataataaatacagcaggctctcaaaagggaaacacttatcttgtgaaaaaacaaggttgtttttttttttcttaattctcaatgttcattctggaagattcaaggttatctactacctgtttttcttcctctccaatgctcaactcgaaagttgttcaaaaggttcactggcatacataagcctggaccctatacatgcttcctacgtgaaatatgttcttacttaggaaaaatgccaagctccagtaactgtgacctacataaattctaaggtgcaacgtaaggagggcaagcaaggcattactgaattgtatatgtcacgccatacaagctgatgtgcagctccctcaaagtctcaaaggcctcaataattgtaaataaacaatgtccttgagtccaaaaagactatgacatcccacaatcaaagtattaacttggaaagcattgcctactttgtattttctagaaatgtttcatgtgttcatcaacagcatgccagtcccaatgtaagacacaaacacagagacattcagtccatatgacataaggttgaaatcatcctaattgtcgacatgagaaaatgagaaagcaatttgtggcatctaaatacatgcataatttttatcccgtctggtttttgctctggttctgtgcaacctgaaataaggagagtgtgcaactgcttggtgacagattgcacagggatggaggactgtaaatggatgaatagttggaacatggttgaactcaggaatgaatgaaccagactctcctgatgaaatggctccactctggagatggagcccaggagagatgctgaattcactttttcacaccccagggatcaatttggttaataacctctctgctgccttaaaatcacttgggaacacctgaacaaaatacaaattcaaagcaagatcttcgaagcttagagaaactgaattgaatcaggaggtgaaaatcttgaacattgactatttcagctactatacacctatgtccatccaatttcatcaagatgctgaaaaagtacttagggtaataagtatgaaaaatgttacacttcttggaaaaccagtgcttaaatgttcagtaaatgataccttgtttctgaatttccctagcagcactgaattcttaatcattcacttatccatttaatcattcaaaagaaatttatatcttcactttttctcctgattgcatggtaatacctgcttactgtaaaatattcaaatgagatagtatcacatcaaggagaaagtataagtctctagaaattccagaaaatgtgtatttgttaaccactacattctaggctgtgtgctagaggtgccacagagttggcaaagtaaatctgaaaacattcctgtcctcaaaaagaccagagtctagtaagagagatgataacaataaaagtactaaaatatagtacaagaagtaatgcaagtcataaaaaaggtctgaataaatgctataggaggtccaagaaaaagaaacgtctgctacctaagaatgtccagggaaaacttcctttgcaaaaagaacctgtttctgccatttccttgaccatacaactccacgtgttgtgttacttatgagtcctctgctcagtgccgaaaagatttccctatactaagatctcagtgcttcgtttaacttgtacaaaattcccaaatccacattcttacaatttccccaaagattcagcaattctgaattccggtacacctcctaacagggtaaacataaagaaatcatttgatcattagttacttaccattatcattgttcacagaaattggggaaatggaaaactataagactggaaaaagataaatgttcccccaggccctctcaaaaaaataaaaattttggacaaaataaagaagctctaggttaggaagaaggataagaggcacacgaacacaggagcatgccacacacatttaacactcaatacacaagagctaaagagaaggctgtgtagggtcaaagtgagtttgaaatacataaaagctgaggctatataaaaatctgcatttacgataactcttctaggcagggaggttgttgagtacagacgaaaagaaccaggagaccagtggtgacagaggattctgtctttgagaagctgggagaactggaataagacacttaaccctttgggtttcatgattctcattattaaaataaaataatgatcctaggcctgtatgaaattcaaatgagataatatatttgaaagcattttacaaaacagttcataatgtattttataaaacacatagggttaaagtagttggccaaagttctaatgaaagattagttgactcaggacataaatctgaattttccaaatgaccaatcccaaattgttacctctactatcccttagaagtaaaaaaggatttaaacaactcaacaggtaaaaataatacttcctccacaataaataccatatcatattcccctttgttcctccagcatctacacagtgctttgcacagagtgagtactcagtactctagaagcaaaactcatctttctcctactctaccttcctatctcttagcaactactaattttctgctgcatttttagtggacatcagcatcagtaagttgccatcccaaggaacaaagtcaaattggcaaaaaggtggatgggctagcatccatctttggttgttatcaaaatattctccttcctcagcacactcaagtgaaggccataagtggactgtctgggccgaaagtctccccatacttccaccactcttgtatcattaaacattcttcgcagccttggtcaggagaggactgcgtggatgggcactggacatgcaaagtggcccaggtacatagcagtcttgtcaagcttggagagtagtggcccactcttggccccaggccactgccatttgcctgtcatttgtaagagcacagaccagaacatgagcccagtctgctgtgcacctcacagcaacatcctgacaattctgaaactcaaaaaaggtttcgttgtttattgggtataagccaggcaggactgaaaaggaattctttaaaggttagtggtgcaatactggataagagctttacacatcccagtcttccttccttggtgtcagaacgggattaacaggaagactggccaacagatgcccagggtaccaatctaagagggtactaaaatagccccagaaaactaacacaatgaagaaaacagcatttatcagaactttcttcaagaagggaactgggtttcattgtaagaaatacttcgataaaacaattgaggtagaatagggatgatatgctttgaaaaaactaaaaacaaggccaatataatgctttcatgtagggtggttccaacaatcaaagggctttcattttgctaagctgagtatggaggccaggacactgtaatctgttgtcatcttcctccacaagcagcactactcaaatctgttacttcacttgattgctgaaggaatactgaattagtctgcatgggccacccacatgtcttagttgagccctacatgagatcaccagttctcagaaaaggtctggctgttctgtttcagttccccagtttccatttcttgtctcccttaccttattcatccatagacaattcaattacaaatatttactgaacacctgctgtatttcaagccctgggaaggaagagatgagcacaacataatcttggtgccagataaacacatgtcctagacagacaactaagttaatataaggcaaatggatgggagctctatgagagaaacatacaaatgcaaacatggggatgccgataaggagtgagggaatgccttatggaaaatgtgacatttacatagggcctcttaggattaggaggagctgacaagtgcaaaagaaggatagagaaacccaagggtgttgaatgaagggcacagtgacttgagcaaactgtaaagagtccacagtgaccacagcacaggcaacatggttaagagtgcagaagatgaggctactgataaatgtcagagccaaaatttgaaaagtctttgaagccattccagaacgttaagatcttactctggaagcacaagggagctatcgatggttttaagccagaagtaaaagaaaaaaaaatgtggtagatttgtgttcagtgaaagaactctggcagaaattgaaaactaatggatagaaatggggtgtagggagtagaagcagaaattgcagtggcccaggatgagaacagaatatagaaaacaggcatttcacaggcaaaaatcaatggtagttggcgactatagtgcatagtgatgaagaggaaagagttcctgtctcctaattcattcatattcatcctttacatctcagatcaaatgccactttctaaaggaagacgtctcaaaccccaagaataaattaggtccttctggacatgctcacaaagcacattggacttttcctccacagcattgacctcagtttataatgctatatttctgtaataaataaaattaatctctgtatctgctaccagattgtgaacctcttgagggtacaaccatgtctgttttgtggttcctgtattcctagtatctagcttttagtaggaactcaaaaactatattttggaagcaataagggaaggcacttaaggatcacataaagacttctatactgcaatgccaggtagctggtgatcccattaactaagacagaacatagaaaaagaggaaaaggggaaaatagggagaagaaaatgaattccagaataaacaaggtaaattggaaaaatcttcaagaattccagatggagatttcaaatagcttgaaactcagcagtcaatccagagattatagatttaggaatcatctatgtagtggaagagaggagagtcactgctttactcgggttaagtatatgactccagaagaaaagaggctcaaagatggagccctgaagaaagccagaggtagaatccaagcaaactaaataatacagcaaaaatactgggaaagaaagtctgagagccaggagaacaaccatgagagggttgtattttaagaggtcaaggagccaggcacagtggctcatgcctgtaataatgccagcactttgggaggccgagataggtggattaactgaggtcaggagttcaagaccagcctagctaacacggtgaaaccccatctctactaaaagtacaaaaatttagccaggcgtggtggcaggcacctgtaatcccagctactcaggaggctgaggcaggagaattgctttgaactcgggaggcggaggttgcagtgagctgagatcgcgccactgcactccagcctgggcgacagagtgagactctgtctcacacacacacatacacacacacacacacacacacacacacacaaagaggtcaagggaggtagagctcaagaaagagaaagtgcttagtggggcccaatattaccaagggtagggggttggctcataagcctcagaaagtggtgggcactgggattcaggcagtgtctatttctaaagcaagagatcccaaactcccaaagaaaagctgaaaacagtgatgaaaacagcaggtgtgcacagaaggaaactaaaaaacatgcaagaaaataattattcattcaataagtatttgttgagcttctactatggtccaagcattctatattggaagtatagcagtaaacaggatataatggtctgtgggcccacaggatttaagagcagataggatcaagatcaaagaaaaagagtctgacttcaaaaagctatgagacatctcttcaaaggaaggagaaatgatctggggctaaagattatatgggcagagtcctagaagtatcaagaagacagaaaattttagggttgtcatgagttgggttgccctgaaggcaaaacctgagacaaggacttaggtgcaggagtttatgtgagagatgactccaggaagcagagatgaggaaatagggtgtaaaaagggaagagcaaaagccaactaagggtacattatcaagtttaccacttgccaaaccagcaagaggctggtttggccagaacctccagagaagtacacagcttgcctccagaactgttcacctgaatcgcaaaggccggagcacttattcacatgttcaaatgcccagtggctgagagtagcctctgagggcatttattcccacagacgtccaggctcctcttcagcccaggccatgcagactcccagcataagagatgcccttggggaagaaagcagaaaagcagaaaagtaggggctagaggtgggaagctgacttggacaaaactggtcaccacagttgttgctgaaatcagagataatttcacagagggactgtgaaaatggccacaggggcatctgccacaaaggtagtgttggtgagaactaggtggaaatggctaatcattcagcccaggctagttaaggagaaaaaaaaagaatgctaagagaaagtggcttgggaagttttctaaggtctaagctttctttcaatgatttttggcctctgcataaaaatatgaacttagggacttactaatagctcaaagttaagatcatagagaaggcgttgtactcctctaggtcaagggcatattaaccactgatatttattgagcacttactatgtgccaggcactttatagtcatcatcaaataaatcatccctgcaactgtatatactcattagtattgttgttcccattttataaaggaaggaactgaggcttagagagtttttaaagcttttaagatctatgaggtaacaacctatttcattttaagtgtatgtcaataacccacacttgcatccttgtgttcgaacacacacacacacacatacacacacacacacatacacacagtaaaatcagatatgaggaatttctggttttactagagaatttagtttatttatcttccctgtctatttcttcattacatggataatgaagcacttctagactctttaatgaatacatttatttaaattttaaaaaatttataccaattgatcaatgtgttttcatcaaatacgtggactagaaatacagaaaataaagatgtttagatatagaaaactgagcaaaaaccagctacaaaataccaccaaaagcacagagctagttgaagtcaaaaaaagcatcataaagggaaaaactaaaagcatctaaatacagaacaaaaggcaaatctgattgaaaacttgtctgcatctttaatttggaggctcatgatcatgctggaggtaggaggcaaaatttaatttaaggagaattttggccaaccatcgctattttctttaacacaagaacaaggagggagagggaatgaggtagacaacatccacggaggaccaggtgaaggaaaagcagagagtgatcatatcccatatccccagacacttggattagcctcagggaggctggttaggcaatgccaccaccaccaccgtcaccacgcccccacccccctcacccgacccacccgccactcccagaataaagctggtttgtaattagtttaggctgtagaggcttgtatcattaaaataatgaccactgggcatttgccacaaccaagataatgtttcataatcaaattaacttggctcaaaaacttgatttggaacctgtttatggttagtcatcaaacagctttcggggtgcttgaagcataagatatgcaaaaaactaggtaagtagtgcatgaacacagaatcagaggaaaatgtggctatgttttagtcacagagtacttacaatgggggttggaggtaggaggacagtgactatacaagaaaaggatttgaaattgaccctcaaagaactgaatatctttttaaataaaatgacaatattaaaaccacatgcttaaaatacgtacggctaagtgcttcagcagagactgggataccagatcctgagttcctcaaaggcaggagtgtccaagtcattcacttttgcttcaccggagcctaacacattgcctggagcagtgttggtactcaggaaaaccttctgtcgaatgaaggactatcatgctgttataataattaggagaggacaacatagaaacatggaaaacctttttaatctactggaaagtgaaaatgatatgtcaatggattgcaaccatgtgcaaaaacaggtgtgtttgaggacaactagaagataaggtggcaaaaatgaaaacactggtgtcaggtgttaggattctgcatgtattgttgttgtttctaaaactgcatttaatgttgtcagaatataatctttgtaatttcagaatctagagatgcttccatgttggagggagggaaggaactggatactcaatgaactgatagcttacaggcaaaggttcaaactccattgcttagcactgcagactctttgtggcacagtccccaagaactccagttttatatcatatccctgctccttccttcttccccatcacactgaatagtttgccttttctaaaacgtatcataggtttcactctttttttttttttttttttttttggtacacactcttctcactatttgtaatgcccttgtttccgtcccttcttcatatggctaaatcctacccattcttcaaaacacaactcaaatatttcccctctgagaagctgacctgattccccacaccctatcccagtctcaatttttggccacgtctctaagtttctatagcaacttatgcgcttacctctttcagagccctgtctcactatgctgcaatcactggtgtacttgcctttctcctctactagcctggatgctacctacagataatgtaaagatacctggggctacaaaggccagtggatgacccactgtcttttttaccaaactgtgacagtgtggtcacttagtcaagactcttttggttgcaagtaacagacatccattgaaactgctttgagcacaaaagggaaatttatttataaggacatagagatacttctcagagcccaaggttagaaagtgcagacactgaggtctggatcctggagctagaaagcctacagaatcaaggcagctactctcttagtcaatcagtcttactctctccccatacccacctctctccctgcagcctcacacagtcttttaatctgcatatctccagaggcctgttgtattcctctctctttctttctccctctctcttgctccgaaagacagttatacagtggctacaagtatgagctcatactacctgtgttcatgcctggctctgccattaaccaactatatgaccttggataaattacttaaccgctctgtgactcagtttcctcttctacaaaatgggaataagaagaggtcccacctcataggagtattacaaggattattgaattaatctaagacatggcttcccactgctcccaagtttacacatctacctagtctatctacaaatatgtcttagtccaagaccacacttctgagaaagacaacctggctggtccagcttgagtcagctgtggatctttgatctactgagccacagcctgggagccaagttaaaaacctgatcaccagggcccatccttgaagataaagtgacagttcttagagaaaggggccatgggctgagcagacaccagaaacaaaaacctgctacagccactaactaaccatgcagccatgcttgtgggcctgcctaggattacagctgggccttttcacctcatggccctgagcaaggctcgtatttaaaacacacagctgcctgtcagactgcaatgacacctaagggagctccacacactggcacttaataaaggcttaatggtgatgatggtggcgctgacaaaaatgacggtggcacaacaggccatgctattgcttcccagcagttctctgctgggccccgtggcttgaagttgaaatcagcacatccttctaactcggctaatgtggcttggctctggggccaaccctcatcagatcccatccaactgctagttaggtagatttataccccactaaatccattgtcacacaagggcttcctcctcactgccagagtgtaaagaacatagacacagcatccaataaccaaaggaggaaaggcctccaaagaaaattaaccatttgacttcaaaatgttatgctgctgctctagaatttccaaccaaatgaaatcagctgaaggtcctgcatctttaaataataaaaaaataaagaagaaccacagctgtgggcccttactagcccataaataaagccccgtatgcaactctatatcaaactttttttttttttttttgagacagagtctcactctgtcaccaaggctggagtgcagtggtgcgatctcggctcactgcaacctccgcctcctgggttcacgccattctcctgcctcagcctcctgagtagctgggactataggcatgtgccaccatgcctggctaattttttgtatttttagtagagacgggatttcactgtgttagccaggatggtctccatctcctgacctcgtgatctgcccgcctcggcctcctaaagatcaaacttattttttattgcagtataatctctttaacaaaaaacaagaattgtagaccagtacatctttgctatgaactgaatgtctgtgtcccctcaaaattcatatgcagaaatcctaacccccaatgtgatggaattaggaagtgggaccttgtttttagagatgggacatcaattccaggaccagtatcaagatctcacatcattctctttcacaaaaatagtctgcctttgaatttttagctctcggtgataagtaaactacacttattgtagttttttgcttgcctcaaatcctttgtagaagtaggctggaaaataaataaataaatagaatttcctctatgaatttgaatagcagagtatgcatgtaatagacgcttcaataaattttgctgtagcatgaagaccaatctcattttcaaatggtgaatcttggctcatgtatatgtggtactataatcttacaagtagggtttgcggtacacatcactttaaggaatgctggtactttaagtgaatttgaatagcaagagcggtctaaaatcagtcaccatcactgagcacagtcatttgaaagcctgaaattcacttttagaaaattcatcagaaaaaaagattcaaaaactggcaacgttcactcacagatcaaagacaacctaagtatttaactcatcatcatctatgaggataacgacttttaacagctgtccatgcaagagaaagcaaaaaaaaaaaaaaaataagaaacaatgagaggcattaaagcataaaggtcaagagcactttgggggcagccagccctaggtcaagaagtcctgactgtgtcatttaccagctctgtagctttgggcaagttgcctaaacactctgaacttattcagtcttccataaaacatttaaataatagtgatacctatcttattggatttctatacttaataaacaatgaatatgatgatgacgatgatgtctgcttttactatgaggaaaatgcattcagtaacaaatataaggaaaaaaatatagaataagtaaggagactctttagctatccttatccactaagaatacctaagagtttgtagtaactggcaagggtgtatatataaccagcactgaacatatcatcctttttgctattagagagtatgcaaaagaggaaatataaagaacggctttgctttgatcataatcaaagggcgtgggtaatctccttgagggcaggaactatctgggtcctattaacctagcacagacagtatcaagtagcaagcatacagtcaaagcaccaaatgaatgcaagaatgcctggatacaccctgaatatgactacaatcaaagcccgaagctcttggtaggtttcactggcctctttccttatatctagaagaacgtcctaccttcctggtcatagccaccactgaaataatgaaaacaaaataacaaaataatattttaaacatacatagcataccagttcattaaaaatagactagggagtattttacattgagacactagggagcatcattactttgaaatgtcactttctgctttaattagtatgctctaatgataagtatatgccattcttatctaatgaaagtcttgaatacatacggaatctggttcacagtcctcgctgggaggtacacggatgtacaaagaagaaacagaatgcatgtgttgatgtcaactagtttgcttacctttattaacataattgccaaagtttcaagttttacaatttgaggatacatatgttcaacacacccagaacacttggcacagtcatctgatcacctttcacatttctcaagacagcctaagctgttttagggagatgtgaagtttccggtgatttctttcaagccgactctcgggggtatcactcagaacaggaccacctgcttggtggcatctttttaataaagacagcaataggtctgcttgctcacagggaaatttataaggctgtctttgcttccttccacctattgtggtgctttatccaagtagaatgtactcagtcttcggagcttcaaagacactgataatggacttcttttcaaagagaagtcttagtcatccgctcctttcattcaacagtcagaataagaaaggcccagagggatacagacaaatacctctgagctgcctgttgtggcaatatcagataaagaaattctgtagcccagagagatatttgatccgttcatttgaaagtcaatactaaacatccttcccagccactccacccaagcaatgagaatgtgtctcagaaacaggacacagaaactatctcttacgatgtagcttccacttcttttttctagcctgagtgggttgggttgaggaaggagagaaagaaagaaatcaagaaccaatgttctctgctttgtgtttccctgattcagtgaaaaacggaggtcatttatagcttcttcaattggctgacccagaggaggctccagctttctcaggattgtaatggcaatgacatttctcaaaatcagttaccaagttcgtaccagttcccagcaatagaatacttggttactcagggcttctttctttgggaaatctgcatcaccgggatgactgcagttcacccaggccctacaatgggttctcatttactactcaagtttcatgcagatcatctcattcacacaagcctacaggaccaatctgcctcccagagccatggctctgcaccttcacaattgcaaagcaatttctcagggggagtcaaagcttcacttgctttttacagaaatggctcatggagatattatcttaaaatgctttctcttaaaaaaaattttttttttatctgagaattgcatgctgtgctgaaataggatggtggtgggttctgattatatcttttttccaattttggtttcactcttaagtatagaaaatatcaggttgctctctcctctgattcccttttctcccagggactaaaactttagtctgctgagtcaaaagtaagctttggtattaaattccatcttttatcttttttctcccaatatctaagaacaatgtgattatgcatcattttgtactacagaagtgctgctgagaactgcatgcaaaataaatcaagtcaatgatgtatttgaatgtgactctaatcactgaggtgggaaaaagataccagggttctactttagactgctaacctgctgtgatcaccttacctcctcttttaaatgagtgggctggaagtgctccagctcatgtctaaaatttagtgtgcttcgctacctcatggcataacaataggatggaaaaccatgcaaccattaaaagtgatcattacaaaaatgacatagaaaaagaaaaaataattgttataatatttaataaaaaattattccacaaattatctgtacattaacatttttcattaggacctcttaagccatgccattatcaaaaggggcaattcaaacatatcaagagtatctgttaatatttaaaattaggctgttagcctgtaatgaacatattttaggggaaaagctagaagtctgacacatagaaagaaagaaagggaaaatattaacctacaaaatcctttaaaaaggtagacttaaagctttttttcactatcttagtgaagatcgttaatatgtaccttacagtgtattttaaaattgtgtttctttaccagggaatttttttttatctttagtaaatttcagatttgtttcttacctgcatggaatgttacccttcccttaccacaatatgacaaaattaataatagccttacaaattgtgaagatacaagtttgagggaaaagataccaactgctttttaaattacaataatacatgatatcaccatttcattttatttaaaagaaatgttttacaacagaaatcatccaaccaattaacagggaaaaataagatggtgacataatccttaggaaggattactgggaaagaaaaaaacagtcatgagtacaacttggtataagtttctaatgtttatgtatagtgtatgtttatatgtatgtataatacattataatatacatagcatataatatttagagtgcatgcatattatgtgttttgtgttacgtgattgtttttgagagatagttgcttacactattggaaaaccactggtcatttggcatttctaaacagttatggtgctgcagaggaaagcttttgaccagcctttgactagccttggtcttgtcgttatttagcattcagatgtgtcaagaaaattaatacctaaaaaaaattttctggctgggcacagtggctcacgcctgtaatcccaacgctctgggaggccgaggcgggtggatcacctgaggtcaggagttcaagaccagcctcaccaataaggtgaaaccccatctctactaaaaatacaaaaattagccgggcatggtggcaggcgcctgtagtcccaactactcgggagactgagacaggagaattgcttgaacccaggaggcagaggttgcagtgtgctgagattgtgccactacactccagattgggtgacagagcaagactctgtctaaaacaaacaaacaaacaaacaaaactgcagatctgtttttggagttttaaagtgaaaaattgcattcttttgtctctagtagtgtaatattgacagtccaggcaattattgtcatgctaacataataaatgaattacctttactattctattgccaatgtgcttttttatagctttatttagatacatttacaaaccataaaattcacccatttaaactgtacgattcattcatttttagtatattcagagttgtgcaaccaagaacacaatcaattttataacatttcctcatcccaaaaagaaagcccatgtgcattagcagtcactccaatttccccgctacccctgcagccctattaatccactaatctactatgcatatggatttgtctctgttggaaatgtcacataaatggaatcatacagtatgtgtccttttgcgactagcttctttcacttaacataatgttttcaaggttcattcacattgtagcatgtttcagcacttcattactaattatggccaagtaacattccattataggaatatgccatttttgtttatccattcattgtagatagatatttgaactgtttccactttttggcaattatgaataatgctactatgaacattcatgtacaagtttttgtgtggatatgtttttaattctcttgggtacatacctaggaaggtatagaattgctgggttatatggtaactctatatttaacattttgaagaactgtcaaactttttccccaagtggttgcaccatcctacaatcccaccaaaacatatgagggttttaatttctccttatcctcaccaacgcttgttattgtcttttctattttagccattctagtgtgcatgaagtggtatctcactgtggttttggtttgatctaatttgacttccctagtaatgagtgatactaagcatctcttcgtgtgctattaaccatttgtatatcttctttgggaaaatgcctattcagatactttgcacatttttaaattgtgttatttgttgttttacagttgagttgcagaagttcttaatatagtctagatactagtccatcaacagatgcaaaattttctcccatctttgggtatatctttttacttttgtgatggtgtcatttgacacacaaaagttttaagttttaacaaagtctaaattatctattttttaaattttgtcacctgtgcttttggtattgtatctaagaaacctaactcaagatgacaaagattaattcatatggttttgccaagggattttatactgttaccttttaaatttaggtctatgatccatattgagctaattgttgtgtatggtgtgaggtacaagtcctaattcattctttgcatgtagacatccccagttgtcctaacaacatttattgaaaagactaatatttctcctattgaattgtcttggttctttagttaaaaatcaattgaccataaatgcgagggtttatgtctattctattgatctaccttttttgttagtaccacacagccttaattgctatagctttgtagtaagttttgaaactagtaagtgtgagtcttcaaacttctttcttctttttcaagattgttttggctattctggatatttgcagttccacatgcaatttaggatcagcttgtcactttctggggaaaaaaataaaaaaacagctgggatttttaaagggattccattaaatacatagatcattttggccagtattgcaatcttaaaaatgttaagttttctgatccaataacatggcatatctttccatttatttattctttaatatctttcaactactttctagttttcacatcttatacttctgttaagtttattcttagatattttattttttggctgctattataaataagattattttcttaatctcttttccagactgttcattgctagtatatagaaataagatttatttttgtatattgatcttgtatcttgccacattgctgaactcgtttagtagttccaatagttttttagtgaatttgccagtgcacttttaacttaaacttttaaattattttgtccccatcatacttataaacatcagtgtatgctactactgtaccacaattatccacaatattgagcaattaaatcctgtctgccctaagctctcattcagtcccttcaattaacccttcaggctgatgatcactctccacaggaaaggagaaagcacgacataaaacaaattacttctttcttaatcctttctatttctagtggttagtaaaaccatacagagtagtaaaatgaaacatatgctgagctactgaaactcttctgcctagcattaccttgctaaaatgaaatcaagcaaaatggaaccaaaagtggattttgacatttcatattttgctgaatactgttagggctctggcaatcactgtctcttacatacaaattaacagcctaccatctgtcaagtgttgggataatcacagggtttagtgcacaatatggttattagaatatgacctgacaaaaaggaaaagaacacaacctaatttggactataaaatctatgatctcacttgcaaacgacagtttgacaagctattattctgcattttggcttctacagtaaaagcagttttatgcatacgtaattctgttatacaggcaacagcccatagaagattgctttaaactacagaatctgcttggtcatacaatattttttaactaattcttagacaaatatttgcaccatgaataagtaggaatgtaatgatctgagccttcacatttccaagtgaagcaccaatcattaggcaaaaaatgtctttgtgatattgctgccagcagttccatagaattcctcagggtatatgcaaagaaactactgtaggaacttattaaaactattcacatggacatacatcaaagtcaaaaagttgacagttttgaaaagtgtaatatatgaaacactttggtgtggaatttacttcatccccaacagtgacatctgctaatgagcatcattaatattgcccacttttatttatccaaatgcctcatgggtgatatctttatgtacattcctctgtagcaccttttgtttccacccagtggaaataaatcccatactgacagctgcctctaataaagatgcttccaacaaaactcttctggttacagagagaacacagagtaccaagttctttttgttgttgttttctacctctcaaaacagtgcagaaatgagtattgttcctgaaggttatttaagggtacacccagtgtgtctaaaatacatgcctaagacagaaatgtattaattaagtctcaaggcaaaacgttctgttgaggcgacaaaacaaaacagatttttaatattagcagttatattacctagggagcttaggcgagataataactatataatacattaggcaactcacactgcaaattatgttgctttgttttagactacacgtttttccattattttcatacttgtttcctttgacggtagaaaaaaatgatgtatttttctgtcatgttggctcactataaggtgagtcagagtgccaaggttcttctgcaaggaatcttgggatccaattttaatatgctgcaatatgaattttaagaacagtgtgtgatgaattgtcaggctgcatgatatccccaaatttcccagtattgagaccttcatggctattccccgaagataacaaaaaaaattcgatcaagatttatagaagacttataaatgtatgaaaatataaaaaaataatagttacatccatgggtttaaaatgattcccctacagtggcaaccctgtatgaaaatacaatatgagatcagggagcagaaaaataaatgaagtaaagatttagggagaatcatggcaacttattcatttacaggaaagccagttcctttttcacccttggaaaaaactacaaacaaattccaagttctttctagctacaattgacattatcatttggccagtatattcatgataaatgttctaatgtgaaggcgatccatcataaatgtaatttcaaaaatgaacttcttattttaacttcagaaagaattattctaggattcaaaagtccagttaaatacatatagaaagaaggatagaagggagaaaagtttaaaaaaaaaaacaaaaaactatgcccagacaaaagactggaagaaagttatttatgtgatgagactatcgatgatttattttcttttaatttttattaatgttcgaaacaaacacacatcatcttttaatgaaaaagaaattctatatgaattattttctctctatggtatatttagagggataacttatatatagtaaaatacacaaatcttaagtatatggctccatggcatttcatatgtataaacccaagaatcttccacctaaaacaaagtatgcagttatttccagaaaattacctcctgatcctttctagcaatagtctcctagctccctatttttctggcttctagtatcattgattccttttgtcagctattgaattttacacaaatggaagcatacagtatgcattcttttgtttgtggcttcttttggcaacataatgctttcaagatgcatccatattgtatatatttgttgtttgttcctttttgttggtgagtaccacctcattgtatgactatgtcacaatttgtttacaatgatgtctaaggatagacatttggattttctcaagtgcttggctattataaataaaacttccatgaacattcttgtatatgtctttttcatgagcatatgcaataatttctcttgaattaatacaagggaaaatatacgacatacagtttttaactttaaggcaaggtctaatatttccttttatggttattttattttaacagtatatttaaaaattcataacttattggtttcaatctaaggaaaatgtaatgaacaaaattcagagcataaatttgtaaaatctcatactcctagatgaagagttcaaaagaagagaaagaagttatatgccccagtggggactgcttcttctggatcttcatgccacaatggaaagattctcaaaggcataaagttttccatagaaacactctcaatctgttagttttaacaattaaaacttacgtttaactgaaagtatagtagagaaagaaaactaattgatgaaactaaaagtaaacctctcaaataattaagaggcaaatatttcagggctgaaaggtcatcaccagtcacagaaaacattcagagaagtgagaaaccattgaaattggaccagtggatggcagagtaatagatggtatttccatgacatctaccccatgccaggggaaaagaagagaagggtttactttgggtacaatgacaaggacaaccttctgatatgttgctaaggatcatgcctagggtgactataaataatttattatccaaaatgagacacttctgagactgaagcagggtaataaaattaaataaaagtaataaataaaaattaataagtttaataaataaaaattgttttatttatattattaaaaataatttaattttttaaatatccacctgttgactgaaaaattggttttattttactggttgacagttgaaatacagtcctattctaaaatgatttcccaaagtaaaattatttttatttttaaaaaatgcttaactgggccaggtgccatgactcacacctgtaatcccatcattttgggaggcacagatgggaggatggcttgagcccaggagtttgagaccagcctcagcaacatagtgagatccagtctctacaaaaaatacaaaaatattagccatatgtggtggtgcgcacctgtagcctcagctactcgggaggctgatgggggaggattgcttgagcccaggagttagaggctgcaatgggccatgattgtgccactgcactgcagcctgagaccctatctcaaaaaaatgtatatataaaaaaatgctaaactggacaagatgcagagaaaactggtaaaaactagggctatcctgagcaaactcagatgcatgggtacactagtcaagtgtcacctccaaccctctccagttaatttaccaaggtacctataaatggagcctaaggcactgcccctgtccttttcttcattcaacaagtaattgttgaaaatcttccatatgtttggcactgtcccaggcagagagatataatgataaatgagtccaactttccttggactcatggaaccttcaaactgtcagagaagacagccaaagaacaagttactaaaagtgtgctaaatgtgaaggaagatacagagcccactgagaggcttttacatggtagtgatcaatggggtttgtattgtcccctagagagatttttttttggaaatgtgaggagcggtggggagctctctatgttccttcttttttaagagatggagtctccctatattgcccaggctggtctggtctccacctcctcttgagctcaagtgatcctcccacctcagcctcccaaagtgctaggattacaggtgtgagccaccatgcccagccatttaactcatattttctgaggggcaacaaggccaccaaatgttcttatgtaggacaggcccacatgatgaaaaatgatcctgtatccctcataactttcaaatgttccaccagacattcacttaggtaaagaaaaaaaatattattgtctattttacataatagcttaaagtatcttttgcacattttaattttcactgaatttttcagaaatgcaactagcatttaaactgaaggaataatgtattttgttttgttcaacactttaccagttgttcactatttcagaaaatcccaccaccgacagcaatggggcttttggtacccagtctaccaatataacacaactgtattagtttgcattcttatctgtcaaatgcaaatacgtaagagagaaataggcctagcaccaaatattattaaattggccatgggacatgaaagtcaaggataccaccaaattgcattcatggaaagcattttttttatatttcattttactgccacagtacatacctttaaaaaaaatctgtagcacaatgatgagaaatctacactgtgaaaattactgattaaaattatttacttactttggatttgcttcttgtttctcagtcttacagtgaaactgtccctagaggtctcccacacaacttctttatggcttcttatattactgcttctttttccaatccattccctattccctgtggcctaccgaagtgctttttaagaactagagaccaaatgtatgcatcaacataagacatgatttcaagatgagaggtattcttcctgtgattcttcaacaccactcagtcccttttcataatatagggaatgactctgcagctacccttttaagtaagtcccactcatttccaggaatggcatacttgcctatgttctctacctcaaaactgcattatttatcttagcatgttagctctacttcaactaaggttatttccctctttttctcatcatgtatattactattaatatgtatccaaaggttagcttttattctagtatccctcaaacctctcatctttcatttcttgtactcatttcacagaatggcttgtgatattcttttcttttcttttttttttttttttgagatggagtctcactctgccacccaggctggagtgcagtgacgtgatcttggctcattgcaacctctccctcctgggttcaagtgattctcctgctttagccatagctgggattacaggcacatgcggccaagcttggctgatttttgtattttcagtagagacgggttttcaccatgttggccaggctggtctcgagctcctgagctcaactgtgaggagaaaataaaacccgcccacctaggcctcccaaagtactgggattataggcataaaccaccactctcggcctgatattcttttcttaaatccaatttcactcatatcaagtagatataagcatttgattaattcattatgtcttcaagtagagttgtgcccaagcctttacattggaatacttagcttattgtaagccacttcccttttctttcttctttatattgtagttaaccatcataccatttttttaagtatatgggtgggtaggtaatttctataaagttcaaaagagggcagttaatctgataggattaaacagttgactggaatctaatttggggcagagactctttaggctgaaacttaacgaatgggtaagagttagctaagtgaagggaaagtagatcagggagatagaaaaagaggccaaacccttgaaggcagaagaatcctcagagataacagagcagagagcttcagctagagaactggttgccaaaaagtggtaagtgaacccctggaagcacacagctgaacttttgctgataaaaaggctaactttttaattttaatagattcaagtgttttgaaatacatattagaagaacagtagtttccatttaaggtggcaaaacaatttccttgtacaattaacttaaatattagcaaaaataagctttttttaatagtaagtgttggtacaaataggacatgaatatggtaaatacatggcttctgaatgactgaagttggggtgctctgacctattagcatggaggttggagaaagaggtagagctagagatgagatgagaaagcaagggcttggtcaggcaaagtcctacaaaccactgtaattattcaggtctttgtcttaaaagcaatgaaaagccacgaaaggacttcaaacagaggaatgagaagatcatagctgtgttttataagatcagtatggcatctaatgagaaatggattggaggtaggaaagatggctgtgggtagacgagttagccaacttttccaaatgtttaattcaaagacaatggtggggctgggtgcggtggctcacacctgtaatcccagcactttgggaggctgagatgggaggatcacaagatcaggagatcgagaccatcctggctaacacggtgaaatcccatctctactaaaaatacaaaaaatcagccgggcgtggtgacacgcacctgtagtctcaactactcaggaggctgaggcaggtgaattgcttgaacctgggaggcggaggctgcagtgagccaagatcacgctactgtactccagcctgggtgccagagcaagactccatctcaaaaaaaaaaaaaaaaaaagacaatagtggtccaagttcaagtgatagcagcagagatgaagaaaggaagaggaaattgagagataacatctcctgaaatccaagttgccataaattgaaaaatagttggcttaatgatagcttggctgataacatgaagaaatagatgctaagtgagcatatcaattgtaagatattgcttcagaaacattaaaatatggaaaatccatgcttctttaaatagaggaaatacaatttttaaagggtagaaaagagtgtgtagacactaaacaaatgactgatgatagtgaacccccagttggaaaaagtcaaaattgccagatttctttggcctcaaactgctaaacatctaatgtcttgggctttattcactttttgtctttgagtgacatgacagatcattttggtgatatagatggagctcaaattgacaaggttactggagaaagtaaaatcaaaaatcctttctcaggtaaagatatacctgagtaaggaatgctgaccttctaatatcagaggcctaaaacttgtaagtggaagtttgcttacagaagacaatgttcacagcattctgaaagtcatggccaggttgttgctgttattatgaaaatggtgatttatagccaatgtccatagcctaggcctcgaggtatgtttacaatttacagtaagaggggcccagccttaaattattgttagcaagtcttgatattattttgtaaaaaatgaaatatgtaaacacatacatatcaccttttaattttatttcttaggggacaagggaaaaaacacagtttgcaactatgtatatctcctcacatcaaagtttaactcctcaagatgaatacattctgtgcctctgctcccaacttgaagaaatttcaactgctctattctttccacaactgcccattgtcttaaaaaaccccaaatcgctggcattttaaaaattaaatacagtatattttctagaaagaaaaaataattaccaggctcgcacgtggcagattcctctagccatgcaagcctggatattcatgaaagccatttctcacttggctcagggaaacctcccagaatgataggaccatttacactaaatgaaccgaacatattactggagtaacaattgacattaagtatattacagctgccaggggcagtatcaggaagaatccctggatgacagaaaacatgataatgtagaaggaagaacctgcagaatcagaaaggggggaaaaacccctcataaaacaattttaaaaatatataaagaggaaatcatatttaaaggaaaaacagagaaattttgttattttttttccttctgcctgcagtagccttctggtattagacctgcaatgcatttgctaccccctaaaatattctcaacactaacaagatcagaggaaatgatttattccaccccctctcctgctacttctgaacggcagcgcgtgtccttggggacatgggatttctgcattgctttcggccatctgatattgcagctctgcagccttccctggaatgagccagaaaaatcaaaataattacattaatgctgggaatcaaagtttattgactctcccttgaggtggaaaaccaaaatgctggttacaaaagttgccagcttatttaatgataccactgcctcctccctgttcttgtcaaaacagcttttgaaagcattttcaaataaagccctcagatgcgctccaattcaatagcttatctattcccttttaaataaaagctagttcacatcatctcaccccctcaaagggaggacccgacaggccctcttcccctgccaaggcactgccaaaggcaatactcccaggcaatatccctgccatcatttccgctctcttcaggaaggttctgcctcattgaatattcttccaagccagtaagagaatctcatgcctccccaaggcagcaatctacatttattataacattcatggctgctaatgaaacttggagcagctggtttctttcactttccaacaattctttggatattcaaagtcccctcataagagaggggaacttatgagcacacccatttcatggatgagcccgcagacacagagattcaatgtggtgctgacctttgtaactttcacaggactttgctacagccctaaaaaaacagatgctaaataataattgattgaattaaactgaaggaggtagattaatttttttaattaaactgaatcaaatagaacagaaataaacaaactctagccctctccatgcctagtcaacacctactattctttcttgtttcttttttttcctttttattataaaagttttcaaataaaatgagagaccagtataatgaagctccaagtacctatccacccaggttgaacaatgatcaagattttcccacatttgcttcattcatcttctcctttttttcttcttcgttgaaatattttaaagcaagactaagacagcatgctacttcattcctacttttgtcagtgattatgctgtgcagaaaagagttaccatagaaggcctgaggttgctatttttagaatttaaaaaagtttgcaggtaggtaggtaatatctacagacttcactttatgatgataaaagagacataagagaaatagacctgcttgcaaagttgactcttggctggcatctgggaacatggatttgggaaggttgccatcattcccagaactgataagagtggctcactgtgcccgaactgtttgttcaaataatgaaatgctaaatgcctgctttccttctgggagtctaaaatgttggtatgtgctagccagagagtatctacgtgaccagcccccaataacagccttgggtgctgatgccctaacaagcttctctgttggacaacatttcacatgtgttgtcacaactcattgctgaaggaattaggcatgtcctatgtgactccactcaaagaggtctctcagaaccttgcatcaagtttcctctgaagttcaccccatacgctttttccctttgctgattttgctttttatcctgctgtaataaatcatggctgcaagtacaactatatgttgagtcctgtgagtattcctagcaaatcattgaacctggtaatggtcttggaacccctaactcatatacctaccattttttaagtctacttaaacctcactttttcacagaaacattggtgaccttggggagatgccaaactaagggaggccccggttatccattctcacagcaccctgaacttcctcttcataacatttatcgaaacggtccctaaataatgttgaaatcatttgtttgtggtctatctctccaccaagaacccaaagtccctgagacaggaattttgtctgtttggtttgccatgtatacctagcatggtacacatggtatacatttaaaattttaaatagattcaagaaaataccatacccctcctccaagtttaagaggtaaagtttatataatttcccttgcattacactcattcattcaccaaataccactcacttatggtataatctatactgtgtcccagttcagtttaatatccacttcattaacatctttctgtaattagcaacatcatgccaatgcttcaccttttaggtgagacaaagcatgactctgcaagggggctttcctcttgacactggtgactaattcatctatttgcatcacattataggaccctctttccaccttacaatcctctagagattctcctgcaaatacagactcttgagatgattcttacatgcctactaaagtttggaaaaccactgttttgggtcactcaaaaaatgaaaaggcagctataattaaagaaaacctcatggatatgattcttcacctgaatttttaaaaagataaataaaccacagactaaacataaattttgctaagcatattcaactactgaaaataccatacgacaacagagagaataaacatatattcctttaaagaaaagaagtgagttgtccatatgttgtaagggatacatctatatatatatacagattgtcttgcacatttaatgtgtgcgcagaaatgggtcaagtagattatttttttcatggtggatgaaagtaagatgtgatgagacacacttgaatggggattggcaagatttttaaagattataagctttgcgttttcatataatctaccatcctgcaaattcacttctgagtatatattaatacccaagagaaacttgagcacatatgtcaaactccatcagtgaaaggccaccaggaacaccctggtagtcaaagttaagtggttcaccttactgtagcaaaggagaaagtaccccagaggaaccttgggagcatcttagtaaaggggaattatcagtggcttcctctagggtttggggaattgaaacaaactgaagtttgcccagaagcagcagtcactctgagaaagacagtgatagtcagaagaaaggggtgtttagtcatttgtagggtcacagaatggctttgtttatgccttgttctgagtattgtttatgttctagttgccagtagagccatgttttactttctcacatatgtaccaggaaatgtgtataagaacattcatagcagcaccattcatagaagaaaatttaaaaatttaactaaatggctattgataggagtacatataaaacttaaaaaggacagggaatgatgaacatgaggttagtagttggttacctcttacgaagaggtagagatgggataaaagggggcacaaatttgtaagttattggtaatatttacttgttgggtttatgcctgttatattatgaaataaatattataaaataaaacagaatttaccatggatgacagtgagtcatgaaccaaacttataattaatctacctctgtgacctgaggtccacattattttaaaacaaacaaaaaataacaataatcattcatatttacgtttccttctcagccatacattttcttttctacttagcattttccactgtgacacagtaggtgccagttgtgtttatacagaagctacaataaacaagactttttattaaatgcaaatgtcaccacgcagtagaatcaactattgactttgtgcaacctctcatcaacagaaccatcaatacgtctagcaaggcacaggatttattgtctatgcacacctttcagagggcttcctgaaacacaactagcttccataattggtaaccaaataaaaccgcaggccaccagaagcagaatataactctctctaggaagctgtaaattaaagggagatttgtctaactaaatgtacagtgctgcactcacatgggcatttcatctcttgctctttaatggaggcagtccttgtacccctacttcacattacgaatatggtttcatctctgacagaaaggccagagcacctggcagagtcctcacatgctccctccttttaccttttccattgcattaattaattagaactgtctttatattcagtgacatttgattttgaggacatttttacaaaataacaacaccaggtccaagttcactacagcaataggatctacaagaacccaaagaatgaatgctttttagcaaatgagaacacaaagtcacatgatctttatttttaaaaagctcataaactatgtcaggcaggggaatcacattgccagacaccataaaacaacatataattaaactctagcagtccattagaagacctagtgacaagcccttctccactgctgcaacaaaggtgggatgatttacatgtagactgggaaaagtcccatgatattagaccaaaatccagcactgctgctaatttttttagactgaaatgtgattgcccaatattaaattgttaccattagtggggaaaaaatagcttattctaacaaatacttaatttctctctagctttggtgcagtcctgacttgtagtttattctaataaataatttaaaaataattttggtcacctcccatatgatccaaagtaatgctatttgagatcaataggactaacattttctatctggtatccatggagttttttatccaatgagagagaacattcaggaacttagcctgtctcatggctgaaaataggtagaatatgttaggtgtgcgtttgatacaatctgtaaataaaaggcaaattataaaagttcccctccctgcagagacgaagtcccacaatagggtgcacaagctgcatttcaacccccacccacacctcagatatgcatcttcattcagtgcacagaagactcaactgtaggggcggcctggatacacatgccatgtttcttccttgcccacttggtgtcttcacatccccttccccttaaaataatcccattagttgaaaagttcctggatacaaggagcagccatcaaagtccatggatggatttcaaggggatgaattcatttaacattattaaatgtttactttgctaattctcaatacttgtacacaatataagacatgatttcttctgtctataatatgaagtctgtgattagagtaatatttcaatttttggtttgtttgttttgacttggaattagcagtaggataccaacttaagtcaaatttactagttctcattttccctaattcagcatttgttttcatctatagaattccttttcttaagtcaggctctttggggtcatcagccccctgaaatcatgtgcaaaatgggatgcctatgtgcacatgcctctttctgtgaggatcggtacctgagaactttgatgccaagttaaaaagactgtgccttgagtttttgacactagggaatgaaggaaagtatgagataaagaatatacaacatctgccacaactactgcatattttctttctatatcacattcaacagtttattacaatcaccaggcttttcattcccataaagcaatgttcagacttcaaatgtgctaataatttagctggagaatttgagaaaactacacattcctctccaacacccccacccccacctccttagccccaagaatcagatttcatcactctggaagagaactcagatatctgcactttttacaagtgcctcatgtgattctgaggcaatggtgagagacccaagctttgaaaaacgtgccatgatctaccatcaagtaggaatcatgtacataagttcttccattagaggaaaaaataaatgtatttgtttctttgtaaagataggacgttggaaattttcacttagattactctgtaagcgacaaggaaattagaaagctcgttttttacaataatcactgttacttgacagttcctgcagcatgttaagatggctgttattgatgacacttattaccttttcccatgcaataaaacacaggaacatacagtggaagagataagtatattttaaaacaacagaaggaagaaaaataatggtagtcatgtcctctcattatttgtgtagactgactaccatggggaacagtgaaatgccttttttaaagttacactgtggctttaaattgggttaactcagtgaggatagccatgaaacaagtggctatagagatgtaaagaatgggctatttctctacatttctcttttgccttttattttccctatggtctttaatgcatttctctttggaatggatgaagttataaagttgccttacataaaagctttgcttgaaagattggtaatcacgcactttgctactgaattgtccagtctattcaatctaaaaaaggctcttctcttttgttcagctcagattatctcctttgcagagtgtaatagaaatatctgggtataaaattgagaaattgttcataaatattatggaaggctttttgagctgtttactattagaggcctgatttagcaaacagtaagcctgcttttgctgggttgggattttttattttttaactttttccttttaactgaatcatccacagttaaaaaaaaaaaaaaaagatacagatttcacagcactttcacccatgattagagcagaagaaaacaaattgctttttttttttttagatggaggtttgctttgtcgcccaggctggagtgcagtggcgcaatctcggctcactgcaacctccacctccagatccaagtgattctcttgcctcagcctcccaggtagctgggactacaggtgcatgccaccacgcccggctcattttttgtatttttagtagagacgggggtttcaccatgttagccaggatggtctcgatctcctgatttcgtgatccgcccaccttggcctcccaaagtgctgggattacaggcatgagccactgcacccagccacaaattgctatttttaagagacagttttaatatcttgtactacatttggagaagaaaaaaacatcagcactgctatcgcctataggcaactttcttatcttgccatttctttatttaaagtctttgcactgaaccagccaatgaaatgcattattctactggccagcgttctctagcagaaacaagagacagcatgcattactgagaagtcagacacatttgcactaaatcaaaaaataaaaataaaaagactctctagctagaggttaataacacaactcaatcaaaaccagtgacattttttatcaaacagtcgtgaaattgccatttggaactctaacttgctacaaatagaattaaaagtgccattctaattctgtctccttgtacaatacgaccctgatatggaaaacaaggtgtctacactgaacacatccagtttacaagagaaaaaacgggatgattttttgattctctcaaatattaggtaagtgtttaacacatgactcctgagtgggagtgccagttaaagagttgtagtacctgtcaacgctggtttaacatttcaacaaagcaaatcatcaattaaaactcatcagcaacagtcatcctgttaattgaccaaatgattatccttcttttagttaagactctacctgacacacttgaagaaatttttttctctgttgtaaaccctctggagtctgtggcacacctcaccttggcaaaccactttggttttcagattcactggaaagcccctctttgttctaagaggggctcctgaatgaaagccaagttctagtctgactttctgattgcttcttctcaggtttttttcttgcttcctaccaggagaaggaaaaaggtagtcataggccatctgttaaacttgtgtttaaagggaagtaccaaggtatggccagctggatattttactcaacatggtggatcatactcaaggtagtgtataaatggtttagcagtgaattccaccccatacttcttggggtaacatctatgctatcaagcccttaaaaccaaatccaactagctctaaaccataaacatatattatgattcaagcatttgcaggaaaaaaattgtgcttcagtataaaactttgcttcatctagaatataaaggatcccatttcccaattaccatattatcagattctgattctatgaggactaattttcaactctgtaaattatagataaatgataacaatgcaaaataattcttgcctataggcaagcaaattgtgttctgttctctggaggttcaattaatccccctaccccaccctcagaaaccagttttgccctccatttgtaacattcttttcagtattcctgatatataaatgtgtctgggctttttggattctctttagactagttataatatttggctggttctctcattataagttgacctaatctttaacatgttttcattttatatcagtatgagagtcatgatttcacctttatttgagaattattctttaatacatgtatagatcttggactaaggctatcaatttcgagacttcacttgtaggactgtgctgtactcctgtctctcacactctctgcacatgccatttcccagcctggaatgttcttccctcctccccactccagcttctggacctagttaattcctaatcttcactcagatttgggcacaattatagcctccataaacaagcattgcctaactacccctcctctctgccaagaagtttagatctccctgttatagttcttgcacttaacaccattgacatttatctgtctggattttctgactaatgtctcttttcctcactagaataatgctcgctgatggtagggaccatatccggttttacataccattgcacccagttaggtgtctggcacacagaaggctgaaacaatatttgttgtgatggggttcttgacacactaccccaaaatatggcatgtcggcatttgacaaaacagtggaagcaggaaagtctctctgaccttctcccacacttttcccctgaagcaggccataaaagaaatctctagccttcctctaaagtgggtcataggccttattcaagaggcacccttcctatgcctggaggaaaggaatgtcattatctctgaaggcacagagataaagagaaaaatctgaataaagaaggcttgctaagttccccccagtttattatctttagatcacaccccctatgtccaatcatacttctacacaactgtctgctcttcatcaaatttagcataaaaatatacaagtttccctgtttctttgagtcttcctttctccatgtcacataaaacttatactaaataaatttatgtccctttctcttattaatctttcttttgttataggggcctcagccattaacctggcaatggaaaagaaaaatattttcttctcccttgcagttgcgtacatcagcaacacagtagatccatggatcagtgaacaaattgggctatgaatattcctattataaatcagaaaaacagatctagaccaaagctgaccaaaggagaaggaaaaggagagactgcattttgatgtaagtgttactgatttgaaaaaccatggagatcgatcacctactacaaggtccaatggtattccagattctagaaaagacctagataaaaatataaagtctctgaaagtcctctcatcttctccaaagagtcctaaaatccaaaagaacctaggatttctgggtattttgaacctgaacaaaggcaaagcacaaaaagcatggtatagaagaaggcttctcaaagtgtggttcccagaccagcagtacctcttggaaactctcaggcctcatctcagacctactgatgaaatcagaaactctggaagagggaccagccatctaggtatcaacaatcgcttcaggtgaaactgatgcttgttagagactcattggcatagaacaaagatgggcctcaacaaagatggaatcaccagactccactgtaaatagctgtgaaacactgagcaagttatttaagttctctaagcctgagtttacttatgaggaaaaatggggataataacaacaaaaactatcccacagaaatgtggtaagaattttttttttttgtttcaacttttattttagattcagggggtatataggcaagtttgttacctgagtatattgtatgatgctgaggtttggagtacaaatgatcctgtcatccaggtactgagaatagtactcaacagttagcttttcaacccttgcttccctccctcactcactcctccagtagtccccagtatcaattgttgccatctttatgtctatgagtacccaacatttagctcccacttacaagtaagaacatttggttttctgttcctgcattaatgcacttaggataatggcctccagttgcatccatgttgccacaaaggacatgcttttgttctttttttatgactgtattgtattccatggtatatatgtaccacattttctatatccaatccaccattcataggcacctaggttgattccatgtctttgctattgtgaatagtgctgcatgaacatatacatgcatgtgtctttttgataaaatgatttgttttcttttgcatatatcctcagtaatgtgattgctaggttgaatagtagtcctgttttaagttctttgagaaatctccaaactgctttccacagtggctgacctaatttacattctcgacaacagtttataagcatcctttttccccacagcctcaccaacatgtgttgtttttagactttttaataatagccattctgacagtgtgagatggtatctcactgtggttttgatttgcatttctctgatgattagtgatgatgagcattttctcatatgtttgttggccacttgtatgtcttcttttgggaagtgtctgttcatatcttttgcccatcttttaatagagttacttgttttttgcctgttcaaaaaattttgagtaatgtctataaattgcctagaaaattgactgacaggctgggcacagtggctcatacctgtaatcccagcactttgggaggctgaggtggacagatcacccaaggtcagcagttcaagaccagcctggccaacatggtgaatctctgtctctactaaaaatacaaaaattagccaggtgtggtggcgcatgcctgtaataccagctactcgggagactgaggcaggagaatatcttgaacccaggagtcagaggttgcagtgagctgagatcgagccattgcactccagcctgggtgacaagagtgagactctgaaaaaaaaagagaaagaaagaagaagagagagaaaattggttgacaaagaatggatactaatgaaataatagctgctattgaatttatcattcatgtcagtagcagcagcagcagcaccatcatcaccattaccatcaccttgtctagattcttaaggcctggaacccagggttggaagaaactgttgtccttttgcctcatacatcagcaaagcgtgcatagggctcttaggaattgggcaggaggaatccaaatttgtgcaccattactgtcttctagctgatgccaccgttttttgtcagtcatttatactaaaatatactaacttagataggtacagaatttaagaggttacacaagcacttagcacacatgctatctgatcttcacaaacaacctgagagtagttatttaattcagagaagttagtggacttgcccaaagtcacattgccagtcctcacagtcatctgaagagccagacttgaatccaggtattttgattccaaacctagtgctttcttctctactcctcgtctatacttctgttttcattataccaccttgccaaggaaacaaacactcaccagacacactgtagagtaaaatagacctgacatcctttagagttcttcttggatcctggaatgtggttcttattgtctctacttacaaacctcacatttacagaagcaggctgtatttttttaacaccttccttattagcaataattggtcccttctgctgtatgtttgtttgatttttaatacacacagttcaagattaactcaaatctgttcaacaccaatctttctaaaaaccaactttccaaatatccacttgtaacacagaaaactgcagatcgtctttcctgcttccaaaatacagtcactttcataaatgttgtccattcattctagcactgagtgttcataaagcacctactcattgctaggcactatgtgaggcaatgggcacacaggtgtggtgtcttaagtaagacaggtgtggtgctttccatcctggaagtgtgagggagtctggcaataaaaaaatcaacaaataaaagaaaatagccacaggttagagtaagtgccattgcaaagcctcaacaggtaaaatgatgaagtagtcactcacattttcttcaggggctggagaagcccagggaatgactccagacagggtggtccaaggtccacttctcactcttcagataaaaacacaaacaagcatatcttgacacagaaaatctaatgtgaaaatccggtaagtggaaatatgagttgacagaatgggtgatttagaaacggattatctactttaacatgagaattcgatacaggatttttcttgagcactttcctaatacaaatacattttatatttatatccctattaaatatatactatatttaatataaatataaaagttggatgccatttataaaaattcaattaataacaaaatgaaacagctactgccaaaaacttgcatatacagacgttaaaagaaatacggggctgggtgctgtggctcatgcctgtaatcccaacacttagggaggctgaggcgggcagatcaattgaggtcaggagttcgagaccagcctggccaacatggcaaaactccatctctactaaaaatacaaaaattagtcgggcatgtgcctgtagtcccagatacttggaaggctgaggcaggagaatcacttgaacctgggaggcagaggttgcagtgagctgagactgcaccactgcactccagcctgggcagcagagtgaaactgtgtctcaaaaaaaaaaaaaaaaaagaaagaaaagaaaagagaaaagagaataaaagaaaaggaaaagaaaggacaggacaggaaaggaaaggaaaagaaaagaaaaaagaaaagaaggtaccaagaggtggaaaggaacagggagaaagaaaacagttattcaatgtttttggaggcccaagcacagggttttggcataatttatttagtccataaaacaactctgtatttagggatcatccacattttacaacaaaggaaacccaatttcagtgaggtgagattatttgtccaagatctctcagctggtaagtgacaaaaccacaacataaaaatctgatctatatccagtaactatatcccatccattctataaagcaagaattggcacaccacagcccacagggccagacttggacagcagcctcttgataccaccacaaattaagaatgatttttacattttaaaagcactgaaaaaattcaaaagaattatgtttcatgacacatgaaagttttataaaactcagatttccataccaataaataaaatgccattggtacacagccacatttacctactgtctagagctgctttcaaattgcaagatggtgttgagcagttgtgaaagaatcagtagggtcccaaggcctaaaatacttactgtctggccctttacaaaagaagtttgctaacccctgaggtagagaaaaggatccatagaaataaaagtaacaaacactctcagaaatgtgacttcaaaaatgagtgacaaaagtatgcaaaaaatggctataaaatgcacctgaaagaatttaacctaatggcagttgcctgaggcacaactttctcaatttcacctgaaggtttcatttttctggccctgtgtcccagtgaggaagacccaagtcaaccttgtgacagggatttatcacgtcttaacttgagcaatgctgtgttcccaccagcactctcagaatggaggccacacaatgtctccactcctgcattcactggctcaacttggtttctgaagaatgcgaatttagttcaaggcacggtttcaagctgtttttgttgatttcccactatattgtcttctctaaatattttctggttcaagtgcatacgctcaattatgaaaatgaattcttacaaacaacctgatctgggcggatagttaactcacaccatgaagctcaaatttgccagtacagggaaaggtatttctttttcttttcagtcttcaggctacaaggttgaaagccagaagctatgtgttataaaatgtccctagtttttcccatgttttgtagcacacatattgatctctatgtctttgccatttacttgtgtgtggtcatccccaattagtgggttattttgtacttttcaaagttaaattctaagtcaatacttagggcgtacacctaagtcaaagatggcctccaccttgaaggaaaaaaattattacatttcaacgaaaacctacacatcatctataaacacactctttccagctgtctgactctagccttgtacaatgtctttgagctattttgcaccacttcgtaagttgtagataactgatagatatatataaattctgtcttacaggctgtgattttaattgacttcctactgtggagaaaacagttttatctcaatttgcaactcatcttaactctcttttagtccatataaatttgtgccattttgacttttcctttgagccagttataacatctgcctggttctctcaaatcatataagtaaaataaaatctttagcatgtgttcatttttatacctatatgagtcataactttaccttttactgaaaattatattttaatgacccaaaagattagtaagaattcagatttatttcaaaatctatctttaaaaactttaaattttgagtgatttcacctttaatatgaatttagttggaagtaatattaagttagtttaaatcatatagaaaaatgaaatgtgatgagaagtgaacttctttgttcccttttattgcttttaaaatgatacaagacaaaaattgtgcagaggggcaagaaacaaatgttaaacaaaaattattctgacatgtgttaaaatggtaaggaagactttattaaggactattgcaatagcagtattgcaacaggggagagagatcaggttcaactccaaatacaacaaagatagatagtcagggatttatagccagtgttagagcagataaggggttcagtgggtagaaaactactaagaggagtaagggaattcttgctaaattaattcctaacaggattcttgctaaaggcaggccaatgacttagacatcaagggtggggtgagaaacttgattagacatcacggtgaccagctatcacttaaaaagattattgctaaagccaggctagaaagatcaaatacaggaatgaggtctggggccaaggtcgctagttgagaaaagggctcagaggagtataattaaagtttgggcaaggagaaaatcttcatcataggtaatagcaaatttataaaaggacaattcaattcaataaatcttgtcctcaaggaatttacaatccactgaaaagagataattaagtcaccacaacctggtcaaattaccttggttttactttgcaattaaattttattcccatatgaatctatatgtaaataatctctttaaagaaaacaaataaaatgagaagttaaagttatttctatctctgtaatctttattttaacctttattttaacttcaggggtacatatgcaggcttgttacagaggtaaacatgtgtcatgagggtttgttgtacagattatttcattacccacatgttaaacctagtacccattagttatttttcctgatcctctccctcctctctcccaccctccaataggccctagtgtgtgttgttcccctctatgtgtccatgtgttctcatcattttgctcccacttataaatgagaatatgcagcatttggttttctgttcatgtgttagtttgctaaggataatggcctccatctccatccgtgttcctgcaaaggacatgatcttgttctttttttggctgcatagtatttaatggtgtatatgtaccaccttttctttacccagtctatcattgataggcatttaggttgattccatatctttgctattgtgaatagtgttgcaatgaacatatgcatgcatgtgtgtttataacacaatgatttatactccttcaggtatatagccaagatttttccataatcccactggtattagatacccaaaaaaatcccattggtattatatacccaaaaaataccaatgggattatcagattactggaccaaatgatatttctgtctttaggtctttgaggaatcactacactatcttccataatggttgaactaatttacactcccaccaaaggtgtataaacattcttttttctccacaacctcactagcgtctgttacttttttagcttgttaatagtagccattctgactggtgtgagatggtatctcattgcggtgttgatttgcatttctctaatgatcagtgatgttgagcttttttgcacacgatttttggccgcatgtatgtcttcttttgaaaagtgtctatcaagtcctttgcccacttttttatggggttcattttttccttgtaaatttgttaagttccttatagatgctggatattagacttctgtcaaatgcatagttcgcaaaaatgttcttccattctataggttgtctgtttagtctgctgatagttccttttgttatgcagaagctctttcattatctctataatcttaatttatagactaaaatattaatttgaaaatataccaactaaagtgtatcacacacctaaatcaaggattttataaaatacactaaaacagaaactaaacatagactatttattcaactttcatataagcaaaagacaccactattggccaccaacctcactactcccagcctgtgaaacaggatgattatgggtatttgtgaaatctaaacatcaccactcactacattaaaatgaaatggcaacaaatttccacaagtctttttactcaaagtgtggtggcccaacccagcaatctgggcatcacctggcacttgttataaatgcagaccctcaggccccacctgctgaatctacattgtaccaagatccccagaaaattcttatgtacatgaaagtttgaaaaccatggatccagaagtgtgtgaaaacataactactgccagaatttttagcatattcccttattcatctcttttttatgaaactaaacgtagtggttttgctgatagagatggacgggggaaaagaaattttgttgtgaccaaagttgctgcattttttgcctaggggtggacctaaagtttcatgtcaatcattttgttttgtgagcaaaatcaaagtcatggggaaaaaggagagggtgcagaaagaagaaaattgtgaatacatagaattttatcactggaagacagaaaacaatctcaattatatatatagtatatgtactcaatacagtaatggttaaataaaccatgacacaactatgcaagagcatatataaagacattaaaaataacaaggtcatttttcatgtaccaagatgcagtgatctctaatgtaaacttagcttaaaatatgcaaggggaaaaatgcaagggcagcacagcatatataatgacttattattcatgtaaggaaaaggacataagtgtgcatatgcatagaacatctctggaatgacacacaagaaagacacacaatggttactgcccagaggggagctgaggcacgagggacagaaatggaaggagactgacatcccactgtgcatcttttaacatcttttgaattatgtgatagtattatccaattaaaacaatattttaatctaagcattgaagaattcctaaaaagtagataaaatacagttactaagataataaaggaatcccttcttcattttccctcatagatggttatgtgactatgtccaaacactttctgtgagttacagatctgagaagttgtgtctaaaattcactgacactggagcttaaatccacgtgcctagaatgctcctcactgcccccacacaacccctgagagcccccactgatgccagttctctctgcaacacaaactaagcctcttcctgtctcagctgtgaacacatttgcagaaggctattgtggttttccttagtcaggggtcagaatggccagcaggggcaggcaggtatcctaaacgagtaaagcaggcctagccaaaacaaagtgagcctttacccctccacctgcaatgaaacagggcagcaactattctgctccaaggaaatactaccatggaggagacagggccagatgttgccatgtcttcccagggatgtcagaagctgctaaatttattttaaataccttgatttaaaaatgttaatattttaattttttaaaaacagtttacagaccaaataaaatacatgtgcagctagatgtaacctagaagttcataatccatcctgtcatctttcgtgtgtggaaccatgaacatttctctttttgttattttctcattggagctgctgaaaagaaaaaaaaaatctctttttaaaaaactcaaacagctatattttggagattcgacaatttactaatctatcactccaaaatgtgctgtataatttatttgacagtcactgtgcttgcctaagaactaaaaataacctcattgtatgtgtgtgtgttgtttctaaagacctgtggtatttattattgttagaatgctttcgatgtctttggtggtatgaactgtgaggtatctctgaaggatagcatttcactgtatttcacagaatatacatatacagtccatcaaaactctgggggttatttgcaaaacatagttctcattttccaacaagctttcagcggaagaaagtttcatagaaaaaaatacaaatttcctaccactctactttgtgagaacctaaagagactgttaggttataaaaaagaaaattgagggataaatttaacacttaaaagtgactcttctagcaggaggtttgggcacccagccagattaaggagaagtagctttatacacacatcttaacagcagtctgaatatcaaatcttcactactctttgcttaaagcccagtacctactgagtcatcccagccagcatgtcccttctaacttgtcatcctgtttgttatcactctatgccctctgcagtactctggactttgaatgtgagattactttatttaagtgaactgcaattgaaaaaagaactcttttgattgaatcttgacctgcagtaattgggaacttatgtaaggaccccatgatactcatattaaggggagtgtgggaggatcccactactaaagcctggctgcagaagagggataatggaaactgcaggtgttagaaaggtaccaacatacatcttccccctatagtacatggactcagtttttacatatggctatgctttctattctgcttaagtaacataaaaactgattaggaaactcaagatcttgcactacatataaaatctgcatccattgcttatggtctaaagtaaatgcaacaactgacaattcttacagagtctcaaaaccaagaaccaccatgataaaacaattatactgcaatgctgaggaaagagacatttaattacagatataatttatgtgagtaagcataatcattttaaatttctaaataaataggcatgtcattaaatataaagcatcaggaaaggatttcaaaatctgtatggttcatctgcgttggcaaatttgatctattcagagtttactctgggcgggggggacctcatgattccatctttatggcccaactgttgattaacttccaaatgaaaatgcttgattcagcatgtattttctgtaagaaaggtatttttcacatgctatagccaggccaatctgtgtcttcaattgttgttaagacactagtatatctttaaatcttttccacttattaatttcagcagattatttgtacacatttctcaggctattctgatatttcaaatgccttgaaaatgttgtagctacataaattaaatgggcaattaagatgtcaccatgcaattctatacaatacatacttgcaatgggatacttgtgagggtaccattatccaaactgtcctattcatcagcctttctagaactttagagatgggagtcagtcagctgggttccagtcatggtgaatggcatgcaatgatctcgaggaaaccacaaagcacatcttcctatgtttgcatttcctcatctattaaatgaagagaagacctggatcctaacaggacgtctgcgaaaccctcacgaaaggttaagaaaagaataaagaacatgacaaaggtaaggtttacatgctcttattgtggcagaagggaaaaaaaagcagaaatgcatataaatacctcacagtttgtcacacaaagcacacatttaaaaaacaataacaaaaaacaacaaaaataagcaaccaaaaataattaacagtagttcaagtaatttaaacctgtattctctcctgaagaaataccagataggtaaaatatactcccgagccaccacaaactctcctaaaatccctttgtccatttctgccactttcaacatccatcttccacccagatgccagcttgaccacctcccccatcaaagtcaccagactgagctctaggaaagtcttcattaaatagtgaacacatgacatatactatcaactcagcttgaccttacaacataggtgctatggtttgaatgatggtgtcccttccaaacttaaatttaattaattaataattaattaaattgttgaaacttaagccccagtgcaacagtattgggagatgtggcccttgggtagcgattaagtcatgagggcgaggctctcatgactgggattagcacccttataaaagggcttgaggtcaaaaggagtactctcttgcccatgtgtccctcctgccatgtgaggacatggtgtacttccctccagaggatgcagcaacaaagcaccatcttggaattagagagcagccctcaacagacaccagtcctactggtgcattgatcttggacttctcagcctccagaactgtgacaaatttctgtggtttacaaatgaccaagtctgtgatattttgctacagcagcacaaacagcttaagacaatggataactaatctaagttccaaaactagtgggcttttgacatgccttggaagtagacagataaagcagtagccaagatcttttctcatctttgcataagcaaatcgtaattgacaaacatcagtatctcagagcattcaacaaagtggcaataagtaaatagataactgatgaacatacagaatcgaaaggctgacgtgggtttcaggtttctctgggttgtggggcatcccatggccaagtactgaaactcttccttgaataactatctccagagtttgagccattgaggctcttggtgacaaagacaactgatatgcttggatccatcaaataacatatcagcaattcatgccccactgatagtagaaaagtgctgcaatcattttattctgaagagagcataaagatttacaccacatgtcaaggctagatgttgttctgccaccaggaaacttgctgtgtgagacacacaaaaaattaaacacctcaagaaatacagctttctggaaaacatcaatacctcttctttttattgttacatttttctaatgaatctttcactgcaacaacttatgcagagaagttatgtatcctggaattattctactttttgataaccatttttaaagctttatactttataaagctttttttattctcccaattcacttaagaatttgcaatatccacctcgaggttaacctgaaactcaatttcacagctaattccaactaaacgtcttctccagctttccagatgccatctaaccagttatattctcactgattcagcagcatattcaaagagacagagaagaactgacatgatgctgatgaagcttaaacttcagggtccctgttgcatgggccctcagagtgccaagagtccttgggagtccgtgttctagctgagaggaaacatgaagaggcatttctctgtaagcatttgtggcaaagagatcttgaaagaaagggaaccggccgggcgtggtggctcacgcctgtaaccccagaactttgggaggccgaggcgggcagatcacgaggtaaggagatcgagaccatcctggctaacacggtgaaaccccgtctctactaaaaatacaaaataaattagccaggcatggcggcgggcgcctgtagtcccagctacttgggaggctgaggcaggagaatggtgtgaacctgggaggcggagcttgcagtgagccgagattgcacccctgcacttcagcctgggcgacagagtaagactccatctcaaaaaaaaaaaaaagaaaaagaaagagaaccaaatcatttcactgaatcattttgaaataaatactcacctttgcatctaattttgtattcataatcttttcctctttttcttaaagaggacctcccaaattgtatgagcttccaactccactaaacctgagtctgcctgatacaagggaaggcatgtaaaaatacttcttagtttatactctccactgcgcaagttttcaatctataaaaaaactcctgatctttaaaaataaaaaataaaggttggggagagggtagtaaaaagttactttaaatgtatatttttaagaatgctgatttcattatgtattttccaataccaaaatataaaataaaatagaacctgcagaacttttggctctctgacatttctccccagtgacttaaaactttcagatgaatgggacatctgggttctgagaagaatggtgtattattactgctctccacaatagcaggcctaaatggatttttcatgtttagactagtaaacataaaaagcaaacctatctcacatgactgatacgtttgcctttaacaaaacaaccccggccaaaaattattagaaaacagatcagcagccccactggactctgaagcaatgtaattaggtagtccaacactacattttgtcaaaaaattctgacaacctaataaccagattgtcatcagatagacattaaaaaatgataccaggtttgctccagcattaaaataccaccactttctgggttttttttccttctgtaaaaataaaaattaaaaatctatcagtgatgcatcccattggtctggatggtgtttaaatgagtctgtgccacttgaaggatggcaaaggaagttttgttttgatttaaagtttaagaaagaattcttcttaggaccacctgcttaacgttaatcacgaaatccctatgtgttaagaggggtaattataaaatggaatgataataacaatagtaaccggcagttattgagtgtttagattgtgccaggcactgggtttcattctgttgaatgaaaccattactggactcccaacaaccttgatgagaggtgctactctcaccctcattttcagaggtggaagggaggcttatcaaggctaaagaatccacttgcacacccaacagaggccacctcatgctcttaacctctgcaatgtgttgctgagaaggtggttagtttggatttgacagggtgaggtggtgggcattggggataagaggtgttattttcaagaaaaccattacgtatgtggccttccagaatatagtaatctagtatgtagtctggcctgtaagccaaattttatgtatagtgtgacactgaagaaaaaaacgttgtaattataggttaattcacacagttaatgcaattaaatagaaaaaggtagaaaccttaagatatagccttaggttcaaatatactctagcctccatttaattagtcaattataaaaaattgtccactaacctgtacaagaataaacctcagggagtacatttctaagatgacctttggaaccctagtatctgaaaatcttaccattttatctattaggatataaatgagttatctggtataaatcactgtcaaatttgcacaaacaaatggtgtggctgacagtcagtaataattcaatgacaccaattttttccccaacatgaaaacaccccagattactcagtcagccatgccatggctagatttgcaaggcactataaagtttccaaagtatttgtccaccacgtgattttgtttgacatccacaagcctacattatttctttttctttttcttttttttttttttttttttgagacagagtctcactctgttgcccaggatggaatgcagcagtgcgatcttggctcactgcagcctctgcctccttgttcaagcaattctcctgtctcagcctcccaagtagctgggactacacacatgtgccaccatgcctggctaatttttgtatttttagtagagacggggtttcaccatgttggccagaatggtcttgatcccctaacctcgttatctgcccacctcggcctcccgaagtgctgggattacaggcatgagccaccatgcccagccaagcctacattatttcttaaacacaaaaagatcattccgaatttcacaaacaatgttgagcaaaatatgccacacacaaagaagcccataccgtatgattctatttattatataaaattagtccaggcacagtgacccacatctgtaatcccaacactttggtggctaaggtgagaggattgctcgagggcaggggttcaagaccagcctgggcaacaataatgagactctgtctcttataaaaaactaaattaaccaggtgtggtggtgcatacctgtggccctagctacttgggaggctaagacgggaggatcacctgagcccaggaagtcaaggctgctgtgagctataattgtgccactgcactccagtctgggtgacagagcaagaccctatctcaaaaaaaaaaaaaaaaaaaaaaaaaaccacccaaaaacacacacaaattcaaaaacatggtaaaaccaatcgcagatgagtcaagatagtgacagcctcagtggaagcaagcatggtagtgagtggaagatggcatcagagtgtcatgttctacctcttattctagatgctggttccttaggcatgatgactttgggaaaattcatcaagatgtacaacttggatttacaagtatacaaatcctatagcatgttatgcttctacagaaaattgacataaaacaaccattctctccctttcagtttgctaactagaccaagaagaaaagatacactgagaaagagggtgggcactctgaaaacactgagaagtttgactttacaaactattgagctactgacagtcttgttaaaacctcttagcgtgcctttccctcacggcatcaatttatatagcaattcactacattaattcttgtaatgaaagtgtgaggagatctgtagtcaatcataattgtgccctgcaaattccagaaaatgtttgctgggatgtaagcctctgatggctggctcagcaagtgatttagagcaatgtggtgaactttcataataacagctcattaacaattgcgtttaaaatgtaaacaattgatatgtttttagaaacaccagtactgattaggtttatttcactttacaggaagtcagaagataatatgctaagcagattttcctttcttccctctcaacgataaattcaataatagttaggttagacctagttttgttttcagtttccatgaatgagaaatgtgaagaccatgggggttccaactcagtctctcttctccagttttgtgtttaggaagcacagacttgaaatgtattttgcatgtcttccaagactaaataccgaggttatgtttgtgcagctgtctgaataaaactgatgctacctcaaaaaataagttgattcagtcacaaaaaagtaccaagcaaagtattaattgatttaattgccctgcttttatttaaagctagacaagaactatgggggagggaccttatcaatgatgttaacagatatatatgtatatgcccagcacctagccaaattatagaaagagcatgggaactgcttaatgatttgctttaccagtcaatctttatgtggagtggggcatagttaatgatagtaatcattttaggcctgagttcctttaaattatcaatttaatatttttattaaatatatgcatttcaagtacatttatctccgttgctttttcgactaaaaaataaagacaaggaattcaaatgtttggattattttccctcactcataccaaatacaaggaaagtaaacataatgaagttaaagtaatattcttagcttgacaaatcacatattggggacatgagaagcctaaattatctgaagtcaattaattgttctttgtcaacggaaagaagaatttagctcccaaactggataaaatcccagccaagtaatgaccaataatggcaataatagtaacattatatttttcctgtctcttgattatcaacaatcaagaggctatagcaaataaatatacaaatatatactgtgaaaacatcaatatttgtatctacaagaaggatgaaaaattaactttgtgtagtaatatccctccactgtatttaggaaaagacaatacaacagacctctaagaatgggtgttccttctggtacttgaaggaagcacacaaacaaatatattatggaactggtggggaaaaaaacagtcatccagaatcacagggctgaagagagcccaggatgtcacctggcctgtcatgtccagaatactaacaagtttcatttaattccagcatcacaggctgctctgatattccctgggttccctctcctggctctgcctaaagacagacccaaagaccaaaaaaatctaccatgtagtccaagtcgtctaatgctagcaagcccctgaatcttgccacatagggcccacttataattgcagtaacatgtctctttcctagcctaattactattcttggagaaaaatctctctttgttttgacaatttttcctatcccttagaaaaaatggttcaggaatagattctagtattatttttcatacatgaaataaatattctatttattctattacatttctgttctataagtgtatggttagatgactgttactattctttctggctactggacataccaagtctggtttaaatactctaaccagaattagtccatgccaacataagcatttaatgagaaaggatcctggggctacatgctccatagtcatgtgaaatcggatactctgaaggggaaataactttctctgaagtgtaaccattaactgaaagagaaagcttggtgtggtatgagtcatgggtaacatgggtgaatcacagtcctgatgggcaggtggccatctctgaagaggatttcagaaatgctctccccaccttgatcaattaaattctcttattaggatagaaaacattgtattccacggttaaagtatgaaatgcctacataaccagataaaatgacacaactgttccaaaagttcagttatttacatactcctttcatgatttgtataatatctatgagccagtgttctatattaatacaacatttctctttaaatcaactcaattctgccagtctaaattacctttttgaagaagacaattttatatccccactgtaaatatccaatgtcactggtatacatattgtatatagccaatatcacttgccataaatagaaggaaactgaaaagatttcatgtgactaaccaaaaatgtattcattcatctcatctcatgtaccacatggaatactgtaacaaactggtttaaattcatactagagagtaaatgaatgatagaattctcaacacccctccatcctgtcctattaatgagattaaaggttgagggaccaccaaaagaggtaggcagggccctgagaacctgaaggagcatgtattcaggatagggggtatggggggtggggttggatgtcacaagctatgagaagtaagggtacaaaagagcagacagtagcccacttcatgattatttatatctggggctgtccctgaatgtgtcatagaggaagtcctctgtactgtttgatttgaaggcccttctacttctatgcaccatctcttttagacatccacatctgagctcacaaattatccatcacaaagaaatcacatgctgttaataggtctcttcattgtggctgacagtgcaaaacaaatgccagtccctgtgctgagatacagatttctggaatactaactgggattcccaatgtggggagacacagtagtagaggtcactccaaggactcctggaacatgctcctgaattctgttgcttcttgccatacttgccacagagtgccgttatgttctagctctctctgggtatccttctctccaatcagattctcaattctctcatcatctttctattgctcttaatacctagctctcagcaaaacaagtgcccaatttatagaaaaagcgagtaagtgactctgaatgaatcaaccacaagtgaatgaatgaatgaaaacagatcagctttgcagaaagaagcacctgcttacctaaggtatatccccaaattatcccaacctcatctaaagttatcagggaacacagcacaaattcattagcatcctgctgccttttcagagaaatgacaggttcttctccccttgcctgatcaaaagatttgctgcactctctctcttaaaatgcctccttgttacaaactgtgcaatcttggtcaacttacctaacctctctgaacatctgttcccttacttgttaaatattgaagaacaatatctgccccatgaattgtgataaagattaaatgagagatttcaagaaaagtgactgtagtatatcaaaagccaaaaagccagctacatttttggaccagatcacaatgccatgataaatatcaatggaataatggtccacaatgtcacaccacatgctttcattctgctgtcctcatgacttccctgtttgccagcatcagggtttttcacgtttacaaagaaaatggagcaggttagcaggtctcggtggcattaatgggcaaagcatcatgggcaactgttgttcataaatgctccttctcaaatgtatcctgggttggtgatgaccacaattcatttccattttgaagcgccctccattttttacttctttctcagtctgaatctcctatacttgtaatactgacggagcttcgctagtttctaaatcagaaagatgagcacgtgcagccacaggaagagaaatctgggacctgatgcctataatatttttcagacagagaatattcccccagtgtctctacccaggagatagtaaactactctgacatttcagctgttgcccctccaagcagattcacacacctcttcggctaacatcccctttgggcaggcatctactcatgtttacagttattcattatgactggctatacacagacagtgcctctggtgtcaaactgaatggccccttagacccccattccaagacagccagaggatacagacatatattaaataagacacaggcaggaaaactgcactgacttccttgagatggggaggctgaagccaaccaaagctgacctgctagagagtcctccagagctccagtgtgggatgactcacagcaaggagcacgggatcaaaatttttgaggtgcttcagggtcagaaagttttccagaacagcttctgcggatgtctgtgaacaaatatgccagcaaggaaaaagaccaactattttgcaggggaatcatcttgaaccagaagggccagcatgcattctaagtgccagggcaagttcccaaccctctgagctagctcacatctattgtgattccacacatctctccatggaataatctgtccaagaacacacaagcagagaagtgcccttctccatctacaagcatctaaatgtagagtcatgagagaaggtgagaggcagtgacttcaagaggtggcctctagacctcagaatccactctaatgaacacgctgtgtttaaacaagggatctcacattttctcaaaaggcagttagacacattcacatacttaggagtgaatctaagaactctagaaagaacggcacatttccctactgacacagttgtattgaaaaatcaatctgtggctctaagggaaatgagaaaacacaactggtgatttctagcacggcatccaatcttcacttttgtgatccctcaattctcagttcaagtataaatagactttttcccccccacgaagtaggaaaaggattaagtaggcaggacattttctaagttctgtgtagcatatgttcataagctttccttttgtagcatttatggattcattctggagtagggttaagccggagcaaagcaatttggcatgcttgcaatttgctttatcaggagaagcaagcacagactgcagaggccacctcgacctgagcagcaaagaagcttcccagaaccctgagggagacactgattattttccttacagggatgctcaagctgagccaacctccttgcaaaatagtcaatgagcttcattcagattatcctcaggaaagcagtggccaagcagacacaagtgatcatcatcatacgaacttaatttctgaccaaattccacaatcacactgctcttcctgaagtcagtcaggcagtatctatactgctacacaaacctcagggtcagcattccaatccatcccagcctaaggatcccattcagcagcagaggtgcttttcaaatctgtacatccacttcggtactttctatccacatgagagaacacactgcagcaggagatgaggatgcagtaggataattcttaatgttcacaatataatgttgaatggaaaaagcagtatgtgccattttcttaaaatacatgcccacataaagaactaactgggaaaaaaacacccagaaatgtcacttggagtcatctctgggctgtaggattatacacaatttctattttcttctcttagctgaactggtttccaaatattctaaaatgcaaatgcattacttttataatagtaataaagtaattctaaagtgatttaaatatatagactgtgattctcaaaatgcaggagttaaagaaaaaaataaagacatagactgaaccttacaaaaaagatttttatccacaaaacaaagaagcattttcattaaaacaatataattaacctgcaccattaggaaagaactacatcatatttcacattcaattttgttattatcaccatcactacttcttaagcatctgctgtacacaatgccctgtagcgggtataagtactcaaaaataaaccaggtggtaactaagttatttacatcactgggactcttccagtgttattaaagttgaagaacttgaaaagcagcatttattaataacaggggcattaatccagctgcctgccctgtactccacttacccagagagtctctcccagtcctgccaagcaagattaagtagaattaagacggcagctaaccaggtagaccttgtgccctgggccacaggtgactctggcaagggtgggcgcctgacctacatcaaaccattcagattctttcccccaggaaggaggaatacagttagtctctatcatccccttgaatgaggcacagggagttgcacgggtagccatagctggctggatatgcaaagaagccagtctgcagacagaagaggtgagaggctatgaggatcctgagacagtctcctgctctttaggatgggatgctgagagatatgtttgtccatttacccatcccactctggttagtttttgagggtcaaccacttcctggcctaaggcttcaggaagctcaccatctaaccttttgtcaaatgagtaagctatcctgtggccttgtagaagcctcacctttcatcgtttttgtcactgtttcttttgtattggttcttgaaaacaaattatctctaagacatagttgcaagattcagaactctgaactctcttcacccactccttacaagctgaatccctcctcctgtccttcttttcagatcttaacttaaacgtcattaactctgaccgctccaaatgaggaggcctgctatgttttgcctcttgatgtttcctaaataagatttacataacttttaattgtatatgctttgttggtttactagttctgatctgtctccttccctagggcataaaataatctgcccgacccatgttccttgtacctcacacagcacattcctagcatattacagaagatcaatagtattgaatgcatcagtcagtcatgtaggtgagtgcatattcattcactcaatatacaaataatgattgagcacttgaaatctgcaaggcttagtcctttcttgataaggaactaaggaactaatgattcaaaaaggagattaggtacatatgcaaagacaagaacatagacacagcagacactgctgagggcctgtcacacagaaatttccctctttgacaaagaaggccattacaccatggtaaagggatgaattcaacaagaagagctaactatcctaaatatatatgcacccaatacaggagcacccagattcataaagcaagcccttagagacctataaagagatttagactcccacacaataataatgggagactttaaaaacccactgtcaacatcacacagatcaacgagacagaaagttaacaaggatatccaggaattgaactcagctctgcagcaagcggacctaatagacatctacagaactctccatcccaaatcaacagaatatacattcttttcagaaccacaccacacctattccaaaattgaccacatagttggaagtaaagctctcctcagcaaatgtaaaagaacagaaattagaagaaactgtctctcagaccacagtgcaatcaaactagaactgaggattaagaaactcactcaaaaccgctcaattacatggaaactgaacaacctgctcctgagtgactactgagtacatcacgaaatgaaggtagaaataaagatgttctttgaaaccaatgagaacaaagacacaacataccagaatctctgggacacattcaaagcagtgtggagagggaaatttacagcactaaatgcccataagacaaagcagaaaagatctaaaattgacaccctaacatcacaaattaaagaactagagaagcaagagcaaacacattcaaaagctagcagaaggcaagcaataactaagaccagagcagaactgaaggaaatagagacacaaaaaacccttcgaaaaattaatgaatccaggagctggttttttgaaaagatcaacaaaattgatagaccgctagcaagactaataaagaagaaaagagagaagaatcaaatagatgcagtaaaaaatgataaaggggatatcaccaccgatcccacggaaatacaaactaccatcagagaatactataaacacctctatgcaaataaactagaaaatctagaagaatttgataaattcccggacacatacaacctcccaagactaaaccagaaagaagttgaatctctgaatagaccaaaaacaggctctgaaattgaggcaataagtaatagcttaccaaccaaaaaaagtccaggaccagagggattcacagctgaattctaccagaggtacaaggaggagctagtaccagtccttctgaaactattccaatcaatagaaaaagagggaatcctccctaactcattttatgaggccagcatcatcctgataccaaagctgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatacaaggctggttcaatacactcaaatcaataaatgtaatccagcatataaacagaaccaaagacaaaaaccacatgattatctcaatagatgcagaaaaggcctttgacaaaattcaacaacccttcatgctaaaaactctcaaaaaatgaggtattgatgggacatatctcaaaataataagagctatctatgacaaacccacagtcaatatcatactgaatgggcaaaaactggaagcattccctttgaaaactggcacaagacagggatgccctctcttaccactcctattcaacacagtgttggaatttctggccagggcgatcaggcaggagaaggaaataaagggtattgaattaggaaaagaggaagtcaaactgtccctgtttgccgatgacatgaatgtatatctagaaaatcccaacgtctcagcccaaaatctccttaagctgataggtaacttcggctaagtctcaggatacaaaatcaacgtgcaaaaatcacaagcattcttatacaccaataacagacaaacagagagccaaatcatgagtgaactcccattcacaattgcttcaaagagaataaaatacctaggaatccaacttacaagagatgggaaggacctcttgaaggagaactacaaaccactgctcagtgaaataaaagaggatacaaacaaatggaagaacattccatgcccatgggtaggaagaatcaatatggtgaaaatggccatactgcccaaggtaatttgtagattcaatgccatccccatcaagctaccaatgactttcttcacagaattggaataaactactttaaagttcatatggaaccaaaaacgaccccgcatcaccaagtcaatcctaagccaaaagaacaaagctggaggcatcacgctacctgacttcaaactatactacaaggctacagtaaccaaaacagcatggtactggtaccaaaacagagacatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaagttaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagcacttctgcacagcaaaagaaactaccatcagagtgaacaggcaacctacagaatgggagaaaatttttgcaatctactcatctgacaaagggctaatatgccaaatctacaatgaactcaaacaaatttacaagaaaaaaacaaccccatcaacaagtgggtgaaggatatgaacagacacttctcaaaagaagacatttatgcagccaaaagacacatgaaaaaatgctcatcatcactggccatcagagacatgcaaatcaaaaccacaatgagataccatctcacaccaggtagcatggcgatcattaaaaagtcaggaaacaacaggtgctagagaggatgtggagaaataggaacactgttacactgttggtgggactgtaaactagttcaaccattgtggaagtcagtgtggtgattcctcagggatctagaactagaattaccatttgacccagccatctcattactgggtatatactaaaaggattataaatcatgctgctataaagacacatgcatacgtatgtttattgtggcactattcacaatagcaaagacttggaaccgacccaaatgcccaacaatgattgactggattaagaaaatgtggcatatatacaccatggaatactatgcagccataaaaaatgatgagttcatgtcctttgtagggacatggatgaagctggaaaccatcattctcagcaaactatcacaaggacaaaacaccaaacaccgcatgttctcattcatagctgggaattgaacaatgagaacacatggacacaggaaggggaacatcacccactggggcttgttgtggggtggggggagggaagagggatagcattaggagatacacctaatgctaaatgacgagttaatgggggcagcacaccaacatggcacatgtatacatatgtaacaaacctgcacattgcgtacatgtaccctaaaacttaaagtataataaaaaaaaaataaaataaaaaaagaaattttcctgtttcacctcacaggtaaagccctgtgctggttaattttctgtgtcaactcaactgggccatggggtgcccaaactaaatattatttctggatgtgtctgtgagggtgtttctgggtgagattagcatttaaacagaaggccatcacccagtttgttgaacagaagaaaaggaggagaatggagaaatttgccctgtttctgcttcactgtgtgagctgggatacatgatctcatctttgccggccctcagactgggattatgccattggctcccttggttctcaggccttaggacttggactgaattacaccaccggctttcctgggtctccagcttgcagacagcacatcatggaacttctcagcttccagaatcacataagccaatacctcacaataagtaaataaaccaataaataaccttttggttctgtttctctgaagaatcctgactagtataagccccagttttattagggtggcctccctccataaagctatgtactcaagggaaggtgagattatcccagaaaagagataaaacccgattagtttaaaacagggaaagggttaacagctgctctgatatccctttagctccaagggcagctgggcagacccagagcagccagagaccccacacccatgccctacacacacacatcagccactccagctgtgagcagcctcttctgattgcttaacatgccggccaaattgtattttctatgtgcaccataacaagaacaaagttgggaagcaccaatctaagccaccagggatgagccccattccgcgtgccagtgtctgatttaggaaggagcatgggactgcaatcaactaaatgagacttaaggggaagtcagctcaggggttacaggaacagttccttgcttttaaaaagggacatataagaacagatattttattttgccagtggatgttgccatgtctgcctgtagctcccaaaaaggaaccagccatcttagaactatgaaggcagccagtctaagaactaagtcaacacactgaagatggcacaggaaaaagagcaagaaatagacactttggtaacaatgttgagccactgaattaacaaaacttgaaactgcacccctcccaggaggtcttattccctgagataattcatttctcttattctgatgggtttttatttggtggattttcaaatgtaacttggtagagcaattcacaaaataattgacagtgcttagcaatctgtcaatagctgagtgctcaaaatcctctccctgctacacagtgacaaccatcaaaggcaccctggtgggtccccagttgcttggcaaaagtggattgcagttagattccagacatttggagccaggattctataatgccttcccatcaatcatgacatccctggggcagcaggtagacttgcagagggcagggagcttttttcttttaattcccctattgtttgaaccatttcaagttgactttttgattatttgcagccaaaggcatcttcggtgataaatccatcttcacataattagcagcaaatttatgtggcctcctttgagcaaagactcaggagaaaatgatgcagagattcataattccacccacattccccaaaatctttagatgatgggtcttcagtgaattctctctacaaaaaaaaagacaactgagatgccagaaaaaggattaatcatgtgatcatctgacacttatcatgggagtcataaagtaccacacaaatggtgaggcatcaccttgtctcagtgttgaattaggggcagcataattttaaaatatcaatttgtactctttgttatccctcctgtgtatactgttccctttcgcatctcaaaaacttcaagactttgccttcttccctttgtctcccagacatattcaaacgcaaaagatgctaaaagacaaccaccaatcccctaaatccagtctccattaaagacttttctttttcaaaaaagcctaaattcattgaagggaatgtgttacatcccagcagaaaggtccaaaataaagacaatttgggttgttttgttttgcttaaaagtgttgttctttgatctgtttaggtgggcacttggagtacagtaaggattgggctttcctggtattggagagaagctggagcagttccttaaagtagtggacgctggcaccctgcttcctggcagaactctagagaggtgacaggacttttgatcgggatagtgatgggatactgggaaaatgactaccaaggccttgaagccacagcgaaaatcccagccttctttgcacagatacaacaggactacccaacaatgcatggacaagaagcctctcatggtgaccagagtggactaaagttcagggggcctttttaaaaatgttttatgctataacagacctgcagcatttttgcatcaatgaccttaagtgagcagacactccaaacaccacttagaacttcccaacatttagagaaaaaaaaagtaaccagttatgcatgtatgcatgcttgcaattcatgcagcattcaaaacaatttttcagaatgaaatctttaaatcagagtgcacactcagtttgtatttttagttgatttgacacatcatgagcaaccacaggattccacaataccaggccaagttcccactgtagggatggaaaggtgtgatacctttcctcacctctcacaagagtcacagccaacattcctataacaaaagacaggtcagcaagagaaaagcataacaaatgtatttaatcaaagttttatgtgacatagcagccttccgaaatgaagacccaaagactaaaggaaaatagtttttatgcttaggttcagtgaagaatgcacagctgtgtagaaatgtggtagaacaaaaggggtgtgttctactggaaatagaaaatagattggcggtggtgggggtggtggtggggatcagcaaggcctgactattcagattcttattggcctctctgtgtaacgttctttcttcccagtatggagcagggcctctatggaatgaggatcttcaaaggagaaggaagagagtgacttttctaggtttaatggcttgctgtggggaagagacattctagtttctatgacccaccttagggaagaggaattctggtttatacgacttgcttaaggggaggaagagaagtaggagacagtattatgggagactgccacaaagaccttggttctgagggctttccaatgtatttccttcagttcaaagtactcaggatgctaaggtaccatactttgggggattgggttctaagacccgacaccactagttatttaatattttccttcctgcaaatcctgctaccttaaaaaaaaggaaaactaactgtacaacaggtagttctgtagctaatgagcattattaaatattttcaaaacattccaataaaaggcaataccaaacggcttttatcctaatactttctaaataacgccacattcatttatgaggaattgcatttccctcaatgttctgggcattaatgaagattgaatataaataaaagaattgccttatatgtatagcactttaaagagttgagattcccaaataatacaaaagcattttcaagtcacacatggtatgtaaagtgaaaatgttcttgaaggaaatatcctctaataatacttacctacttcagagggtgatgggaagctctattaacaccaaaagaacacttttagatcttcaaataaaagcactatacaaatgcaaagtattattattatagttctgaaataatttcacacctagggatgagaaaaccccaggccaaattttattgcttctctcatacgtgataaacaagaaatgccataagcaaggggcgaggggggtggttagtggggggtgtgatagtgggggaagtggaaatcaaacagaacaaagacttcaaagtttctctttcactaggactttgtatttgcccagatgtcatttagggaactctcagggaagaaagaaaaaaaaaagtcccttaaaggtcagagttaagtacagggacaaagttctcattgcttttgtaccagataaagcaacaaccggctgagctgaaaaaaaataagcttgtctacttctatgggacataatttctcccaaagcacttctcaaaaaaaaagaaaaaaaaatggccagatgaattattactgaatcacccactagtgtgatgatctcacctatgaagtcaaaaggtagctgctttaacagacaccaggatttctagtcaattactgagagcactgagcaagacatgttattgctgatggtagtggtggtgatgatgatgaagatgataatgatgttgatgatcatgattgtgatgatggtaattacggtaatgataggatatggaacagaagttctcaaacctgctgatcaatggaatcacccctagagctttttacaatacagatttttggttctccacctcagccccactgattttgaatctctgaagatagaactcagaaattttttttaagtagccatcaggataactgaagtgacagtatttgtaagtaatataatgattaagaatgcaggctctgtgaacagactggctggtgtcttctcccagttctaacacttactagctatgtgaccttggaaaaaatacttagccttaagtctcaatttctacaactataaaatggaaatactaatatgacccacctatgaaattgacatgctattactacctaccttataaggtagatgcctaaagtaggcaaatttttttaaaagcacatattaattccaagaaagacaaaaaattttatattaaagaaaacataacaaataccattcggcttagcaacagaaaaaaattacgtaatcatgataatgtaaatattacctgttgatttaaataaaaattgtaatataactatgtcaggaggctgtggggaccagaagtggtaagagtggaaaggatcagagagctattgctaaaattgataaattaggaaaaaataatataagtacattatttagaaagagagaggtgaacaccagaaatatcagaatagaaagttgctaattctgggaagcaatccagagagaggtagaaagaaggcatagatgttgcagtttttaaatatttgctatttaatgctgttttatttaaacaatgtagatacactgctttgataaaaataaaaataaaatgtaaaaggtaatttgtaatgcatataagtacaatatggtatttctttatacactgaggctactataaagcttttcaatttaccaaaacttgcttttaaaaaaaaaagatataatatctccaactatgcaatcaaaatgtccatttcttaaaagtgtacaataaagacttactttttacctggcacactctaaatcctaaaaagatatttgctgaattgggctgaggatggtggaaaaatatataaagaacaaagttcctttgtacaatcaaggtcacagcaggaaggagatgacatcttcacctggggtgaaggcagggttaagggaagaccactaagggatggtctagtgtgctggacttagcaaaaattccattaacactccagactcaaaggggaaaagggaagaggcagttaccagacagtagaaaaagctgtagccgctgaagagaggcccccaaccggaactgtggccttccttagagggatacagccattgccaacccacaatgctgcagggaagaaagtagggaagaatatttcaacctcgtgttcccaggtcttcatccagttccttcccctggctaatacaacagaaagccagcaaacaagggagcccagagaatgcctgcgatagaggttaggcccatggtgcagagccatttagaagagagaggagctggaagcacaaatgtgaatacccagcacaagcactatacaaggtggttgttgctgttgtcgttgttgttgttgtttaatctgtctctttttcctactcagcctcctaaaacaagcccctcaaattttcatctgtttaagaaatattcatggcatgatagtaataaactgatgttatgcatttgttaaaatttactaagcactttcatatatattgtcttcatgtgatcctcaaaacagccctgtgcaataaatagggcaaaagttatcctcattttacaggtgaggaacctcagatcttaaagaaagttaggaatcttgcacagagtcacaaagctagcaaatggcagagccaaaactagaaggaatgtttcctaataccccagctaaggctcttccttccatataatactgtcatgctatttattcacagtaggagtgcaaaattgatatacctgttaaaaaaaaattaacaagttttgttctaggcactgcacagagcacagaagtagtcaacaaataagacacaaggggaaatagagaaaacttgcccattccattctcattctacattccacaagcaatgccagaactggaagtaattgagttttcaatcacattttacacatcattgaaaagaaggtgctcagtagggtaagaacagtgttcaaatgagaaataaaaattcagggaaaagtagacaaatgtctaaagaatatacctgttgtgtttggggttgctgggggtaaaccgaagaaaatctcagtcccttaacaatccccatgacacaaagagaccagggccccagaaattgggagggatgacttctccgcttctcttctcatttccagctctacgcccacatacatacaccttctttgagagctaagagaagcagccaagagtgacttttctgtaccaaacacaggagtactgggaagttcagcaaaataacccatttttgagagtctaataaagaactctgtactttttgtaatctactgcaaaacactgagctacttacacatgatgaaagaaagtaatgagtggcattttaattgtaaacctccaaacataccatatttattccagatctagctcactaatgaatagactatactatcaatgagggttctgtagttgcaagcagaagaaacaaattggctaatttaagaattattggaaggatactggagtctcagccaatccatggcagaatggaaaataaggtttggaggccatgactactagccaagacagacatggaggcaacagtggtctcatagtacatgttggcagatcagaatgcccacctaggacaagggagaatcctttagctaaagaatcaaattccaaagaaggagcatttacttagccaagcttgtggtcatacacccatccataggcagggtgcaggcccctgagtagggcccctggttacagttccactagcctaattacctcaaaaagaaataaagatgctgttaggaaggaaaaacatacacgacagaaaaaaaaaattggtgggggggttccctctatactaccaaggctttctttaaaaattcttgaagaagctaactagcagtagactcttaatttctcaagactattaactagtaattgatgacaaccaaggaaggtagttttcctaatacctacaaaacttcagcctaataacttttcacttccagaggcctcacttcctgtattacctgaaagttaccttttcatttgattcctaaggaccaagcagaattttcccttctttggtagcaacatgcttattttagaaatattatcctgaagcttctaaaaagaatagacttataaaaatgtataatgaataaattcataaagatgctgttgctgctgctgccgccgccgatgatgatgatgatgatgatgatgatgatgatgatgatgatattaataagagcagtggcagctcacatctactgagcacttatcatgggccaggacttctaagtccttgacacagaatacttcatttaattctccacacctacatgaagccaaaaacagtattatccccacttcacagatcaggaaactgagactctaagagggtgaataagttgtccgcagtccaacagctagtaaaagccaaatcatgactaaacccatgtctgattccagagtaccaattcaacaaaagattttcattgagaataaagaaaatggactgtgcctgtgtggaaacattccccaagaggaaaggaagcaccatatctgtgccaaaagattacaaagttgttaagatggctacatcaccaccaaatccaattattcatgagcatttatttctaaaagctatcaagtatttctttattccaagatgtggctcaatggtccagagacatgtagttgtatggccaaaaataagaattatctactgcttaagatagtaatttcttcactgatgttcaacaattatggcaaaattccaagccaaccagttttcatgcaccagagtttagttgccccaaagcaaatcctaagaaaagaggatttttttataactcatatttttattatctaaaaggggttttctccaatatccctgtaaaattcttctttgccctccaaataaacatgaaaaattcagccccagaaatagatttgtcaagaagttaggaagaacttaaagtacatggtaaatcaaaatggcttttcaactttaactaaagtggtcatagtaataattgctgcaataaaaatgacagaaaaaaaccctaaaagtatcaaaaatgtaatttatgatgaaaacaaatgtaaaattatagcatatttcaccctggccaccaaagactcttgatgaaaccgcagccctataattgcccagaatgaattctttaaattaaaatacttcatgcagaacagaaattaaacaatgaatcaaagaacaaagctgtacagaggtatgctcataaatatacctagcaaagaggaaacaattacatttttccatgtaaaaaccaacttgattgtaatgtttcacaagagaccgagtaggtacttttcccattgcttcaagcttggaagttcatttcctgtaattcatttagggctcagagtgactgggtggaatgaaattagatacaccaaattcagtggctcttttctttctacaaaactggctcttccatgcaactgcacaactgactttcacaataaatttcattcaacccaattgaaatgccactctgcattttattttaaatgctttatttggccagctagttttatttaactattggccagaagtggtacaagtgcattctttttccatctagcattaatcttagtaaacttagctccattggaatgtcttagctgctgagaagaaagcaaaagtcagcaagcatacaattgcatttgtctactctcaacacatcattttatttcctcctgctctctgctaactattgctcagcacttttgcctaagagggaggacaagcaggtggttaaggaagttgtcctgtcagctatatctttagtccaagtgtttaaatctctgaataaaagaaaaatcaatgttgtaaaggcaatgtttgtcaaggccatgtaataaatacacttacctttacagactgttctcagtggatttctcttctttcctgagcttcaaagctacaaagacataaaaatgaaagacagagttgtctgtgagtacaacaacaaacattttctccccatgtctctaaatagaatttccatatgccatggtatatggtgctagccaaataaaccattgataaaacttgtgcctcatacctcccgcacaagaggccaaaaaaagacagtcagaaactgaaaatggtgcacacatctacccagaattgaagcacacaaaccttggccaaatctacagtcaaatcttttggagtgtgtactcctcaacagaatgggaacggcttatagcgagatgaaaatcaaattaaacatgagtgtgacatactcagtctgactaagcattttattttcttatttctttttgtcatctttcttgcatgctctatttccatttctctgaaaaagtttcacttagggatgcctattccatttatatgacatgcatggtccttctaatataaacctcaccacttgctccgtaagtatatgtgtgcatgattacagggacaatcacccttcctgtatgtagactgcagccttctctcggaagaaactcacaaaacagaggaagccacaacttgacatttcaaatcaaatcttgttaacttcagctctctgtgatcaaaacataaatactatgcactgaccacacacaaatcaatgtgacaaaagatctgcaaaagcaacagtaataacttacagtatcgtgaagctggttctttaatcatccaatcttactcataaggtgcctctacagtcaccagtaatgggaatatgattctttctctcatttttggctaggtcctaacatctccgaaaggtgcagtagttggggatagacagctacaccacagcttttccatggttctttttttttccttcaatatctgaagggattgttttagcttttactgggctgtttccctccacatccctctattccatcaaagaatgcattaccactgatgcatgaccaccaaagaacaggtcagacttacgggctaagatgtaaatttcagactattaatgcaggaggtaggtcccttctatgggacagcatcagaaatttctccttccccctgagctacaccgtttaccaatgagtttagaacaagcagagtttggagaatattagataaaatagtgtaatattgcatttgtgaaatctaagagatgaataatctgataacatggagattgagctgaatccctttccacttcaaacacagaaatgctaaacaaaatacaataatgacttaaaatacatatatgtgtgtgtatgtgtgtatatatatgtgtgtgtatgtatatacatatgtgcatatatatacacacacatgtacaaatatacatacacatgtgtatatatatacctacatatatatacacgcacatagatacacacacacacacacacacacacgcacatacacacacatatatagccaagcccaaaagaaagagaaaaagccgtctgggaagtgagaagcgcctctgctcagccgccaaccatctgggaagtgaggagcccctctgcccggctggccaactgactgggagtgaggagcgcctctgcccggccgcccaactatctgggaagtgaggggcccctctgcctggccgctgccctgtccgggaagtgaggagcgcctctgctcggcagccgccctgtctgggaagtgaggagtgcctctgcccggctgcccaaccatctgggaagtgaggagcgcctctgcccggacgctgtgcaaccttccaagtgtgaagtgacagccttgtgtgtgatcttttctgttcttccccaagtttgcatttttgacattaaagtttactttttcgttaaaaaaaaaaaaagagagagagaaagccaatataaaaatatatggatgtagagtttctagaatgaaagacatgagtcctctggaaaaagtataacaatatctcaaaaagataaataaaagcaaatgcatactttcatatatcagaatgaaaccacagaacgcagagataaaaataaaatcttaaagtcaaccagagagggaaaaaaaagagacttctagcaaaagaacatgtcattagcaaaaatgaaagtaaagcaacagtgcggacactgtgtctcacgcctgtaatcccagcactttgggacaccaaggcaggcagataacctgaagtcaggagtttgagaccagcctggccaacgtggtgaaaccttgtctctactaaaaatacaggccgggcgcggtggctcactcctgtaatcccagcactttgggaggccgaggcaggcagatcacgaggtcaggagatcgagaccatcctggctaatatggtgaaaccccatctctactaaaaatacaaaaaattagatgggtgtggtaccaggcgcctgtagtcccagctacttgggaggctgaggcaggagaatggtgtgaacctgggaggcggggcttgcagtgagcagagatcgcaccactgcactccagcctgggcaacagagcgagactccgtctcaaaaaaaaaaaaaaaaaaaattagctgggcgtggtggtgggcacctgtaatcccagctactcaggaggctgaggcaggagaatagcttgaacccaggaggcagaggttgcagtgagctgaaattgcaccattgcactccagcctgggcaacaagagagaaactttttctcaaaaaaaaaaaaagaaaaattatatgcccatgctaaacctaacattcaagaatgatagagaacaatagataaatcagaacatttttcaaaaaaaaaattgtttagtgctcacagtagtttacttttgccaaaagaaatactaaaataagatatgcttgaataagcgggaatttatcccagaaggaagcagtgagaaacaagaagcaatagtaaacagagaaattagtaagcatgatggtaaatctggtaactttaataataagtaatgggtattgattaataattattaagctctacttgtaaaaaaacaaaacaaaacaatttttagcatttgccaataaagtgaaactgagtggtttatcacaatcatatggaataaagaagggggtaataaattgtttacaaggaggagagaaatactacttaaggcattaaagatatgcactaaaactactgattaacttgttaaggataaccagcatttctttctctgtctatataagcaaagaggcccttacacatgtactcacagagatttgtacaatgtttacattctacaaatgtattgccaggatggcaaaaaatacagaaaacaacccaaacatctatcagcaatacgataaacactttttttacatattcttagaatggagtattatataactttggaaaatcagtgaaagttacccacatcaacatagatacctctcaaaatataatgtaaaacaaaagaagcaagtcacagaaagctatacatattattctatttgtataacattcaaaaaggcaaaaataaatactgtgttgtttttgaatataaagtataagtggtacaaaacaaaataaagaaagggaagaaatttacacagaattcaggctatctttatcttgagagtgggagaggagatggaatacgtgagaggaatgggggggcttctggaatatggtaatgatctgtttcttggcctagaaagaggtatctggacaatcagtttattattttctttaaactgtatatgtacacttgcacaaattattttgcatgtaggctctatttccgaattttaaaacatacaagagtaaccaccaaaagaacagaaatttccaaatcaatagaggaaacaacatagagtaaacgcaatcgattctctatacaacattgaaatggaagggagaaagaagcaaaggaaaacacgctgaatagaatataaaaaagaaaatattttaactaagtccagctgtgtcaggaatcagggtaagtacatctgttaaaattttatcaaaacgaatgttttaaaatcttgctatgtgttgtttataagaaacaaatttaaacataagttttgaaaagaaaagtgtggataagtacacaccacggaaataggaaccaaaaaaaagctgacggaataagttattgttaggcatgacgaaagttagcaataatagaagagaaagtatttatattctttttttaaaattttattattattatactttaagttttagggtacatgtgcacaacgtgcaagtttgttacatatgtatacatgtgccatgttggtgtgctgcacccattaactcatcatctagcattaggtatatctcctaatgccatcccacccaccccccgccccacaacaatccccagtgtgtgatgttctccttcctgtgtccatgtgttctcattgttcaattcccacctatgagtgagaacatgcgctgtttggtgttttgtccttgtgatagtttgcagagaatgatggtttccagcttcatccatgtccctacaaaggacatgaactcatcattttttatggctgcatagtattccatggtgtatatgtgccacattttcttaatccagtctatcattgttggacatttgggtcggttccaagtctttgctattgtgaatagtgccacaataaacatacgtgtgcatgtgtctttatagcagcatgatttataatccttttagtatatacccagtaatgagatggctgagtcaaatggtatatctagttctagatccctgaggaatcgccacactgacttccacaatggttgaactagtttacagtcccaccaacagggtaaaagtgttcctatttctccacatcctctccagcacctgttgtttcctgacattttaatgattgccattctaactggtgtgagatggtatctcattgtggttttgatttgcatgtctctgatggccagtgatggtgagcattttttcatgtgtcttttggctgcgtaaatgtcttcttttgagaagtgtctgttcttatccttttcccactttttgatggggttgtttttgtcttgtaaatttatttgagttcattgtagattcgggatattagccctttgtcagatgagtagattgcaaaaattttctcccattctgtaggttgcctgttcactctgatggtagtttcttttgctgtgcagaagtgctttagtttaattagatcccatttgtcaattttgtcttttaatgccattgcttttggtgttttagacatgaagtccttgcccatgcctatgtcctgaatggtattgcctaggttttcttctagggtttttatggttttaggtctaacatttaagtctttaatccatcttgaattaacttttgtataaggtgtaaggaagggatccagtttcagctttctacatatggctgccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctctgttcttttggcttaggattgacttggtgatgcaggctcttttttggttccatatgaactttaaagtagttttttccaattctgtgaagaaagtcattggtagcttcatggggatggcattgaatctataaattaccttgggcattatggccattttgacaatattgattcttcctacccatgggcatggaatgttcttccatttgtttgtatcctcttttatttcattgagcagtggtttgtagttctccttgaagaggtccttcccctcccttgtaagatggattcctaggtattttattctctttgaagcagttgtgaatgggagttcactcatgatttcactctctgtttgtctgttattggtgtaaaggaatgcttgtgatttttgcacattgattttgtatcctgagactttcctgaagttgcttatcagcttaaggagattttgggctgagacgatggggttttctagatatacaatcatgtcatctgcaaacagggacaatttgacttcctcttttcctaattcaataccctttattttcttctcctgcctgattgccctggacagaacttccaacactatattgaataggagtggtgagagagggcatccctgtcttgtgccagttttcaaagggaatgcctctagtttttgtccattcagtatgatattggctgtgggtttgtcatagatagctcttattattttgagatatgacccatcaatacctaatttattgagagtttttagcatgaagagttgttgaattttgtcaaaggccttttctgcatctattgagataatcatgtggtttttgtctttggttctgtttatatgctggattacgttaattgatttgcatatgttcaaccagccttgcatcccagggatgaaacccacttgatcatggtggataagctttttgatgtgctgctggattcggtttgccagtattttattgagggtttctgcattgatgttcatcagggatattgatctaaaattctctttttttgttgtgtctctgcccagctttggtatcaggatgatgctggcctcataaaatgagttagggaggatttcctctttttctattgactggaatagtttcagaagaactggtaccagctcctccttgtacctctggtagaattcagctgtgaatccatctggtcctggactttttttggttggtaagctattacttattgcctcaatttcagagcctgttattggtctattcagagattcaacttctttctggtttagtcttgggagggtgtatgtgtctgggaatttatcaaattcttctagattttctagtttatttgcatagaggtgttcctagtattctctgatggtagtttgtatttctgtgggatcggtgttgatatcccctttatcatttttattgtgtctatttgattcttctctcttttcttcttcattagtcttgctagaggtctatcaattttgttgatcttttcaaaaaaccagctcctggattcattaattttttgaagggttttttgtgtctctatttccttcagttctgctctgattttcattatttcttgccttctgctagtgttgagtgttgctcttgcttctctagttcttttaattgtgatgttagggtggcacttttagatctttcctgctttcttttgtgggcatttagtgctataaatttccctctatacactgctttgaatgggtccaagagattctggtatgttgtgtctttgttctcgttggtttcaaagaacatctttatttctgccttcatttcgttatgtaccccatagtcactcaggagcaggttgttcagtttccatgtaattgagtggttttgagtgagtttcttaatcctgagttctagtttgattgcactgtggtctgagagacagtttcttctaatttctgttcttttacatttgctgaggagtgctttacttccaactatgtggtcaatttcagaataggtgtggtgtggtgctgaaaaaaatgtatattctgttgatatggggtggagagttctctagatgtctattaggtccgcttggtgcagagctgagttcaattcctggatatccttgttaactttctgtcttgttgatctgctaatgttgacagtggggtattaaagtctcccattattattgtgtgggagtctaagtctctttgtaggtcactcaggacttgctttatgaatctgggtgctcctgtattgggtgcatatatatttaggatagttagctcttctcattgaattgatccctttaccattatgcaatggccttctttgtctcttttgatctttgttggtttaaagactgttttatcagtgactaggattgcaaaccctgcctttttttttgttttccatttgcttggtagatcttcctccatccctttattttgagcctatgtgtgtctctgtacatgacatgggtttcctgaatacagcacactgatgggtcttgactctttatccaatttgccaatctgtgtcttttaattggagcatttagtccatttacatttaaggttaatattcttatgtgtgaatctgatcctgtcattatgatgttagctggttatttcgctcattagttgatgtggtttcttcctagccttgatggtctttaaaatttggcatgtttttgcagtggctggtactggttgttcctttccatgtttagtgcttccttcaggggctcttttagggctggcctggtggtgagaaaatctctcagcatttgcttgtctgtaaaggattttatttctccttcacttatgaagcttagtttggctggatatgaaatgctgggttgaaaattctttcctttaagaatgttgaatattggcccccactctcttctggcttgtagagtttctgccgagagatccgctgttagtctgatgggcttccctttgtgggtaacccgacctttctctctggctgcccttaaaattttttacttcatttcaactttggtgaatctgacaatgaagtgtcttggagttgctcttcttgaggagtatctttctggcattctctgtatttcctaaatctgaatgttggcctgccttgctagattggggaagttctcctgaatgatatcctgcagagtgttttccaacttggttccattctccccgtcactttcaggtacaccaatcagacatagatttggtcttttcacatagtcccatatttcttggaggctttgtttgtttctttttattattttttttctaaacttctcttctcgcttcatttcattcgtcttccatcattgataccctttcttccagttgatcgcatcggctactgaggcttgtgcgttcgtcacgtggttctcgtgccttggttttcagctccatcaagtcctttaaggacttctgtgcattggttattctagttagccattcatctaattttttttcaaggtttttaacttctttgccattggttcgaacttcctcctttagctcggagtagtttgatcatctgaagccttctactcttgactcatcaaagtcattctccatccagctttgttccattgctggtgaggagctgcgttcctttggaggaggagaggcactctgatttttagagtttccagtttttctgctctgttttttccccatctttgtggttttatctacctttggtctttgatgatggtgacgtacagatgggtttttggtgtggatgtcctttctgtttgttagttttccttctaacagtcaggatgctcagctgcaggtctgttggagtttcctgggggtccactccagactctgtgtgcctgggtatcagcagccgtggctgcagaacagcggatattgatgaaccgcaaatgctactgcttgatcgttcaagttttgtctcagaggagtacccggccgtgtgaggtgttagaacgcccctagtgcggggtacctcccagttaggctactcgggggtcagggacccacttgaggaggcagtctgcccattctcagatctcaagctgcgtgctgggagaaccactactctcttcaaagctgtcagacagggacatttaagtctgcagaggttactgctgccttttgtttgtctgtgcccggcccccagaggtggagcctacagaggcagacaggcctccttgagctgtggtgggatccacccagagcgagcttcctggtctctttgtttacctactcaagccttggcaatggcaggcgcccctcccccagcctcgctgccgccttgcagtttgatctcagactgctgtgctagcaatgagtgaggctccgtgggcgtagggccctccgagccatgtgcggtatataatctcctggtgtgccgtttgttaatcctgctggaaaagtgcagtattacggtgggagtgacctgattttccaggtgccatctgtcacccctctcttttactaggaaagggaattcactgaccccttgcgcttcccggataaggcaatgcctcgccctgcttcggctcacacacagtgcgctgcacccactgtcctgcacccactgtattgcactccccagtgagatgaacctggtacctcagttggaaatgcagaaatcacccatcttctgtgtcgctcacactgggagctgtagactggaactgttcctattcggtcatcttggctccatcccccgttttttattgacatataacaaattatccaaaaactagatatttaaaaataaaagtggtggctggcagccaagatggccgaatagaaacagctccggtctacagctcccagcatgagcaatgcagaagaagggtgatttctgcatttccatctgaggtaccaggttcatctcactagggagtgccagacagtgggcgcaggacagtggttgcagagcaccgtgcacaagccgaagcagggtgaggcattgcctcactcgggaagtgcaaggggtcagagatctccctttcctagtcaaagaaaggggtgacagacggcacctggaaaatagggtcactcccaccctaatactgcacttttccgatgggcttaagaaacggcgcaccagaagattatatcccacacctggctcgaagggtcctatgcccacggagtctcgctgattgctagcacagcagtctgagatcaaactgcaaggcagcagcgaggctgggggaggggcgcccgccattgcccaggcttgcttaggtaaacaaagctgccaggaagcatgaactgggtagagcccaccacatctcaaggaggcctgcctgcctctgtgggctccacctctgggggcagggcacagacaaacaaaaagacagcagtaacctctgcagacttcaatgtccctgtctgacagctttgaagagagcagtggttctcccagcacgcagccagagatctgagaatggggagactgcctcctcaagtaggtccctgacccctgacccccgagcagcctaactgggaggcacccccaagtaggggctgactgacacctcacacggccgggtactcctctgagacaaaacttccagaggaacgatcagacagcagcattcgcggttcacgaaaatccgctgttctgcagccactgctgctgatacccaggcaaacagagtctggagtggacctctagcaaactccaacagtcctgcagctgagggtcctgtctcgtagaaggaaaactaacaaacagaaaggacatccacaccaaaaatctgtacataaccatcatgaaagaccaaaagtagataaaaccacaaagatgggaaaaaacagagcagaaaaactggaaactctaaaaagcagagcgcttctcctcctccaaaggaacgcagttcctcaccagcaacggaataaagctggatggaaaatgactttgacaagttgagagaagaaggcttcagacgatcaaactactccgagctaaaggaggaaattcaaaccaaagacaaagaagttaaaaactttgaaaaaaatttagacgattgtataactagaataaccaatacagagaagtgcttaaaggagctgatggagctgaaagccaaggcacgagaactacgtgaagaatgcagaagcctcaggagccgatgcgatcaactggaagaaagggtatcaatgatggaagatgaaatgaatgaaatgaagcaagaagagaagtttagagaaaaaataataaaaagaaacaaacaaagcctccaagaaatatgggactatgtgaaaacaccaaatctacgtctgattggtgtacctgaaagtgatggggagaatggaaccaagttggaaaacactctgcaggatattatccaggagaacttccccaatctagcaaggcaggccaacattcagcttcaggaaatacagagaacgccacaaagatactcctcgagaagggcaactccaagacacataattgtcagattcaccaaagttgaaatgaaggaaaaaatgttaagggcagccagacagaaaggtcgggttacccacaaagggaagcctatcagactaacagcggatatctcggcagaaattctacaagccagaagagagtggaggaggcccatattcaacattcttaaaggaaagaattttcaacccagcatttcatatccagccaaactaagcttcataagtgaaggagaaataaaatcctttacagacaagcaaatgctgagagattttctcaccaccaggcctgccctaaaagagctcctgaaggaagcactaaacatggaaaggaacaaccagtaccagccactgcaaaatcatgccaaattgtaaagaccatcaaggctaggaagaaactgcatcaactaacgagcaaaataaccagctaacatcataatgacaggatcaaattcacacataacaatattaactttaaatgtaaatggactaaatgttccaattaaaagacacagactggcaaattggataaagagtcaagacccatcagtgtgctgtattcaggaaacccatctcacatgcagagacaaacataggctcaaaataaagggatggaggaagatctacccagcaaatggaaaacaaaaaaaggcaggggttgcagtcctactctctgataaaacagtctttaaaccaacaaagatcaaaagagagaaagaaggccattacgtaatggtaaagggatcaattcaacaagtagagctaactatcctaaatatatatgcatccaatacaggagcacccagattcataaagcaagtcctgagtgacctacaaagagacttagactcccacacaataagaatgggagactttaacaacccactgtcaacattagacagatcaacaagacagaaagttaacaaggatatccaggtattgaactcagctctgcaccaagcagacctaatagacatctacagaactctgcatcccaaaacaacagaacatacatttttttcagcaccacaccacacctattccaaaattgaccacatagttggaagtaaagctctcctgagcaaatgtaaaagaacagaaattataacaaattgtctctcagaccacagtgcaatcaaactagaactcaggattaagaatctcactcaaaaccgctcaattacatggaaactgaacaacctgctcctgaatgactactgggtacataacgaaatgaaggcagaaataaagatgttctttgaaaccaacgagaacaaagacacaacataccagaatctctgggacccattcaaagcagtgtatagagggaaatttatagcactaaatgcccacaaaagaaagcaggaaagatccaaaattgacaccctaacatcacaattacaagaactagaaaagcaagagcaaacgcattcaaaagctagcaaaaggcaagaaataactaaaatcagagcagaactgaaggaaatagagacacaaaaaacccttcaaaaaattaatgaatccaggagctggttttttgaaaggatcaacaaaattgacagacagctagcaagactaataaagaagaaaagagagaagaatcaaatagacgcagtaaaaaatgataaaggggatatcaccaccaatcccatagaaatacaaactaccatcagagaatactacaaacacctctgcacaaataaactagaaaatctagaagaaatggataaattcctcgacacatacaccctcccaagactaaagcaggaagaagttggatctctgaatagaccaatgacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaagagagaattttagaccaatatccttgatgaacattgatgcaaatatcctcaataaaatactggcaaaccgaatccagcagcacatcacaaagcttatccaccatgatcaagtgggcttcatccctgggatgcaaggctggtccaatgtatgcaaatcagtaaatgtaatccagcatataaacagagccaaagacaaaaaccacatgattacctcaatagatgcagaaaaggcctttgacaaaattcaacaactcttcatgctaaaaactctcaatgaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtggacaaattgtccctgtttgcagatgacatgattgtatatctagaaaaccccatcacctcagcccaaaatctccttaagctgataagcagcttcagcaaagtctcaggatacaaaatcaatgtacaaaaatcacaagcattcttatacaccaataacagacaaacagaaagcctcatcatgagtgaactcccattcacaattgctcctaggaatccaacttacaagggacatgaaggacctcttcaaggagaactacaaaccactgctcaatgaaataaaagacgatacaaacaaatggaagaacattctatgctcatgggtaggaagaatcaatatcatgaaaatggccatactgcccaaggtaatttatagattcaatgccatccccatcaagctaccaatgactttcttcacagaattggaataaactactttaaagttcatatggaaccaaaaaagagcccgcatcaccaagtcaatcctaagccaaaagaataaagctggaggcatcactctacctgacttcaaactatactacaaggctacagtaaccaaaacagcatggtactggtagcaaaacagagatatagatcaatggaacagtacagagccctcagaaataatgccgcatatctgcaactatgtgatctttgacaaacctgacaaaaacaagcaatggggaaaggattccctatttaataaatggtgctgggaaaactagctagccatatgtagaaagctgaaactggatcccttccttacatcttatacaaattaattcaagatgcattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagaatcggagaaaatgtttgcaacctactcatttgacaaagggctaatatcccgaatctacaatgaactcaaataaatttacaagacaaaaacaaacaaccccatcaacaagtgggcgaaggacatgaagagacacttctcaaaagaagacatttatgcagccaaaaaacacatgaaaaaatgctcaccatcactggccatgagagaaatgcaaatcaaaaccacaatgagataccatgttacaccagttagaatggcaatcattaaaaagtcaggaaacaacaggtgctggaaaggttgtggagaaataggaacacttttacactgttggtgggactgtaaactagttcaaccattgtggaagtcagtgtggcgattcctcagggatctagaactagaaataccatttgacccagccatgccattactgcgtatatacccaaaggactataaatcatgctgctataaagacacatgcacacgtatgtttattgcagcactattcacaatagcaaagacttggaaccgacccaaatgtccaacaatgacagactggattaagaaaatgtggcacatatataccatggaatactatgcatccataaaaaatgatgagttcatgtcctttgtagggacatggatgaaattggaaatcatcattctcagtaaactatcgcaaggacaaaaaaccaaacaccgcatgttctcactcataggtgggaattgagcaatgagaacacatggacacaggaaggggaatatcacactctggggactgttgtggggtagggggaggggggagggatagcattaggagatatgcctaatgctaaatgatgagttaatgagtgcagcacaccagcatggcagatgtataaatatgtgactaacctgcacgttgtgcacatgtaccctaaaacttaaagtataataataataaaataaaaaaataaaaataaaagtaagaatttattatctctcacggtttctacggatcaagaatcctggcagggttcagcaggatggcttttctgtatgctacaaagcctgaggcttccgctagcagacttgaaagttaggggctggaatcatctgatatctcatgccctcaaatatctaagctaggggctgggatcatctgaagactcatgccctcacatatctgccagttgttgctcagggttagctgagaccacagctagagctagcagctggaatatgtccatgtggcctctccatgtggcttgagtctcctcacaacatggtggctgagttccaaagacgagttctgagagaagctgtattttttatgacctaggctcagaaatcacataacaccatttacactgcactccactggtcaggtcagtcacaaacccccacccagactaaaagaaagagaacaacagccttgccgccctcaatgagggagtgtctgttacactgtaagaagagcacaggattggataaatgtgctgatgtgatcacctttggaaaatacaatctgccacaacattctttacaagcacatatgaaacataagcaaaaattaaacatatagtaggcctgaaagtagtttcaatgaatatcaaacaatagatatcaaaggtttcttattataatgcattaaagttggaaaagaattactaaatatgatttttaaaatatgtttgaaaattacaattttatgacagtttccctttgtgaattgggattagacaaggaccttaactaaatcccactggatgaaggtccacatctggagtcaaaagagatcactaatttggttgtggatacattgaatttgaagtgccttagagacatctaaaggaaaatatccaggtaagcagttgggtagatgggactgtagctaagaggggaggtctgagagtggtaagttatctgtaagtaggaagtaactgcagttgtgaatatggatgtgactgtccagggagtcagtataagtagaaagacaaaagggcctaggactgatccgtgagcaagttcaacatctaacagttgtgttgaggaggatgaatcctacataagagagagaacagttgccagagaagtaaaactaaatcctcaagattcacagaaaggtcaagcaatataaatactaaaaaaagcccaataggaaggtcatcgaggaactcagcaggaactgttttgtggactgatggaggcagaattcagtttggagttggttaagacagaagtggaagtcattaaacaaagacaatgagtaaagacaatcctagataagcttggctgtgactggggaggaaagagtggcaactaaaggacaaagggctggaagacggtttgtttgtatagtttttaaacagaaaaaaggccgagtatgtatcaaggtaatggagaagatctatttaagatgcagagtgagtgtagaagagaaagggtaaccagtactgaaggttcctgagaaggttgaaagggacaggtggtaggactggttttaaactgagctttggcctcaccgtaatcatatagtgtcttatgataggaacccatgctattgtcttaatgcactactttatcgtgtgtttatgttttctcaccctaattagaatctaagctctataaaatgtatggcctttattgttcaaaccaaccccaccttactcacacattgaaaaccccagattctatcccagcacccaacagtcattcaataaacactcatgtgtcacttagtaatgggagtatattctgagaaatgcacccataggtgattttgtcattgtgcaaacatcactgcatgtacttacacaaacctagaaagtgtagcccactatacacttatcctatatggtatagcctattgctcctaggttacagacctgtaaagcatgttactgtcctaaatgctgtaagtaattataacacgatgataagtatttgtgtatctaaacatctaaacatataaaaggtatggtaaaaatatagtattataatattatggaaccatggtcctatttgcagtccatcattgactgaaatgacattatgtggcacacaaccatacttgttgaataaactaatacaagcagattctatcatctttgtgtacatctttgtgtaaatctaaaaatgtgtgtgtgtgtgtgtgtgtgtgtgtgtgtgtgtgtttgtgtgtgtcctggctatccaaaatgcgagcaagtcagaacccaaaagttcttgttccagagtatagatatctagacaatagtcaggaatagccactcaaattagccctctctttcccatgttttccttgacctaaaaatccaaggatctaaactacaggccatgaaaacattttcacctacagttacaatattataccacttcccactttcctcatgcctaattcgtccatattttgttctagagcagacaaactctgtatccttcatttgacctcctgcaagacataaattaaatttaaatgaatccaaatactttgggcttcagttctcctaaaagaaataaacatggaagtagagcagtacaggccagtaacacactgatttatcttgctgatttttcagaggatagccctccaaaaaatctttacaaacctcaagcctctcaatccatggatccaaaccccagctcccttaaaaataggtctgaatttaaacaaatatctttccgaaatatagaaacctgctttgatggtgactcatcttatcccagtagaaacctttctctgggtaccatccaactgcaccattcttaaggcaacattacctggaactgagggatttgcctctattgttgcattctgcagccctcacctgacttaactgccacgttaaggaattggttattgacctttaagtctttaacaattatttacatacctaggaaagagtctgtgcattcaggtacaagaatgaagacaccgaataaattcagccctcgttttcatttttatgctacgttcagtgagctgttactgcagacaaattattgcagcattctttcaaatgatagccaattttcaactaagagaagattcttaaacccctttctaaaaccttttcctgcatatcggtgaaaaccaggcagttggaaaacacagccctggttaaaccacataataataaattaatactttaaacacatggaattatttaagaatctgcataataatttaaaccctcataagacatagcagcaaaggccccaaaaacctaacacttctcagatatattcctagaagttttatttcaatttatatgtatgcatttcttacagaatattttcagaatttctgaaactcagatacatttagagtccagggaggtgaccagaataattcttacttttgttatttacctggggagctaatcaatattgttaaaatgtaggtgaaagtctttctatttgaccataagttcagcaataatacggaccacatctgtcttgttctatattaaatctacatcttctagaacactgtctggcacatatactccgtaaaatttctttaataaaagaatattataagttttcactattactaggaatgaaaattgattgcaaattattaaggaaaggttagttttgagttttgttcttggttttcattcattctcttaatttgtaccccatgctttcacaaaacaataagttatctctctactgaagcctacccttctatggcctgagacacatacacacaacacgacatgcccttgccacatctattcaatgctgtcatatttgccatgcatcagaaaaataaatttaccaagtagcagaagctctggaaaatcattaggtgacatctgaggagcagaataccaatcagccaataattagcatctgaaaattcatagagtcacagacaaatcaaattccatgaaatctcagggagcttggctccctgaccctggctgggttggtgcccaggcaatgggtaagcagtaaattgtgccaccccaacaggactggaaggtgccatggctagtctaaccccagggggagacattctgacaatgtggcatttgcacagggatgccctaacatggccccagtatgttttctcagaacgggatgacattttaagtcaaatagctctgttcccaatagcacaggtcctctcccaaactctaatagcctgaatttgagaaaaagaggttcatcttggggagaaactgatgttttgcagatgcaatattaaaacaatccatttataaggaaggcaaaaccagatattcagtgtttaacttcatttattacctttccatcattacatagacctcagatagccttagacttaaaaagtcattcacatttaagcaaaactctgttcctggagcatctacactggatacttttcaatgaatgctgaaactggttataaagttgtgctaccaagaggcatgaagagtgactgtcagtaccttaccaaacccctgctgactggaacatgcaagtcagtccaaggatgcagggccaccactgttactgctgcctccagcctaactaaggtcacctttcctgcatgcctgcctcattctaaaggaagaaaacagagaggttggagaataccagctccccatttggtttctacagttgccaactctacccacatgtgacttggggaaagcacccttaagaagagtggggtccaacgtccaaccagactgacccagccttgggggtaaacattccacctccaccacgtggcctgtgtgcacctgatttgaatctgctcctaccctgagccaagggtgaccattctgccaggtccccactccactgcagggtcaggcagcagcctctgctcctggctcctggcccagtgctcggatggcccagcaacgtcactgcggagagggagtctggttgtgccctcctctgaactctccatctggaagactctctagtctccttccctctcatttttaatctgacagacactgcggacagggaaactcagagcagaccaaagttcatcttccctttcctgcttcatggctggcataatcacaggggcagaacaaggttggcatggaccaggatgccaggaattaaatgagggtccctgaccactggaacacattagtcctgccttccaaagtcttaattagtcttcctgtgcctggcacacctaccaccagggaggtggccgggtaaggtgccatgctcacagcaagtattcaacaaaatattggtagagaatggcggtcacaaatgcctgctggctcatggctttgcaacaacagtcagctctgaggtctgggcaccagcggcaagatttctgctctctttactaatgcagacagttctagcagcgttattctgagtgatattcagccaccagctcaatttggaagcaaaatgatcttaacaaacagtggcagacttgatagacaggctgctgagcctggggaccaaaacaaaggatgaaaagaaaaagaaaggaagggttgatgacaagacgaggagtgggaaatgaatactgcaaagaaaaatgaggaggattacagtactagatacttcagtccggcaactctgaaatgagctgtgaacataacaacagactcaagggtggaaacaatggggggaatcaaggcaacggaacagggcagcatctgtcacgaattttgatgctgggacagacttagcgctagcagtggaatagatttgatagtaagtaatatttgagaggtttcaaaagacaatgggtcttaattctgtcctgttttgcacctcttgaactacagtgacataccaaaatttgctatttttctaagaggacattgacagatacaatgaaaattgtgaatacattttttccttctgcattcattatctctggcccttatccacaggcctattgcagactaaattggattttggatcactggtactgaggtgctgcaattaattaacaatagaaacataatatttatatccaggcctaacaacatctgacatttaaactattctgccagtcggacaaattccattcgacaaattttcattttaatgaacatgacagaccacagtttgcatgataggccaagcagcagaacagagttgacctcttggcatgtgttttcaaggactgaccatgctccagaagaaacaatctgagaaactgtcagaataacagaaagaccagatccccagttccacccagacagaccaaatacataccaccctcatgtcccccagcacagatcctagtatgaaactgtcctcatttcatgtgcgagctcaaagttaaatacttactgccccttgtaatccactggataatttttctatctttgggttgctgacattttctttggggtactgaagtcccttagcccttcctaattaaaaagtgataaacatttttgcaaggcatccaataatgtgcaaagtacacaagagttggaactgatgcagctttttcagttggcacaaaactggccttccacattttgccagatggtgtatctcagtaagtccccaatccctgactcgagtgaggggcattgtcaatatgatgctgaagcagagactatctttaaatgctatcttattttgcattatactaacacgatgggtctaacacttattcttgctgaaactttcacagctaaagaagttttcattcttctgtgactcattattcaagccaacagaatatgatacagataaggggaaaaattctgcccctcttaagaaccatataaatttgctggaaaccaatgtcagagagcagatctcccagcaagacttcccattgctcctctatgggttactggtccaaagcacactgggtgaaatagtatgtatttacccaagcccatctctactaccccaaaaacgtggatgtcaaggatagagataaagatgaaaaatgcaaagacagcaaggcagatagaagcttaatagatctgggaaataagtaaggtcagtgaaaaacaatatattgtagctgggatccctaagggccgtatagttctagttcacatatctacaacattccttattctagtttttatgtcaattcaaaagaactgaaataaaattccactttaaaagtaatacttctttggagtagggatttggttcatgggttccaatctcagcaactgaaatgactacctacatggtaatttgttttcaagctgtggctctgactagacccaaaatggtaaccatgcttatgttactattttattttattttattttattttattgacatggaatctcattcttatcgcccaggctggaatgcaacgatatgatctcggctcactctgcctcccgggttcaagcaattctcctgcctcagcctcccaagtagctgggaccacgggcacatgccaccacacccagctaatttttttatttttaatagagacggggtttcaccatgttggccaggctggtcttgtactcctgacatcagctgatccacccgccttggcctcccatagtgctgggattacaggcatgagccaccacatccagctcatgttacttttagatatggccatgataccagaacattaagcactgaaaggatgacagcatttccaccagtgtaacctaatttagaatcaataatgtgtcactcaaatcggcagcatgtacatatatacatacagtgtggatggacacacacacacacatatatatatacatacattaattatagtaatagccacatgtttgaggtttttacatgcatcttctcttatataacaccatgagataagtactattatgaactctgtaacacactgaggaaagggcagttacagttcactgacctccttaagaggtaaagtcaaggtcacaggcatgtaagcggcagagtttaagtgcaaatccaagtctgcccttcctccagagcctgtgctctacacaacacagtggcatatgacagcatccgcaagggaaacagcatgaaggaattgattccttttggcaacagtcaaaatatcttttaaatatcaggtataaaacattttcagaccaccagatgcttattcaattttgaaaaatcaatttttatggagttgctatgagtagtttcatgtttgttaatgcctggttatattcttgaaaaagtagcggcctcatagagaaaaatatatatatttttttgaaagttgggaagaaaaatgagaccttaactggattaaattgaaaatatttgacagaacacaaatgaatagaatctgtaactttaacatgcctttgcaggaggcatgttctaaaatggtcataccaaattcagaacacaatagacttaacatgcttcttgttgtaaacaaaggcattgggttaaatgaaagttccatcaaagcttaataaccaattcaagtgaacacaaagttaagcgttatatactttctgcggtttcagtaatagctaatctaataatggtaaatggagggttattgttgattcctttgcctgtttcataaattagataaagcaacgtggaagttagagtactttagagttttattggactaagtgattttaaagctatctcaaaatataacgaagtcatgacttgaatgactgctgagttgtagcttgttttccatcaccatgttagtacttttcaccagtgttaaataaaaagcttcctgttaactaaaacaattctataaatacaatgtctatctacagaaccaaaccatttaaggtaaagtgtcattgatacagtatgatctgatattctatttcaccagggccaagcttataaaatattaactataagagcagtcaagtgttatttatttcttctgatacaaaactcaggaacagtagaatttctctgcttaatgattttccatagcacatttccaattttctactacagtttattgatctggaatactaaaacagttttcttccctgtctaaagaacacaaaaagccctgtgcccctagtcccatgggatgtgcctccaaagataacagtcgtggcatctcatcaggcgctgaggggtggtaatgagaagcaaggcattttccttactgaaagaaggtgctagtcaaatctcaggccttttgataacgggaaacacttcccaagcctttgcatttggagatgaggctccacacctgcagttctgagagcagatgagttgcccttcacaaaggcagtctattttcctgcatttccccttcatgccctgatatggttactttcaattaccctgatagtccaggaagaaaaatatccctctctccatatttcattcacataataagaatctgcaagctgttctgtatgacagatgaggactgtgtgctgaagcaacttgttccgcctgtcagcctccgagaacccacagcaatgagatacaatcgtgatgacattactagagaagaagtgggtcaaatacatggtcactttaaaacagaatgtcaaccattctttctacttcagtaatttgatgcagtggtactcaaaacacagacagagagagagaaaaggaaagagagagagaaagagaaaaaagttcaccactattagtttagtgtccatacatacacaaatgcaaatgcaaataattgttaaaattactgttcccatatacccttacatgacttttttcatcctccagccaattagtcaagaaatgtttagtaagcatgtggtatgagccagacactgaaatgggtagaatgctgaaaacagacacagcccctgccctcttagagtttacagtctaggataaaggacaaagattaacaagcaattgagattaatgtaatgaagcctgaaaaaaaacgaagtagaaggtactaaaagagcttacaatataagaactaaccaagtctttcaggtcagtaaaggtttctctgaggaagagacatttaagttaaggtcagaagtattagagcagccagataagaggtgagagagaagagtgacaagtggaggacttttctcctcagaatgtttcctttcaaagaaaccattaagacaaaggcctcaggacacagtagaagatataatggagtaaatgacgccatcaagtctaccattgggacttattgtctttccttatttcaatccctagtttagaaaattaatttttaaaaaaaatttttaaacattagtatacctctgtcctatcttgccacataagggcaaaagttaatcataatcacattttcttgctgatctaaatattaaggtagattttactttaaaaaatctaatttatcttgactgtactggttaaaatccatgggttatttttaaaaatatgttttgacagcagtgaaacttgcagcacatacaataccaagagcataaatttgttcagggtataagtacatgaaaattaatataagcagttggtaaatgtgacttataaaaaaaaagactgtaccaactacatgccacaatgggtggaaataaagaagaaaaaggttctttttctctaatatttggtcatgaaaattctgatttgttcttgcagaaaattgtttttggatcattattcatctctcttacagcatagaacttttttccatgggatcaacaaattggaatggagaggaaaaaccggatatattcatgagtatgtttgccctttctactaaagcccgagtgtgatgttcggattattttctttccaaactcaaaatccattcccagaatccaaaatcaataaaaatggtactagcaaaactgagggttgaatttggcctaaaaactcaatgactaagtagagctactaatatgaggagaggtttttaaaaaaatgtctgtagttattaatcaccagcaatgactttagcagctgctctaaagtaaacacaatctacagctactttaaagcaatacagtgtaaaaaccatgagaattaacattctactgggtgaaaggtggcagaatatgccaccccaaaatataccacattggcataagaattattttcaagctaaaggcacttataaaaaaataatttaaaaaaaaaaacagcaggtgcaagaagggttttctgaccctcttctttttcttcataaaagcaagagctaaaatccctgtatggaaaatattctcctgacaccagaaggaaagtaacattcttatcatcaagggcgggatactgagaccaagagaactctgtacaaacaaaccttattaaactagctcttattttcctcgtcacctctccacccagttaaatatcctggcccaaggccctttgccttgtcacatcttcacaatttactactctttatccaattccatatataagtgttcaattctaacttcatctttgggtcttcatttccttatgagggctcccatgtcacaaaaaaacttacattaaataaatttgtatgcttttcttctattaatctgccttgtatcaatttaatttttaagcccagccaaaaaccctaagaaggtaggggtgaaattttgcttcccctacatctgttacttaggtcttatctagagttcaacctgaaaggcatattttaggaggaatattggccaaactggaaaatatctccaagaggacaactagaatggtgagaggttctgaacttcacataagaaacctggggatgttcagcctggagaaaagcaatgggagacagcaaaactaccttcatacattcgatgggtcattcatcaataaggccattccgttttactgagcacttcctctatacaaggtaccatgcaaggcaaaggagatacagcactgagagagaaagccagtcttttcttaccatgcggaagggaaaatggattttctccatgtcacttcacaagatactgtagagtagagcagagcacagattttggaatcagagcactagagtaaaaacctgtactgggttgaatgccattccccacccctccaatatgtctgtgtcaaatccctggagcctgcaaatattactttattagaaaaaaaagtctttgcaaatataattaagaatcttgagatgagatcatactggattgtctgggtgagctctaaatataatgatcagtgttcttacaaaagaaaggcagatgcagacagacagaaaagaagaagatatagaagagaaggccaaatgaagcaaacagttatgtgggtgcaagccaaagaatgcttggggccaccagaagctagaagaggcaaggaagttttctcccctagagcctgttgagggagcatggccctgccaacaccttgattttggacttctggcttccaggactgtgaggaaataaatttctgttgttttaagccaccaaatttgtagcaattggttacaatagctctagaaaactaatataactcccaattacttagctagctgtagtaccttactagctgtgttacccattgctaataactctagccctctgagaaccaggccctcattaggaaactggagacaatagaaatactcatctcacaggtcagagattaaggaggtatgtcaaacgtgcagcacagggcctagaacaaagtaagttttcagtacataatagtgttattattaatggattcagatttactgggaagcttgtgtagaccttagaacaatatatcaacaggtgtaataacagctaatttatgcagtagggctctctctactggtaaatatatgtagagaccagataaatcattttccagaaatactggaaaagggatgtttatattgtttgggaggctggaataaacatccactagccttccttctagatcaacccagtaaccatttctccttggtgcatcaggtcaagatccttaggcaggttaacccagtaagggaagtgaggtatacacagggtttggctgctaccttaaaaagtcccttcccctcgctgtaccttgttgtctttagctataaaataagcatattctgatcatgtcttagtatttccaacttgaaaatgccaagacacaatgagaaagacttggatcaatgagatagtttgggtatttgtccccccaaatctcatgttgaattataattcccagtgtcagaggtggagcctagtgagaggtaattggatgatgggggtggatttttcatgaatggtttagcactatcctcttggtgctgtcctcataatagtgagtgagttcttgtgagatctggttgtgcaaaggtgtatggcacctccccttactatcctcttgctcctgcttttgccatatgacatgcctgctcccattttgtcttctgccatgagtaaaagctccctgaagcctcccccaaaatggagcagatgccagcaccatgcttgtacagcctgaagatctgtgagccaattaaatctctatttttttaataaattactgagtctcctgtatttctttatagcaatgcaagaatggcctaatatcatcacacacttaaattttctgattctcagaaatgaagcaattagactagagtaaggattgctaaggaccagttgacaaaccaggaccaaaccataatattgtttttaaccagtacctagcaaaatgagaaaaatttaaaaaataataattttttaaatgtctttgcttggcagaattaaaagttagcaatcctatgtcagctcccatcctatctcacttcctaattcaaaaattatgtttacagcctctgaaattctaaagttttggaactggtatatcacagaacaatctattaaatttgattcctacactaatattctgtgatttttttaaaggacatttcagaactgtggattctatcactgacgtgttcaagttcaagaataagaagtcatccttttagaatttaaaaatactcactggtaaaatcatatagaactaaatgttcacaacagtaaaatggaaaaatctaaataaaatgagtcgctagtaaatatgatgctatagttttacaaaatgttatcatgaagagaaattgggtaacgcataggcatgaatctctctatactagttcttacaactgcatgtgaatctagaactatctaaataaaaatttcagttaaaaaatactcactgggttgtgtgcaatggctcatgcctgaaaccccattttggaaggccaaggtgggaggatcccttgagtccaggcatttgaaaccagcctggacaacataataagaccccatttctacaaaaagtttaaaaaaaattgctaggtgtggtggtgggcacctatggttccagctactcgggaggctgaggtgaaaggacctcttgagtccagaagttcaaggtggagccatgatcatgccactgcattccagcctgggcaaaagagtgagtctcggtctcttacggaaaaaaaaaaaaaatgctcactgggctctaaaagttcttaatgttgtttattaattcaaacaatggtcagattcaaactcaataaatataatcaactgtgctttatacatagcatatggacagttactatgaaccatttgtttggcaaagatgtactgaggatcttctatattccaggcactatgctaggtactagagtctggtggccaactcagttcttcccttcacagagagtaacacctagctggagaaaaaggcaataaataaagagacaacttcaaattgtaacaagtgctatggaaaaaagaaaggctgaggcagaaaacacagggagggataaggaactacatgagccatacatatggaaaatgaaactgtgatgcaggaatgtgcccttattttttgtatgcctatattattgaactggcataaattctgaataatgaaaatatgtgcttgggttgtgactgtggtgggctcttaaaggtaggctctgcccttctgcaccaataaaaggagtgagaaaaaaaaagtaaagttgacatttgcctttaacaaataaggcaatacaagactgtccatatgtaaaagttaaacatacaatgggggccgggcatggtggctcatgcctgtaatcccagcactttgagaagccaaggctggtggatcacttgaggccaggagttcgagaccagcctggccaacatggcgaaaccctgtctctacaaaaaaaaatacaaaaatcatccagacaccatggtgtacacctgtaatcccagcttcttgggaggctgaggcacgagaatcgcttgaaccagggaggtggaggttgcagtgagctgagatcttgccactgcacttcagcctgagggacagagcaagaccttgtctcaaaagaaaaaagaaaaaacgtattccataaacatacaatggacacagcactctgtgagatgaaattctttaaaaggtatgtgagtcataatttcccatatatgcccaccaccccttggaggaggaggggttggctctctacctaaactagaagataaaactctctcataatcaaagacaggggaggaccagggaggtcttcaagaggagaaacatacctttgaaattctctcccttcttagaagattcagaatatttcaaatactgcaaagtatgccctgggagccagtcaaaatatgtagtaggccagaccacaggactaggaaattaagatacagctgcctgctcctattaggcctaggtgcagggccagaatattaaggttaacttgggcccagtttggctgaaaagacacaggcttcaaataagactggacaggagagcaggtaaataaatagaatattcacataatggaacattatataacagtcaaaccaaataaagcaaggtacagaacaatgtgtattgtacaatatctttatataagaaaggaaggaaaataacgtacatacatatttgcctgtgtgctaataaaagtggctactaccttaagggagatgggtacaaagatgagggtatgagaagaggagcaagaacaaaatttcactttatacctttttatattgttttgtaaaaataaagagctaaaagattataattctcattgctggtgttagtcacacatttggagagggcaattcggtggtatacatccaggtccttaaaactggcatatccctagacccagaaattccacttttgaaaggaagttatctaagaaaataataagagatttgtgtacacacacacacacacattcactgcagaattatttatcatagttaagaaaatttttttaatctacatgtaaaataataaagaaccagtgaaggaaattatgggccatctaaacaatccagtaacatgcaactgtcaaaaactacactgtaaaacatataccgtagaatactcagtggcacagaaaagtattcatagtatattttttaaatcattcattaatttttcaataccttctttagagcatctaccaggtactaggcactgagctaaatgctgatttaaaaggccagttacaaaacagtatataaatggacaattccattttttgtgcatctgtgcatttataactagactagaaggatagacaccaatatgagagtagtgattacctgagtggcaagattatgggtgaaatatattttctataatgaacatatattatttctgcaatatgagaaaaaagcaccacttttttaatcaggctaacaactcccaggatcaagaatgtgtctcattcatctctctgtcctctcaccccctcctgactccctgaatacaaacatgatgcttgcttcagctgcagcaattctgtggccattatggaaaggccaagaactgcaagatacactctccttgacatctctgagctgctgaactaaagccaaagctaaccatttctagacttctttttatgtggaagaaacaaacctctattctttttaagcaggttacttgcagctgaaagcatttgaagctgacatagtaacctattaaataatacatgacacattaaggccagtacaggcaacccagcaaatttctttgatcaaccagcagaaactgaagactgatgtggttaattgccccactagcttctggctctgtattctcttctctgaagctcctgggaagtagagcccaggagaagctgttagtgaggattcgagatccataggggagcactgcttgctgcaaagaaaaaccaggcagctactcctacagctttacaacgtggcccagcattcccactcctggaaatgtctcctaagaaaaaatcatgaatgtgattatgcacacgtgcaaatacatcagaaaaaatggtgaggaaaacctatatgttgaccaagtgggatagattaaaaaataatgtcatgttctaacagtggaatactctgtagacattaatgccatgggaaaatgcatacaatatattgacgagtgaaaacagaaaacaaaactgtatgtaaagtattatccaaatttagaaaaatgtgtccattttctgttagaaaactaacagaacaaatatgcatgcaataaaaacaatggaaaaaaagccacacactgaaatattgatagtgctatcatgaatgggtgaaatgcaatgttattttattttttgagtatttctatatttttttaaatcttccaaatttattttcttgtgcagttggtaagaaaatttcttctaaatagcaccttcttacagaatattctgggccctccgaccaagatgttcaattcatccacaccaactttgtctaatacctgcctgcagatccaatggagttaacaagaaacaatttatttttgtgttttaaaaatagacatggcaacagctgtaagctaagctacagaaaatgataaagaaattttatttccaaataaatttgcattgtataaatgcagtacattttctttaattccataaggttttgatactgctaatttgagaaaaatattgatgtttccttaaataagtctaatttgtattgaaattcatcccctcacttgaaatggaatgatcttgaaaacaataaaaatgaatgttaatttgctatgtcattgataaaagcaattccttttatatccttgtccttatccattagacttcattttacagaaaaggtagctatcaggcaggtctgacctttttgccacctaaggacattagctattagagctcaagctccctagccggatggcctgggtccatatcttaggcccaccacttgccaactgggtgtccttgagcccttgtttaacctctctgagcttcagttttctcgtgtgtaaaacaaggataatacaagtatcgactccatagagttgctaagaggatgaaatacgaaaatctacataaagatcttagttcagtgcctggccatagtaatctaatttaaaaaaaaaaagtaaggtctcttttaacttgctttcaatttttatgtgcagatagatcatggacctgaaattttaggtcctaaagaggcccaagcatcctggtttaagaacccatgttggaaaaattagctgggtgcagtggcgcatgcctgtagtcccagctacttgggaggctgagacaggagaatcgcttgaacccaggaggcggaggttgcagtgagccaagattgcgccactgcactccagcctggatgacagagcgagactctgtctcaaaaaaaaaagaacccatgttggatacagatacttgacttttaaatgcagactcagtatcatttacttagcgttccctatgataaatgagatgtttagggaaaatgttgggtttttttagaccactggaaattgacttcagcatgtgtattagagaatgtaactaccccattcaccttgtcctgtccagtactttcactaaaagcaaggtattgtgaccaataataaaatcatagctaaaataatcactaacatgtcattagtgcttaatatgtaccagaaagtgccctgtgtgttttcatgtattatctcatttaatcctcacaactaaccaatgaggtaagttctcttactatccccatttttagatgagaaaactgtggtataaagagccaggaaagtgctaagtcaagatataaatatagtatgtaacaatatactatatttactatatgtattataacatatactataataatatatttttgttataatatatagtatattatattatatgttataataatataatatagatatataaatataaatatatattattgttatataatatatattatggtaattagtaataataataataacacagcatcattattcaatccctgtgacctgccaaatgcagctctagatgccttcccagtgacatctcttgtgttgacaacaatcttttactattcttatttaatggatgaggaaactgagaacttaaatgagttacttaagatgagctatagctctgactggttccaaagccagccactccagaattactcttctacagagggcagggaaaacagctcattaggtccctgaagtgctctacccaggtcacagaatgttggagaggaataggacttcagaatgatcagatccaagccctcactttacagatgtggaaagggaggcccagagaaaagagacttgcataaggcagtgggagagccagaactaaaacctgggtctcccagttgacatgatgtagccatctcatgttgagtcagctatctcaggcactgtgaaagcaggaagggaaagctgacagcttcagagtgatgacagcagactgtcctccctctctctgctccctgctgaccctgggactgctgcatatgcttcctggcccactcagagtagcagcaacatgacttgagaagaggctcttcaggagagaacccacaatgaagacaggaagcacccatgcccttacatgatctacctagggcccatttccaatggaatccccctgaaatagaattaaagatcaatggagatggagggttgcctcagacacatgtgggtctcttttgtagacatacaacacaacctaaatctttgagaacatgatctgactcaacaaattacctgcattttttctgattaaatgtacatccatcttagtttgtatactggataaaaataaaccaactcgtacagaaagttttttaaaaatagagttttggggtgtttaattaaaaatgctttcagtattatgtaatccttgaaatacaacagttgtttactctgctttgatttctaagctttcctttgatgacagatattaatatttatcatttttctgatgttggactaatgagaatcttaagtgtttatgagaagccatttaaatattacagtactgcagatatgtttgttttctgatttatattcctgtctttaacatcaaccaggatttatttttttgtgctgaatcctgggttgttgttcatcaacattttcagtaaactttaaatagccagaactgatgatttctacatttatttgatggtcaaagtgaatatgaaacttcaccaaataacatagtactatgggaaaggtttagttatgatttataaagtaaaaactggaatgcatgtataactgctagccaggaatagagtaacattccaggtttaatgacactgatctcaggtcatacgtattgagtgctgagtatgtatcaggcactgtgtagaacataattgaaatcaatgatttcacttgattcttacaacagctctaagagctaggtagtattatcatctccattttacaggaaagcgaagctcagagaggttgagcacttcactcaagatgacacagcaaatgagaggcaaagccagaagtgagtcctcagggtcagataatgggctcttatttataattcctctctcaagggtccctctgtgactccccagtatttgaaaaatcttattctctacaaagtataaataacccatctgcacagagcaacagtcttcagacaacccagactttcagatcttgatggctatgatgagtcacacctcattttgtttatcataggccatgcattgttctatgcatggagacagcaataaacagcaccaacaattgtccctgccctcatagtgctatctttctagagagggaagatagataatattaacacaataaacaaagcattatcaccattatggggaggaaacgggaggctatgcaaattcagagaaatagtaaaaggggatgaagtctgcagtttctgtagatttcacttgcatatactccccatgcagccaagactcagctaaccagagaaatgacttacaatcagtaacagaagatggcccagaagtagtgtggtacagtgcaaaatctaacactgaattctcagttagggacctgacataaatcactcaccctgcataaggaccaggtgcaggggagacagccatcagcaaaatagccactaccgctgcccttcatagagcttacagtccaaagggaagagaagcattgatttaaaatcaaaggttaaataaaagctgtaaaaagtataagaaggaagcaaaagacacaggagctaacctataggagactaagaaaggtcaacattctgccaattgcactgtctgtgacccacaccaagtcatttttcctctttacagccagtttttcaaatatgcaaataaaggagagtagactagatgaatccaaccagcttctttcaagctctttttaaaaatctcttgaagccatgattctaacatataaaaattatgtatctcctcttctttccaccaattaaaagatcccaaactgtcagtccctttcattgtattcatctgcctcactactgctagggctttgttcttgattttcactgccatttggcagagaagtcaaatcaggagggatatggatgtgataccgcattagggggcagaagtgggtatcgcagatgctctgatcagaacctagtgaaggaaatgagaaggaattgggttatacaaatggaacctagggtccagagagtgtattaacaggtaacaaattagcctgtggagatagtaggcattagggaagcatcagccaggactgtaactcatgttctggccaaagggaggggaaaaaaaaagtctagaagtagtggagaagcagatgagtggaagagaggtctagacagcaaacagcatggatccaaccacaatactgagatccagggacaggagcattacccatgggaaaaaaatccaaattccatactttgacttcaaggccctgtatggcctgggccctatctatacagccaatttcatctgatgtcagtctccctttccctctctatggttcagccacaggggccttcttttctccctttgatggtgttaagctctttcccaccttaaggccttggtataggctattccttctgcctgggaccccattctattaataccagctcttcatatggccagctccctctcatcctttacttaggtctctgcttaattctcagctctttctgtctggccattttatctcaataggttactcatccctctttctatcacagtatcttataatcttccttcttgtacttgacatattattattacaggtgtttgcctatgtgttatctgtccccttcactagactccatgagggcagtgctgatattttatatagatcatcccatttaattcataacaatctacgaagtgggtactattatgtccattttacaaagagaaataaaactgcaaagaaaaacaactggccatatatatatatatatatatatacacaaattctaaacaatactactcattacattaaaacagaatggcaacttagtagaagccacaaaaatctgaaatctttttatttcaagtgtagcccatggaccagcaacatatatatcacctggcagcttgttggaaatgcaaacacttctggcctcaccagggcccttgcatatagttccagcagtcctcaacccacaggagttggacccagctgttccatctgcaacaggaagccaaacacagctaacacctctaggccagggaaaccttggcctgttgccttgtggaagttcaagaggctagaggaagccttagtttagaggaagctttatccctgctcagaggagccaagagagggcctcagctgtagatttttctgaagcttcttggccttgtttttatccaccaggctggcagaacccagcaaatgggatttcaaactacagtggctacctgttttgctgtatccctagtgtcacatccctcttctgaaggtatcagcagctctcgttaaccagggcctttctgtgtgtacagccctgcaagctttgcacagcacaactccagcaggcaccagtcacatatactctggtatgaatggtggcctctgatgctaagaatgtggcagccctggcccacttcctctgggtgaatctctcctctcccagggtgggcatttgctccacacctggccactcacagtacccctccaactggctatagaaacaattccaagtggtaggcatatggcccaagctagaactccttcaatctgctgtaaattttgaggtattatgggcaaatagatatatttcagcccatacaattgagtctctctaaacttgatggaaaaaatctgggatctttaaggtaacatgttatatctgattattaagatgggaatttaaggtaccttgccttctaatggaaatttatgtagccaattacagtgcccccttctttacataattttaacccattgggattgctttctaaccagtggttcttggccctggctacaagttagaatcactagagcatgtctcgtccagatcaattaaattgggaaaggttggtggcacaggccttggtacctcaatttcagctgcgctagactctgactactcatctatgtaaggcgtcccaaagtggcatatggtgtgctacatagtctatgcttccaggcaggccaacaaagtggtagactacatccagtgaaaatcagacctgccactttctgatgatgtagtaactgacaggcagagactaattttacttacacaagtggctgtaaaacaaaatattcccctctctctccaccccaccattttttgttgttctacctctcccacactctctgcatttgttttacctccctcttgcctctcctgctctcccttggatttcttgccagggtcattcctagaagagattgaactggaatcgctagtgctccaggactgaaacaatcttactctaagcaggttccaacccttccctccacctgtcctcagggctccaaacgcataggtaaacttgtgcttctgggcacagcttaaacatctactgacaaaaccaagcaggtaccgtccttcagttaatgtggagtccaaaggcagcagtgagttttgtgttttgctttgttttttcaaaactaagatgtgggaagaagacttctcagaaaataaaaatcttgttcttaccacattccacagacttcagtgattaaatgactgtagattgtatgctcctccagcctggtctaactaaaatattcatgcattaaaccttgtgagggagtactgatacttcaacattatctatgatggtttctaactccagtagctgtgagtctgagaaactgcaaaatatactgaattttaataggattctgattgttaagaaaaagaggtaaatccataacaaagaacactaataaacacttaaaaagactcagcaagagtctttaagttacagaatcctgaaaatgtgtatcttttgtgaacttctcaagcagtttctcaattttctcttctattcccacttattcatcattaaaagaaaacactggcatacaaacaaaatacccctaaaataagtgatttttaactgcagttaacactctggcaaaaacactctttttcccaccctttctctttttctctgtatggagtgaacagaccagaaaagtaaggccactacattgtgaaataacctcctggtgggcagaaaggttcaggaaatgctgaaaaatgaaattacggtgctgggtaatatatattcaaaccaagaatgttcctggaccgttgatataagggtttaaatataaatataaatactcaaatataactgtatgcattttctatgagtcagaaaaacaactttccaaaggaaagggtctgaaaggggatcagaatatgctaccccaaaatatgccactttggcataagggttatttgagttgaaggcaattaagaacagcagattcagaaaaaacaacaacaaaaaaaaaaacacctctgccctcctccatctagctaaaagcagggcacagattttcctttgtaaaggtgacatattttctataaataaaggttttcccctttccctaccagagagacttcttacctgcataaacaaaccttactaaacaaccttcatttaccatacattttcctagtcattttttcacagtttatccccctaccccagaagcccaaatccccttgtccttttgtaaccacccaacaggttcattttgcctgctgcccagatggtttatccagagagaggaattgcaacagagaaagaatttaattcatgcagagccggctgaacaggagaccagagttttattattactgagatcagtctccctggaacatttcagagactgggattttttaaggataatttggtgggtagcgggccaggcagtggggagtgctgatcggtcgaattggagatgaaatcacagggagtcaaagctgtcctcctgtgctgagtcagttcctgcatggaggcacaagaccaaatgagccagtttatcaacctgggtggtgctatctgatccatctagtgcaaggttggaaaaatatctccagcaccaaccttaggttttgatgttatccctaggagcaactggggaggtttagaatcttgtggcctctagttgcatgactcctaaaccataatttctaaacttgtggctaatttgttagtcctagggggtttgggaaagggttgttatcatctttgttccaaagttacactataaactaagatcctcccaaagttagtctggcctacgcacaggaatgaacgaggacagcttggaggttagaggcaagttagatgcggttaggtcagatctctttcaccgtcataatttttgcaaaggaggtttcactttgtctagtttcttctccacataatatataagcccccagacctaaccacctctttagggtcttcacttcttttctatgaaggcctctgtatgcatatgtaataaatgatttctcctcttaatctgtcttttgtcagtttacttttcagtgccccaggagcagaacctaagaaagtagagaaaggattgtttttcttttttcctccctcacaatcaccacatatatggattatcaagaaaattaaaggtatgtaatcaaattagcttaattattcttctgctttgacagaggatgggggtaggaagaaaactttataataggcagcctttctagaagtggttcatttcaatggttcatttcaagctactcaattagaatgtaagaatattaccagtaaaaatgagtggtattttatctgaacaactgtttaaaccctttcaataacactgccatagatcatgaaagcatgtcactgagtttctttggaacacagttttaatgggattatagccccccactccacccccagctatgaggaatgaggcaaactaagtacaggacgagaaacacaacctgaaattcaatataaggaaaacccttagacaagcacagcaagagatacaaggagggtaggggagaaagagtgtccctggtagttaatctcaaagataactagtgcaaaatttatagttagttcatcaaattccatgacagctttgtgatgacgcttttctttcattcccaaagccttcaaaatgctactttctagatatttcattccccactcagaccttttacctattggattatacctgattcattccacgatgctgtgttattagaatcagtggttttcaatgttaaatgcactttagaatcagctgcgaatcattccacaatgctgtgttattagaatcagtggttttcaatcttagatgcactttagaatcagctgggaaatgtaaaaaataaacaaacaaaagaaatcacacaaacaaaaaaaacacctgctcccctccccactctttcggttatctggatgggaccagccccaggtgattctaacttacagccaagcctgagagccactagttggaaagcaatccaaacaaattaaaattacataatgaaggaataaacttacattaggaggccaggtacctcgaattcccatcctaataatcagatataatgtgttaatttaaggatcccagattttgtccatcaaatttagaaagactcaattgcatgggatgaaatatatctatttgcccatgatggggttcaggacatactaccctgaaatattgtaagctgaatgaatttgagaagacagcagaagccagaaggtcagaggtcactctctgaccttccttctgccctctctgaagcaggtcataaaacctaggaagaattatctggccttctcctgaagcaggtctaagaccctcctgtgaaaggtttctcacttcccatacctggaatgaaagaacatccttatctctgaaaacaaagggttacagagaatctgaacaaacaggtcttgctatgtttcctcccattgttagctcatgttttcttattcaatcatacttctacacaactatgtacttcttcatcaaatctagcataaaaaatacacaggtttaccagttttgggggtcttcattccattatgaagaatcctgtgtcacataaaacttacgttaaataaatctgtgtgcttttctctcgttaatctgtcttttgttacaggggagtcaaccaagaacctgagggtgaggaaaagatacttctcctccccgaccccataatacgccaacttttacagaggattgaagaaattccaaacatcatatcatagaggtaagcaaaaacagtagaattaaaggttatctaagtcctcttagtattcaaaatatgataaacaaggaaacagagcaggatgcatcaacttgtgttttttattgacaatgataagaataaaatcattagctaccatttatggagtaccagttactgtgttaagcatttcaatgggttacctcactgaaaactaaaaacatccctctgcaatagaaattatcgcccccatttcacaaatcaggaaattgaggctcagagagatttggacactttccccagagtcacacacatagaaagtagcagaaccaagattaaagtccaggtcttttgctctatcgagtccattctcttaactacatcatctgtcacctagaccactgaagagtatcctaagtacttgctactcaaaggacgatccatggaccagcagcatcagtctgttagaaatactgactctctgatcctttccaggtctttaatttaatcagaatctgcattttaagatcagcaggagacttgtatgcacattaaaattaaagaagcacaaacatacatgcttatcccacatcaactattacctcagataaattcattatccataatgcatccatactttttaaaacctgatttacttgacaaataaaaattgtatatgtttatggtatacaacatgatgttttgaaatatgtatcccatgtggaatggctacatcaagctaattaatatgcactacctcaaatacgtatttatttgtggtgagaatgtcagaggtgtttgaaccagagcaactccatcttcaataggggctgagtaaaataaggctgagatctactaggctgcattcccaggaggttaaggcattcttagtcacaagataagatagaaggttggcacaagatatgggtaataaagaccttgctgataaaacaggttgcagtagagaagttggctaaaaccccccaaaaccaaaatggccacaagagtgacctctggtcgtcctcactgctatactccctccagcgccatgacagtttaaaaatgccatggcaatgtcagaaagttaccctatatggtctaaaaagaggagtcacgaataatccatgccttgtttagcatatcatcaagaaataaccataaaaatgagaaaccagccaccctcaggactgctccgtctatggagtagccatccttttattcctttactttcttaataaacttgctttcactttactctgtggacttgccctgaattctttcttgcataagacccaagaaccctctcttggggtctggatcaagacccctttctgggaacaagaacacttaaagtctacactctaagtaatcttcaataatacaatacatagctatacatccatacttttatgaaaacaaatccaacaatttcatttccccatttaaggccattaaacaatttcccaaatgccctcggaataaggtcgaaatgcaggtaaccggactctgcatagtattactcaggctcaccattctcagcaaactaacacaggaacagaaaagcaaacaccacacgttctcactcataagtgggagttgaacaatgagaacgcatggacacagggaggggaacatcacacaccggggcctgttgtggggtagagggggaaggggagggagagcattaggacaaatacctaatgcatgcagggcttaaaacctagatgacagattgacaggtgcagcaaaccaccacggcacatgtatacctattaacaaacctgtacattctgtacatgtatcccagaacttaaagtaaaattttaaaaaaatttaaaaaaagaaaaacatatctattactcaggctcacctctgcagccttattctctccacctcctccagccattgattttcataccctaagcacacagaccttctttctgctcatcaaatcccaacatcccctccctccctccctcctgtcctccattgtactaggttcttccctgccgagaatataccctcactcaccccatcagtgcctccctaccagccccatttactgctctcaccagagcagatgcagtgcctggaacagagctaggagcaagataaatgtgctgaataaaaatatgtttaggatactgagggcctccgctgtttcctttgtccttctcctctgctgttgctgtgatcctcattcctgttgctccttccctgttccctgcatcacttcttttcagtaactcacctccttatcgtaacctcatggctattgaagttgtcagctttagaaagaagcactgccacatccccacggtcattgccccaggattactcaccagctggatgacaactgcctcactctaaccctgagcctcctgggataggaccaatcctttctagagatggacagaaggccccactgacagaaacaggctgcttttaaatcaaggatttaatatataggtggaaccatagatcaggggcctctcagcaggcagtaccgagccaaaagcttcactgtctctctgcccacacaagagagtgtcactgtgctgacaagacaggttatcaagagttgtgaggaacttcatattttaaatgtgatgaccaagtgtgctactctaagaaaacaagtggcaaacaaatccttttataatataaatacctgcttaaagttttaaatcttgaggaaatgtgaattttcatatatcaggcttacaataacaaaaataagagctattatatttatctattgactgcaagctgttaagagcctgacaacatgctcaaagctttaaacacactttcttcttcatcatcactgtgaggtagaaatgcttattatccctattttaagagagaaaaccaagggctaagtaacctgtctaaaaggcacagctgggaattaaatcatgggtccccagacaacccctctactgcttctctgctatgtcttactatatagatcactttctcatctgagaagtcacagatatggacattcccaaagagacaaccccttggagaatgatctcaaaggctgagatttttctctgcaatgtacatgttgaaagcaaagtaacctcctacatcttatatttcaaagctgcacttctgcattaaaagagtaaacagattcaatgaagagatgtgggaacagggtgcttatgaatgcaatgccacaagtactttttcagtgtctactggtggtcaggcactgtggtggaagctgaatgatcagactatcagttgggagagcgtgggggtgggggcatgggggtgatgaggagaacttctcaaatagactgtttcaggaatgtttagccaataattcataaaactgttactttattacctaactatatggaaatcatctttcagaagagaccagagttacctgccttattatctgtgaatacataattgaaagggccaatatgtcttccaaaatgaaagtcacaacttgatagatttctgagagttcatattagagggtcagattttaacatgtgaatgcaaacatagtgtcagaatttgttctcaagtgtctgaaagaacaaaagagaaaagagtaatgggagccaaaaccagactaacttccaaaatagaaacagagcatgttgaagttgcataaacacacaaataaagatggggacacaaaaacatttcctaaagcattctatcaaaggctgcaggaaaaaggccaagacaaggataccaaatagaaaagcataagcctaaaaaggttatccacactactgtgaggactccagaaacctgccttcttgcagaaacgggatacttttgacatgagggcatgagatgaagattgcagactacttcgtaacacactctcctcatttataaaataagagttagattagattatttataaggtccttccagtctgaatgcattaagtccttatcatctatgtggtccttgcaccttaagagagatgaccatataaagaagctcaaaaaacatttgttgaattcatgaagtattacaaccttaccaataataaataagataatttataacaattggtcctggtctgtggccttgaaagagcaaattagaggagaaaccattatctaaagagctacacatctggtgttcctgctagctgactgctggtggaatgaaaataaccctggacttgaaaataagatgcttggttctagtctaatctctgacacaaaccaactgtgtgaccttgggcaaactgctttaccacctgggccagtttcctaatctctaaaataaaggtattctaaaactatatacatatatatatggaatctttattataggccaagaagtgttccaagatctttgcattagaattaaatgatctcaaaggtttttgcagctcaaatgtttagtatctaagtacagaggcagcatggtataattaaaagattccaaattctgtagccagaaaggttggactcctcctcagctctgtaaggtaaggtctttctctaagcagagactgttaagcagaagggcttacagtctcagtccttttattcaccagtgttttaacttgaacaagttacttaactttcctagccttagttttctaatctgtaaagttgatataaaaatggttctcactctcatatagcttttaagaggattaaattataacacatatattttattgaatatatattatattgctagctgtgtaatcatgggctatcttctcaagttttttctcatatacaaatgggaaatgtagtattaaaaagagatcatgtgaacaggttctaaatggtcaagtgttagtggttttggaagcatgtacgttaatacttggaacaccgtatacaacaatcccatatctaacacttagaacagcatatgcaatcaataacaacacacacacacacacacacacacacacacacacacacacacacacacacacacacaaaccctagacttctttctttactaaatatttctagtccaggttgcagcaggtggacacaggccggcagccatgaacgcaggtccacatgggagttgtagttccgagtcaagcggctgctctacagaacggctagaagcgagacttcgtctcccaggagacatctcgccgtgcaaaatggcacgccacgaggtggagtacctgcccgacgagaaacaagaggcgggactgcaactcccagaagcctccgcggccaaggcctcaggccgcaggctgaagccaaggagggagagttcaggtagatccggcttaacatcaggtgcgagtagggaccacccttggtagtctgggcccggcccaggtcagaaccttactaaaacaaccactgtgagtattttctattggtcccagcacatttctgagagaccagaataataatagcagtaaatctgcaagtggtaaactttcacaagcataacctcaatttagatttcggcttcaggcaacatcctttggccacttgacctgggagcattgagctccttgtttcccagataagcgctgtgagtggctgttccaaggtaacacagcgagggcagaatgtgagcctacagagaaatctgcagatgcatctcaagttccactaacctgcctccttaccccccaccaccaccaacttggatatacctttaaaattcccccctttgacgctaaaaataaaaacaacaaccataaaataagtgtaagaaagtccgaccaagtaccgatgagttctcccacaacaataaattcgatgcctctttgcctgtttttgaagtagtaatgtaaaattatctcccaaaatgctgccttctctatactccggtttgctcctgtcctgggcacgtgttcagcaaccccttaggggaatccagagctgcgtgtttaacacagacctgttgggacggattttcgctacttgtctatgaaactgacgaaccatcccaaaacggcgggtgccgactacacccccagagccaagagctgtggcgtccccggacccgctggcgtggccccgtgcctcagtttccccaatgtataaacacggtggaggaggaacgggttagggctagggtcggtgcttgggaattggggggcccgagtccccaccctgagaccctcgtggggcggaagagtactcgggacagaagcccaccgccccgtgagcggcgccggccccactgggctccggggtgatgacctgacgcgcgtggaaacccagacccgcgccccagaaacagtattccacttgggcttgcctccccgcccctaccttccaggatgttgacagctgggaatgaaaggcagagggagggagcgcggggccggagcgccgcctgggagtgtgcccactgggtggccgcctgagggacccgggaacagagggcaaaaagtcctgtgaccggacagagcagagcggggactgcaattc

SEQ ID NO: 865 - DNA, 1502099 bp, Homo sapiens; identical to SEQ ID NO: 864
  misc_feature (369735)..(369735): n is a, c, g, or t
  misc_feature (455030)..(455030): n is a, c, g, or t
